United States Patent 7,745,391 (HUMAN THROMBOSPONDIN POLYPEPTIDE) - sequence listing, part 225

SEQ ID NO: 586258 - DNA, 1128 bp, Homo sapiens
  misc_feature (441)..(441): n is a, c, g, or t
  misc_feature (471)..(471): n is a, c, g, or t
  misc_feature (573)..(573): n is a, c, g, or t
  misc_feature (684)..(684): n is a, c, g, or t
tgcagtggctcacgcatgtaatcctagcactttgggaggccgaggcaggcagatcacctgaggtcaggagttcaagaccagcctggctaacatggtgaaaccccgtttctactaaaaatacaaaaaaattggccaggcatggcggctcacgcctgtaatcccagcactttgggaggcagaggcagacgtatcacaaggtcaggggttcgagaccagcctgaccaacatggtgaaaacccgtctctaataaaaatacaaaaaactagccgggtgcagtggctcacgcctgtaatcccagcacttcaggagcccaaggtgggtggattgcttgagttcaggagtttgggaccatcctggatgacatgacaaaaccccgtctttacagaaaatacaaaaattagccaggcgcggttgcacgtgcctgtggtcccagctacttgngaggctaaggtggaaggattgcttgagccntggaggttaaggctgcagtgagccatgattgcactgctgcacttcagcctgggtgacagagtgagaccctgtctcaaaaaaccccccaaaaaaaaaaaaaanaaaagccgaattcgagctattgccaattggcctatatgagtcgattacaatcaatgcccgcgtttacacgggggactggaaaaccctgcgtaaccacttatcgccttgagnaaatcccttttccagatgcggaatacgaaaaggccgaacgttgcctttccacagtggcaaccttatggccatggaatttacgggtaaaattggtaaaatcgggaaaatttggtaaacgctatttttaaaaaagcccaatggcaaacctttaatcaaagaaaacccctaaagcttggggggtctcttgcaaaaggccttttaaaaggggctccccatgggggaaaacctttttggagggcccccttggaaacctccaaaattttttgggccggaaaacattaagccccataggcccctttaatttggaaaagctcccctgcgggaacaataagggtcttggcctaacaaacgtccatggacacacccgctaaccctcgcctctgaattttcccaggggttcccagactctgtcacttccacttttattggcctctcccccctgct

SEQ ID NO: 586259 - DNA, 726 bp, Homo sapiens
cgtccggggcgagcgctcagcctgagcctgcccgcgcctccggagccctcccccccgtgctccatgcgcgcgggtgggtcatgagcacagcgccctcgtttctgccctaagaagcagtaagcacagtggtgggggtgggggggggaggggggtgaaccctgctggacagcgcgctctctggaaatagctccggcccggccaggttcgtccccggccggcagcaccaagcctttatgtgcacgctgtgcccccctctgacccgcctgggccaggccaaacgccttgcaatcaaaggtgctgacatatgctgacgggcacgaactggccatattttgcaccccgagtacctgcaggccctgtgacctttccaccgtccgggtcaggcgcccaatcggagcgtcggatgccaagaaagagccccggttggacgcgtgtagggcgcaaacagtgtgggcaggatcgggaagcccggaacccctcggcccgtcctccaagactcgtcctcgagttgcctccaactggggtgcggccgcgggcggttgcccgccggcggttgctgccgggcgacaaggaccacaaaatcggggcccccctgaagctagagcggacatcgggttgacgcgacaagtcggagtacaaggccgtactcaaaaccgggctcggatagaagggccggaagcgccggtgcacgggtgcgaagccggggccgcggaagggaggaccgca

SEQ ID NO: 586260 - DNA, 134 bp, Homo sapiens
acactcatctatatgccagtaaccaaaacggacacactgcagagtccatcatgatgccacacacgggaatccaccatctggccatcatgccaggggaggcatctatctctctggaggtctcagctcatggtctc

SEQ ID NO: 586261 - DNA, 182 bp, Homo sapiens
ggaaggcgggggacccgggggcaagggtggcaggccaccaaggcagggcccaacggtggttcttccaacggtcttttccatgtttgaacaaggccagatacaggggttcaaaggaggcttcagctgtatcggccagaatcgtgatggcatcatctgcaaggcaggcctgagggagacctact

SEQ ID NO: 586262 - DNA, 364 bp, Homo sapiens
cgcaggagatcagcacacctaacccctgcattgctcgagtcaactgtattataaaagtagccttaataacttgatcgttgatgcggcatacatgtttccacttgtcataactatatagtatgcaaacgctgttgagtctattttgcatcctaactatgtctatacatagtcagtaagatcacggcaagtcagcttccctctcacactgaaccaacacacatccacgtgtcgactactgtcccatgtacgtctgtagcttgcacgtatggcacacccagagccattaatgtgcagggttgattgttctttcagtgcaaggcagtacttatgttacccctttaagtccgtgcataaattgtaagtg

SEQ ID NO: 586263 - DNA, 316 bp, Homo sapiens
cccccttagccttctcctgcttctcttttctccgtagcacttttcatcttgacatatttatttattcatgccactgcactccagcctgggcgacagagggagactgtatcttgaaaaaaaaaagaaaagaaaagaaaagaagagatgcggagacagacacatgtggagggaagatcatctgaagacaaaagagaagacagctgtctgcaagccaaggagaggagcctcagaagaaaccaaccctgctgacaccttgatcttagacattcagccttcagaattgtgagaaaataaatttctgttgtctaagccaaaa

SEQ ID NO: 586264 - DNA, 544 bp, Homo sapiens
agatcccgttaaaatgcttccctgaaatcaaaactcaatgcctggagaatttactgtttgttccagccaaaacttgatgataggcagataggtccctgaaccccttcttagagcagtcactttagaaagcttgtttctctacccttggtgatgtaagtctaccacccaacacagtttcctcaaagacttgggagccatctctttgaaatgcaaatattcagaaagataactcaccctagctcctagtccctgtacaagaccggtaccttgctttagctagcaccactgcctcctatcataaagatagaagtttgtttctcctctggataagagccagttaacaaacccaaatggcctaatcacatcaatcaacaaaccaccgtgcccccctgccaccccccaaaacttaagatccttttgtgcctttcctttttgcataccacagccttttgtttcagggaagtgtgggattagtttgtattacactcttttccctattggactagcatcactgaataaagtctgtccttactgctttaaaaaa

SEQ ID NO: 586265 - DNA, 357 bp, Homo sapiens
tggtttttccgaaaggccttccttgtcccagcctacacagaacaaagccaaatcaaaggctatgtttggcgctcagctgtgggcttccttttttgggtgatagtgctcacctcctggatcaccattttccagatttaccggccccgctggggtgcccttggggactacctctccttccccatacccctgggcaccccctgacaacttttgcacatactggggccctgcttattttcccaggacaggctccttaaagcaaaggagcctgtcctgggagccccttttcaaactcctaagacttgttttcatgtcccacgttttttgctgacatcccccaataaaggaccctaactttca

SEQ ID NO: 586266 - DNA, 573 bp, Homo sapiens
  misc_feature (98)..(98): n is a, c, g, or t
  misc_feature (242)..(242): n is a, c, g, or t
  misc_feature (271)..(271): n is a, c, g, or t
  misc_feature (282)..(282): n is a, c, g, or t
  misc_feature (305)..(305): n is a, c, g, or t
  misc_feature (307)..(307): n is a, c, g, or t
  misc_feature (329)..(329): n is a, c, g, or t
  misc_feature (370)..(370): n is a, c, g, or t
  misc_feature (407)..(407): n is a, c, g, or t
aatgtatataatacaggtcctctgtctaattggagttatggcaggaccacaaggcaggagaaaggggttgtcaactggcatccagcagtctatcaggnttggttgggaaaatttccagctatagttgtttcagcaatgcttctcaggagctggtttctgcttgattacaggaaaacttatggcacaacattgggaccaacccctcatcctgctagccatgagattttctttttttttttcantttctcatgttagcctagccatagggttnccatctggtcngtctgtctgtgggggtatatttnancagagatatgacttaatagccnggcagatgtcagtgcaccaaagctgggaagagggaaaattnaggttggtaactcataacaagccggttaaaatgagtncaaagttgaagatgagaagccaagacagaagacattattaccccaatgagaaggcacctgcaacagctttctatcaggtgtgaatgagaaagaagcaagtaattagctctgctccctccctgaacagtgatcatttttcttccatctccaaccccgaacacggata

SEQ ID NO: 586267 - DNA, 342 bp, Homo sapiens
gggtccgccatcactgttgtcccggagatttgatggagctctgaatgttgatctgacagagattccagaccaacctggtgcgctacccgcgcatccacttcccttctgggcagcatatgccgcctgtcatctctgttgagaaagccttatcatgaacagatttcggtagcagagatcacaatgcttgctttagagccaaggcaatgagaatggtgaactgtgcacctcgtcccaggtaaatacatggcttgctgcctgttgtcaccgtggtgacgtggttcccaaagatgtcaatgctggcatggccaccatcaaaaccaagcgcaggatccagtttgtgga

SEQ ID NO: 586268 - DNA, 340 bp, Homo sapiens
ggtaggaatttttaaattaccatttccatcttggtacttggtataaggtcctgttccagggcatttaattcttactgatttacagctaggaggtttggatttttcccaggaatttatcatctcttctaggttttctagtttatgtacctaaaggtgttcatagtaacctagaatgatcttttgtatttcagtggtgtcagttgtagtatctcctgttttgattcttagttatgttatttggattttctcccttcttttcttggtaatctgctaatggctattaattgtatttactattgaaaggaccagctttttgatcatttatctttgtatagttttc

SEQ ID NO: 586269 - DNA, 149 bp, Homo sapiens
gcgggcctgtgggaggggtgagtcctttgccaccctggcgccccccaggctctacaatgcgtctagatggtcggagtcgcagggcagcgatgctgtcgcaggggtgggtgctgcacgagggagcgtcctgagactctcaggccctcgcc

SEQ ID NO: 586270 - DNA, 966 bp, Homo sapiens
gctcgtgtgttttcctctcggtgtgtgctgggttttgatccttttgtgggtcttcatttcgccctttcctcattgggggtcttcttgctctcccgggccccttgggccccatttgctcccgggcccgtctcttttaaggaaagtgtgctttatccatatctcagggcgcggggaagttttcgtgcaatcggccatggtgtcgccttgaacccccctgaggtcaggtatatcccccggtttctgcccgaggcctttgctgaagtttgctgctgcccctggacccctccatttgctgccgccttcactcctggaccttccctaccagatcccgcccccttccgggagcccgccttcttgtggttactgacccccgggctgacccccagcctttcccggagccatcttatgttaacctaccgacccttgccctgtgtaaccccgattctcctctgccctatgtggaccttgccatcccctgcaaccacccagggagctcccctcccgtgggtttgatttggtggattctggctccgggaatttcctgcccactgcgtggccccctttcccgtgaacaccccctgggaggtcactccctgatctgtacttctacccgagatcctgaagagattgaaaaagaagacccggctgctgctgagaagcccgtgaccccaggaggaatttccgggtgaatggactgctccccgctcctgagttccctgctactccagcctgaggttcccagactggtctgaaggtgtcccggtgccctctgtcgcctattcacgccattccctactgaagactggagcgctcagcctgccccggaagactggtctcgccagctccccctgctcaggcccctgaatgggtaggacgccacccctgactggtcttaagctgttcttgcataggctctttaacccgccctggaaaaatggttgatggaaaattaacctccgtttttta

SEQ ID NO: 586271 - DNA, 1903 bp, Homo sapiens
  misc_feature (414)..(414): n is a, c, g, or t
  misc_feature (720)..(720): n is a, c, g, or t
  misc_feature (908)..(908): n is a, c, g, or t
  misc_feature (1877)..(1877): n is a, c, g, or t
gcagaggggtccatacggcgtatgttcttggattccccgtcgtaacttagatgggaaactcttcacaactgtccggatcccttgatgctccgtgcagatagaaaggacgcgaggaatagtcctgtaaagtttgccttggcaagcattgaagcccaacttagagtaggctacacacactcttgagcttaccatggatggacacatgtatactctgattgacaaggaacaagtgatcgcgacactctcataattacagtagagattctacaaggtaggcgcatcctggcgagtaaagctctacttgtctaggccagggtccgctggcaaatctggtctatgaccaattgtaacataccccctggctgtatagtctaggtgctaactaatgctctcaccaaggcaagtaacttgtgnaccacagaagagcgacatgattagccgtagaaaggatcttggtctgggctcgccgcaggctgggaagacccaacatgcgcaatgtattggcgtagagcccgcgtttacagcttccctgtgaaaaaccattacaccatacacatgcatagaatttccagaggcaagcgactttcccagggaggaaggccccaaacgcgactcttcctttggttggggtataacttagaacaccccctacggggacttttgagcgcagactaggatacctgcctaccaaccgagacagtgcgataacttccatatgtntagaaagctctgaaccctgtactctaatttagggccgctgggtacgtttagacaaatacagggaatatctatcccgtgctgagtccgccctttaatagctttgggacaacttattctttggccaccagtggcgccacaattggtgccaaaacgaaaacctagaggggagcaaagtccttcaaacttcnaagctagggcggatattatgacttggtcggggctgacaagtggacttagggctatccaggggcaaagggtttgccatggctgccaattggacgggttggagacaagcggcaatgtcttcacgcgtttgaaaaaacaatcgcgctagtgggagagacgttgtccaatgtgcccttcgaaattccttgcgtaacctgtatcgttacacataacaggaatttcgcctggaaacggaacgcagttggacatagcggggaatgcaacgcaatgggcctccgctttgcgcttcgctaaaaggtgcttagtgtgacaccaacatgagtcgggcacatattccacacgggattgaaagtctgcggaaccggcgtaacacccggaaatccttgggcaagttcaacactcgtcgtagacttcaaaacttgcacaagtgtggtcgcagacaactgggtccctgtgaacgtgtctggataccatggcttgtggcacccttttgtgtgtgcaccaatttttcacgataagattccacttaaatgtgaaaacgacagtgtgagcgcggtgacactgtttcagggatagaacggtgacagcagagagacacccacaaggtgccagaggcacacgtctaatgggtatggatagcaacccagtagacggggtactcagaagcgagaaactagcgacaaaagcgcacctaagacgagaggagacaaagtcggatgagtgcagaaaaaacaaagactcgctcaatctgacgacacgaacccagaatcagaccaagacgacgctgactatacgtcgtacggatatgagataagaagtaacgatcatctaatcaccagcaacaatgacaatgagagaatagcacacatcatgagctatcacaactacatcagatcagcatcgacatgaacacgaacgtaatcgatcgagactgcatatgactcaaactacgaaatcatgactgacagacnacaagacaagcagacggcagaacgat

SEQ ID NO: 586272 - DNA, 551 bp, Homo sapiens
gatgacggtacgtaccagatgtgtacagttgtaacatgcaaatgactcacgagaatgaagtcttttgacaaactatattagagatcacaccaccgttgattcgttgtatcgaagagatattcaaggagaaagatctgactctccaaactgcatctgagattgccactttaaacagacctcatttcaaacatgctacaacgccactggtaataaagctttggaatgggtgctcattctattatttcactacaaacagcatagaaagcaagagaagtcgggaatttattctaaaatagaatggaggttgtcatctacagcagcactcctcactcctctgttgccatttttagcaagtactccttgtcgatcttgaacagtctccaaccctcttcactggacagatcagaagcacctcttcttttatagaagttgatggttggttcattccattctgctaccaagaagtgcatgctgctgcagagacacctcattgcaacctggcttagattcttcagaatttctgatcctatgccaaagcctctataatcact

SEQ ID NO: 586273 - DNA, 210 bp, Homo sapiens
cgtgtacatctatgcccaacaaagttccaaattttatacctttctttaccacttatgaagtatggcgtaactgttacactttaaggagttcttaaaaagaaatgtgaaatttaacgttttactttgtgaaccgtgttgtgatcagaacgagtattaaatatcacataccacagtgagttaaacacaagagaagtgaaattaaaaaacaaa

SEQ ID NO: 586274 - DNA, 329 bp, Homo sapiens
  misc_feature (2)..(2): n is a, c, g, or t
  misc_feature (54)..(54): n is a, c, g, or t
  misc_feature (83)..(83): n is a, c, g, or t
  misc_feature (153)..(153): n is a, c, g, or t
  misc_feature (167)..(167): n is a, c, g, or t
  misc_feature (238)..(238): n is a, c, g, or t
  misc_feature (255)..(255): n is a, c, g, or t
  misc_feature (276)..(276): n is a, c, g, or t
  misc_feature (315)..(315): n is a, c, g, or t
anttcggcatgaggactcggcgggcgctgttgaagggagtcgggccgcgactcntggtctttttataccttcccgcgcggacncggcgctgccaacggaagggcgggtagggcggctctgctgcaatgaaggtgaagattaagtgctggaacngcgtggccacttgnctctgggtggcaacgatgagaactgtggcatctgcaggatggcatttaacggatgctgccctgactgcaangtgccggcgacgactgnccgctggtgtggggccagtgntcccactgcttccacatgcattgatcctcaaagtggctncacgcacaacaagg

SEQ ID NO: 586275 - DNA, 117 bp, Homo sapiens
atacatatacaagacctacaaaagcactttgtacaacgtaaagcacattacagagaataggagactaaaaaaattacaatacaaacaaaaactaaaagttatatacctagatatata

SEQ ID NO: 586276 - DNA, 249 bp, Homo sapiens
cgttatgtatgacacatctctccaatcatcttcagctgatgaatgtagtatgagagcccttctccaaagcagaggtagaatgtacaggtttcaccatggattttctacttataatcgtttttggaatcagcttgacagattcacaggtccctgtttgtatatatgctttattctattttgcttttttaaaaagataattttgtttcatatttaaagcacttgtatagtcaatgttgcttgttccgctgt

SEQ ID NO: 586277 - DNA, 389 bp, Homo sapiens
  misc_feature (47)..(47): n is a, c, g, or t
  misc_feature (122)..(122): n is a, c, g, or t
  misc_feature (136)..(136): n is a, c, g, or t
  misc_feature (356)..(356): n is a, c, g, or t
  misc_feature (381)..(381): n is a, c, g, or t
ttgcagacagagtctcactctgtcacccaggctggagtgcggtggcnaatcatggctcactacatcctctacctccccaggctcaggtgatcctctcatctcagtttcctaagtagctaggnctacaggtgcgcancaggcctggctaatttttgtattttttgtagagatggggttttgccatgttgctcaggctggtctccaactgctggactcaagcaatcacttgccttggcctcccatagtgctgggattacgcacatgagccactgcacctgggtctgacatgttaataatgacattaactttatgtttctagggaacgtattcacggcacctccattttctttcaggtnttgattttatattcttcaacaaaantctatcca

SEQ ID NO: 586278 - DNA, 1481 bp, Homo sapiens
gatgggacactttaacctgattgacaggtgatgttcggtcttgcagggggacgccttgatcatcgactccgactactttgcgcaagcgtacacttgggaagcatggttgaccgtgtaccatagactggtggacttgctcaatgtagcctttctcatgctattgcaaaactgtctgggcagtcttcaattacaggaactcgaagcgtacgtacaagcgagctcgcactcttacaagtcgtagattccataggcaggtagcagattacccacattgagctgtgcatttgaatagagtgaatctcgcgctcttactatggaaaagactcccttaacttagcaagacgtcgatgaggcgggagttcgcataattctgtggatgtgtcgcatgtaccccagacatagacttgggtactttaccttgaggacctatggggattcgggactctacctacgctaaagtgcaatagctcggaccctagtatgttaccgcgttgtcctaagcccaaagttcgtagttgccaaaaagtatgttcgtaatgttggccagctcttttgatgttttaacatgtgtggttcccttggtccaagctttaagggggcagttaactgttctatagcggaggaaaattttcgcgcaaacaacatgggccagagcctaggggaaagtgagtgaacgagctggggtgttaacccagaaattatgaataggatgttccagtaatagcaatttttatctgcgtcaaacactgtagggagaaataggtagggtgctagttggttgagtagggaaaggcgaataaataccctggggacaaacaaaagcctgttagctagtatgggaatggctataatttcctaggttcttcgaaggggacttagggttgggagagccgcttgatgtttcctgggagacctttttggtggaagataggtgtgattggatggatggacgattgattctagggggataggtcgagaggaagttgggggttgcggggaaggataggttaggtgtctggtgggaccgaaaggtagtatcgaaaggcggggagtggaaacgaggggcgaattgctttgtctaaggctgtgggggttgccagaggaaaatttctttgcgcaattggaatggaatttggggtggaaagtatggagagaaaaggtggggcgtttgcattgaacctcggtttagactaccgactattgaggctagacccattggagcacgaggtcgcattgtacagaagggggaggttataatgaatccatccaatcttaccttggggaagttggcgtcgcaatggaacaacccccttttcgttgtgtgggcagattccaggaaaagttttctggaaacgctcgcttgttgggagaaaaagacgaccgcttgtgattatagttgggtggaccccggggcgaaacaagcgatggcaatggtggacaattaggacgggcgaagacaggggataatattactcacaaag

SEQ ID NO: 586279 - DNA, 402 bp, Homo sapiens
  misc_feature (11)..(11): n is a, c, g, or t
gggccttcacncttaaaaataatcagtctaggttgggcatggtggctcacacctataatccccagcactctgggaggccgagacaggaagattgcttgatgcccaggagttcaagaccagcttgggaaacatagcaagaccctgactctacaaaaaaaaatttgctggtgtagtggtgtgcacctatagtcctggctagttgggaggcggaggtgggacgatcacttgagcccagggattcaaagctacagtgagctatgatcacaccactgcactccagcctctctataaataagtaagtaaataaataaagtcagttagttacaaacctttttaaagacaatttacagttaggtctgacctttaaaggtgctggttaaaaataattatggccaaagaaat

SEQ ID NO: 586280 - DNA, 281 bp, Homo sapiens
gctcgacctttgggaggccgaggtggatggaatgcctgaggcagaagttcaagatcagcctgggcaacagggcaaaaacccatctctgcaaaaaaactacaaaaaattagctgtatgcagtggcacacacctgtagtcccagctactggtgaggctgaggtgggaggttgaggccacagtaagctgacattgtgctattgcactccagcctgggcaatggagactctgtctcaaaaaaaaaggtcaggcaaggacacacatgtgtgatggcatttttgtcg

SEQ ID NO: 586281 - DNA, 578 bp, Homo sapiens
tttttcctagcagcagtgatgatatcaacttacaaggtctggctttcaggatttcagaagctggcattcaaggacaacaggcagtttgtcagagctgaatgagaatcagcctggacaaatcaagtgctttaacaagggcatcttccgtgctgggagataatccagtcgcttaatactagttgtgcgagcttgaacataatgagttttggtgaaagtgtcgtttttctgggctgcagcccccgttttgaagtaaggccgttgtaattttaaatggtctggaaagatcttcgatgctttctgtaaggtgtagatcaccaagaagccagaacttttgggtgaaaacagagatttataaaatgagaactgagaccttcgtcctttcttacaaagataaagagtcctgtcagactccagtctcagagccacctttgcccatttgtgattcagacttgcagagtgaggagagaactgcttcagccttactgtcttgtagagagatttggtgaaaatcatgttcactgttagacccagtagttttcaggagcgcaacaggatgcggggcacctgggcttcccggg

SEQ ID NO: 586282 - DNA, 301 bp, Homo sapiens
aactgcgaacggactgatcaggaggtcaggaattcgagaccagcctgaccaacgtggtggaaccccgtctctactgaaaatacaaaaaaatgttagccatgcgtggtggcacacgcctgtaatcccagctactcagaaggccgaggcagaagaatctattgagcctcggaggcggaggttgcggtgagccgagattgcgccgttgcactccagtctgggcaacagagtgagacgccatctcaagaaaaaaaaaatagccacatgtctagcacataggaagagatcagtccgttcgcatgtt

SEQ ID NO: 586283 - DNA, 323 bp, Homo sapiens
agaaagaaagactgaagtctatgcaaaagagtgcagggtacggaccgggcgcggtggctcatgcctgtaatgccagcactttggaaggctgaggcaggcggatcacctgaggtcaggagttcaagcccagcatgaccaacatggaaaaaccccgtctctactaaaaatacaaaattagccaggcgtggtgttgggcgcctgtaatcccagatactcgggaggctgaggcaggagaatcgcttgaaccgaggaggcagaggttgcggtgagctgagatcgtgccattgaactccagcctgggcaacaagagcgaaactccatct

SEQ ID NO: 586284 - DNA, 313 bp, Homo sapiens
tgaattcgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggag

SEQ ID NO: 586285 - DNA, 119 bp, Homo sapiens
  misc_feature (85)..(85): n is a, c, g, or t
  misc_feature (94)..(94): n is a, c, g, or t
  misc_feature (96)..(96): n is a, c, g, or t
aagagggctcagactaacagcagattttttcattagttaacactgaggcaggagaattgcttgaatccgggaggtggaggttgtngtgagccgngntcacaccactgcattccagcctg

SEQ ID NO: 586286 - DNA, 738 bp, Homo sapiens
gccgacgccgtcctgtggaaccagaggaagcgggcagaggagcccacgttcggctggtcacctcgaaatatctccagtccgtcgcagtcccgcaagagtgtaaggatgttcgcactgacgccgaaggcatcgactgtgcgagccccgctcatctgatccagagtcttggatccaggagttgcatacaggaaccgaatttcgttgcaatcgagagttaatcctcgaccagaggctaataggactggagagggctctacggtatttaattggggcccatgaatggtgtgtctcagctaatccaaaggggagtttcagaccagtgcaatcagcagagacattgagtactgctgccaaatttatcgcgtgcaggtgctgtcaactaggtaggacgtggctggttctggtgctggtattggaagcacgtctttggcagccttatcagttggttatgccataatacccttcgctgaagcaggcagctgtcctcatatgctatcctggcgcatttgccttgtctgaacgcgtagtggggtctctctggtttgatggttgctttcttgattattgttatgccatgtaacagattactgcttgacatgttggcatttcatacttagttacgggatgtagtactgtgtatcttactgtgactccgaaaactgtagtattgggtgtctgggcactgtacgttatttcccaagccctttcttacagatgaaactttgagaaaggcaaagt

SEQ ID NO: 586287 - DNA, 146 bp, Homo sapiens
ggcaagatctgtcaggagcatgtgggacacaggttagctgaacaaaggcccaccctactttaggcctctctcaacagtgtatgtgtgcacgaggataggctatcattagccatcagtaaactcatactgtcatttgatacctttcc

SEQ ID NO: 586288 - DNA, 851 bp, Homo sapiens
tgatgggctacgctgtggctgtgcctgcatgccatatgtgttgctttgtgtgcctgctgtgtgtgtgctgctgtgtgtgtgtgttgctgctgaatgttgacctttgctgtgtgtgctgtgtggctggtgagagaatgttgctgcctggtgacctggccctagacacttgagcctgctgtgtgtgtgatccccacctggctctgctgatgtgccctgctgatgctgccagtggatgtgctgccactgaggtgatgcctgtgtgcatgcctgctggtgccactttcaagtggtggtgccctgcctcgcctgccctgggctggtcgagagatccttgtgtgggcacatctctggggtgctggtgaccctgccctgggctgcatttcaggggtgtctgtgtgtgcgcaattgccatgggtgacatcttggatggccctggcccttgcttcttgtctgggctccatgtggtacccccctgtggattgtgcttgcagcttgttgccccctctgcctgtggccctgccctgtggggccgcctgggcaaaggcggtgcttgaggttcagccctggggattcgcctgtgtgccgcctggccctttagccgaccactggctgacattgcttctgtgcttgccctgtggttcaggctgtgacacaccttgtgagcggcgatttgggtcccgcctgttgtccgcctactgtgcctgcctgctgcttgcttgccctctatgttctacgttggcctgttcttcgtcaattgtgctgatcctgtactacgccttcctcatggaggtacatcgtcctcaacgttgggcctcgtcttcctgcccgagggacttgaccaaggcgctcta

SEQ ID NO: 586289 - DNA, 440 bp, Homo sapiens
  misc_feature (340)..(340): n is a, c, g, or t
  misc_feature (375)..(375): n is a, c, g, or t
taatattttcttagctctgatttatatatttggcattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttgggctcactgcaacctccgcctcctgggancacgtgaattctcctgcctcagcctcccgagtagntggggactacgggcaagcaccaccacacccagctaaattggttgtattttccagtagatacaggg

SEQ ID NO: 586290 - DNA, 129 bp, Homo sapiens
ccgctgaagcggaggcgaaggtgagacgtgacgcaggcgatgacccgcgcgaagcgcgccgagcgcgcgacggcgcaaagacggccagcaggcgggacgccagtaaaggcgcgccacgccacgacgaaa

SEQ ID NO: 586291 - DNA, 689 bp, Homo sapiens
agcggaggggagaggagatgcgccgagggatggaggtgtatgtcaccgaggaggctgctgcgctcctgccccacgccctgggcccttgaagcctggagagtcaccgccgagggatgaggacgcgccagcccgggggaacgcgccagctgctttcgcggcccccaagcgcgcagtgcccagcaagccgcagccgagacctgacacgctgatcctcatcccctcgcgcacagggctctgcgagtgaccccaggcgggcggagctccgtgctagcaatggaacgggctgcaagacaggccaagaatggacaagtcaggatgctgggctagcaaagggaccctggcatgccagtcacccaaaaggaccaagggccatccgtgggacatcaggaagcaggcccagaccctcattcgatcatacgaagcgctcaaagtatcaacattatagttcccagtctcttggaaacaacggtgggaagaccatgcacataccgcaaagacccgcggaaagccagctccgacgtggaaccaaccgcgaagagtcgccaaaagtcccaccgacacagacagataaacacaaaaggaggagtgtaggagccgagaacaaaccagaggcgacactcgggaagaacaatcctcatacaagcgacccaccgaggacacgcacaaagaaagcacgaggaggaaggcca

SEQ ID NO: 586292 - DNA, 649 bp, Homo sapiens
taagcagccttgtttgctcacacaaaactgtttggtggtctcttcacagcaacgcgaatgaaattggtgccatcactcggatcagggacctcccttgggagatcaatcccctgtcctcctgctctttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaatttcccactacctacccaaatcctataaaagggcccaccctatctccattcactgactctttttggactcagccactgcacccaggtgaaaa

SEQ ID NO: 586293 - DNA, 128 bp, Homo sapiens
tagagagggtcaagggcgtgcaccaagtcggtctttcctctctttaaaagggggttggattggccataaaagacacacattggacattttggaagaatacattctcttctctatttttttggagctca

SEQ ID NO: 586294 - DNA, 720 bp, Homo sapiens
atgttaggcagctgagtatgggagccaggagcctgccatgaggttagagaacagagatgctgttcagagctggaagcagcatgtcagccaagagaagccgatgcagcctcagtgttccttgccttgggggtactgagtggtggggtgtaagcagatcctgccaggcacccagaaggaaactcatcaggactccctcagaaagcaggcccatgaagacgtcctgtgacgtatcatctaaagtaggtcatgagacccctgagcattaaaacggagtgatcgcgattggagaagataaggagacatgacgtgccatgccctggggtggggactaaacattcgtgccagtccacgtgaaagggggaggcatgactccacgagttatactgccaacaacagagccggggaaaggaggacgcaggaaagacgcgacgtataaaccaagccacaggtagatggtacaacatatcgaaaccaacgggacccgcctgtgcaaaagactacttcaatgagggtgtcaatcacaaaaaacgctacccagcaaggaaattaaataaagcagtccggagagcaagcaggacgccgacacacaggctgataccactaccgatactagaacatacactgaaagacaatgataagcgaggaacaagctggcgatgcacggatcaagcggtgcaggacacatgcctctcacggaaataaggctggctaggagacacc

SEQ ID NO: 586295 - DNA, 243 bp, Homo sapiens
gtggatccagacaactatcagaccggtgtcgtcataaacagacaggactgattcacatccatcctcactgctggctgactgttcctgaagtcttcgagggccagtcggccagtatcccactaaggaatattggcttccagggcctttttgtggattttgggcgataactgagagcagcgcctgaggtaatccaaggccgggaggcaaaaggtctgtggcaccgggaataccggggtagctggg

SEQ ID NO: 586296 - DNA, 315 bp, Homo sapiens
ttatagcacaactagggtcagttttgcaggtgataagccatttaccaagatagttgtaggtaaagaagggcagatttattagagaaatgtgaaaatatgttgcagtgggcagctcagcagagaaggggctgcctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 586297 - DNA, 975 bp, Homo sapiens
aaattgggtaaagccatttagcataagtatagaatagatatgccgatactatcgtagaaggtatgtggcgatctatttggataaaattctcaatatcgagagtaaatcatcgtgatgtttctatagatcatctttgccagctcaaatagaaatagaataccctatgtagttgtggaacgttttatgctaatattgtgtaactgatgattgaaaccctaaagggttctgccgtaccactgttggtatatcagtatgattttagagcgagactgtagaatcttagaaaagaaagatagtcagtgcgattactctatgcacatagaattgctcttagatatcgttcaatgttggccgtcatgacattacaagtgtttggaatttgtactgcaactgtctgtcggcatagtatagacaatccttttgtatttccagtgtgaagattcttcgaaatcaagtataggaagtagaattgttagaaaagcgagttgagtgttaagcgagaatcattatcagatctgctccgacaagatgataatatcgtagctttattgtcccatgatggctacaattgttgacaaaatatttatcgaatatccttctatgggctcattttgtgcgagttgagagaatgtcttaaaagcaacattatagcgtaggtccatgtaggtgtattcgtgtgtaaactacttcgagaatttttgaaaatcaatgctttgactggttgggagacccgatggggaaatacacattcaaacattagagtcagagaccaccaatcatgcgaagaagcggaatagggcgcgccgtgggtagggtcaacgagaatctctatatgccaatgtttgcccctctctaaaaatgtgggggagcacccaacgctgtgggctacattgggtgtgtgtaaatcccctcaaacatgccatttctgtgggcacacactcaattgcggagttcacactggacaaggagtgatgg

SEQ ID NO: 586298 - DNA, 445 bp, Homo sapiens
  misc_feature (285)..(285): n is a, c, g, or t
tttatacccatctactcctgccttttttccccaaatgcaactggagaaacttgtgtgtatgctagcatctagtcaatattagtcacactctgtggtgctagatgctatcaaattactatattagtagtagtgacatagcaactactataattagaaaaagatgaatggcagattttatgtaggcccaagggcattatatagtctaggttagtgttgtagatcatagataaagccccatccatcccagcagtccctcatgtgggaactcggtacgagatcgtaccnttgccccacttctctataactccaacataaccagtttccctctagagttggaacagattatagtttagtagctcaccaaataaagtacgtagcttgtatttaccagctatggtatataaaaatatgaatcattaaatgctagtataaagcagttagtctt

SEQ ID NO: 586299 - DNA, 916 bp, Homo sapiens
taatgatggagtatcgctcttgttcccagactgtagtgcagtgtgcccagatcttgggtgattgtgactctacctcccgagttcaagtgcattctcgtgtgtccgcctccacagaggtaggcgtcgggattaggtcatgagccacgacgactcgtggcttaaatggtttatagtatgtttgagtagagatgtggcgttacacctatgtgtgcgccaggctgggtctcagaaaactctctggaccttgcaatgtgatccagtgcttgtcctcaaggcgtcctgagtgttgtcttgttcgcattcacatggtgttggacgccccaatttgtgactccgagagttcctcacctttcgttttgtgtgtactaaccctccaatttttgggttcactggccatgggtttggccagaaaattaataaaaatacacatacacactgaggcacacagcatgagacaacacttatttgtgtcgggggggcagtgggttatgagcatggccccgtgttagaaattacacgtgtttttttactaagcagaccattatccgtgtgtatagtgggtggagccgggcgggggaggccctaatttgaagaggacggacatgaatgtcaaaccttttgggcgttgcaatgatgcatggttatgatcatatgagaagtaagagaaccgtgaggatttcagtgaaaataaagtggtgatcgcgagtatgtgtcttttgacggatgtagtgaataattcgcgcctcacggggagtgctggaaaacatcgagaaaggtttttgttgagacaagaacatcctcacattcgtgtggatcatttgtgatggaagcgatactaaggagagaaaacactaaataagaccatggggggaagtcacaacacgagaagattgtagaatgtttagaaaaatttgat

SEQ ID NO: 586300 - DNA, 266 bp, Homo sapiens
cgtaagtgtctcacaatgaaacatgaggctccccgacccaggcactcctgatctaaaggtggacagtttgagtgaaattaacattgctccccgtgattctcaccaagtttcactggagtaatgccacctcagttcaaaaaggatttggatccctatcttaaaacactctagtgtacttcaagacacttctgatatcttttaacaaagtcaggcgctgatcacagcggtccagctcgttcaggcagcttatgacatcatactgaaac

SEQ ID NO: 586301 - DNA, 161 bp, Homo sapiens
  misc_feature (4)..(4): n is a, c, g, or t
  misc_feature (42)..(42): n is a, c, g, or t
  misc_feature (54)..(54): n is a, c, g, or t
  misc_feature (141)..(141): n is a, c, g, or t
  misc_feature (150)..(150): n is a, c, g, or t
atgncatacatacagaggacatccagatccttcataggtggntttttcagcggnaactggagaggcaccacagaggagggatggagagcaatcttgccccagggcgcctgggattccaggctcaagctctggctcttagcntgggaactngggcaagtaat

SEQ ID NO: 586302 - DNA, 323 bp, Homo sapiens
  misc_feature (54)..(54): n is a, c, g, or t
  misc_feature (71)..(71): n is a, c, g, or t
  misc_feature (108)..(108): n is a, c, g, or t
  misc_feature (116)..(116): n is a, c, g, or t
  misc_feature (129)..(129): n is a, c, g, or t
  misc_feature (138)..(138): n is a, c, g, or t
  misc_feature (165)..(165): n is a, c, g, or t
  misc_feature (198)..(198): n is a, c, g, or t
  misc_feature (314)..(314): n is a, c, g, or t
  misc_feature (319)..(319): n is a, c, g, or t
gtcatgatgttcgttggcttcctgggctgctacggggccatccaggaatcccantccctgctggggacgtncttcacctgcctggccatcctgtttccctgtcaggtngccgccgnatctggggctttntcaacaagntcccagatcgccaaggatgtgaagcanttctatgaccaggccctacagcaggccgtggtngatgatgacgccaacaacgccaaggctgtggtgaagaccttccaagagacgtttgattgctgtggctccagcacaatgactgctttgaccaactcattgctcaagatcactttgtnttccntcgg

SEQ ID NO: 586303 - DNA, 160 bp, Homo sapiens
gtgtctgtccatgcgctgcagtatttgcggttcccagaggagttggcaggaggtgagctggggcctgcgggaggtgagatggaggtggtgaggaatttgtctgggctggaggctggactgaggcggagagcaggcggtactctggcgagctaccccgctc

SEQ ID NO: 586304 - DNA, 127 bp, Homo sapiens
ggcgagttattataccatgaaatgattgaatctggtgttatcaacttaaaagatgccaccagattcaatcatttcatggtataaatcattgccttcacgggtcctctcaccaacaccagcaaacaca

SEQ ID NO: 586305 - DNA, 189 bp, Homo sapiens
tgatcgtcgctagctccacgagcttgtaccgctggtcgtaataccgtccttcaccactgtcgctcaccaacttgacgttgaccggcgcattgccaaccgcctgcacgctgcggatggtttgtacatcgaactgattgccgcgaaaggcctgggggcaacccgtcaattccagggtcgagccgccagaag

SEQ ID NO: 586306 - DNA, 325 bp, Homo sapiens
attattacccagtcttgagtagttcttaatagcaatgtgagaacagcactaatacaatggtctatgtattgaactagtgttttagtaggtggccaataattatctttggtttctatgtttagcactcccttaaggacctcctttaaggcaggtctggtgataacaaattcccttagcatttgcttttctgaaaagaaatttatttcttcttagtcttacgaagtttagtttggctggatacaaaaattctatggctggaatttctattctttatgactgctgaatataggctcccaatctcttactggcttgtaagggtttctgt

SEQ ID NO: 586307 - DNA, 856 bp, Homo sapiens
  misc_feature (102)..(103): n is a, c, g, or t
  misc_feature (134)..(134): n is a, c, g, or t
  misc_feature (164)..(164): n is a, c, g, or t
  misc_feature (182)..(182): n is a, c, g, or t
  misc_feature (184)..(184): n is a, c, g, or t
  misc_feature (202)..(202): n is a, c, g, or t
  misc_feature (212)..(213): n is a, c, g, or t
  misc_feature (256)..(256): n is a, c, g, or t
  misc_feature (258)..(259): n is a, c, g, or t
  misc_feature (264)..(264): n is a, c, g, or t
  misc_feature (272)..(272): n is a, c, g, or t
  misc_feature (281)..(281): n is a, c, g, or t
  misc_feature (305)..(305): n is a, c, g, or t
  misc_feature (311)..(312): n is a, c, g, or t
  misc_feature (345)..(346): n is a, c, g, or t
  misc_feature (394)..(394): n is a, c, g, or t
  misc_feature (398)..(399): n is a, c, g, or t
  misc_feature (404)..(404): n is a, c, g, or t
  misc_feature (406)..(406): n is a, c, g, or t
  misc_feature (421)..(421): n is a, c, g, or t
ctcactcctcagctgcaggagccagacgtgtggagtcccaggcagaggcaactgtgtctcttcatctccctgggaaaggtgcccccgaggtgaaagagatgnnctggtggaaatcctggattgaacaggagggngtcacagtgaagagcagctcccacttcaanccagaccctgatgcaganancctctacaaagccatganggggatcggnnaccaacgagcaggctatcatcgatgtgctcaccaagagaagcnannacgcngcggcagnagatcgccnagtccttcaaggctcagttcggcnaggacnntcactgataccttgaagtctgagctcagtggtnnagtttgagaggctcattgtggcccttatgtacccggcatacagatacnagannccaangnagctgcatgacgccnatgaagggcttagcgaatccaatggaccggtgtctatcgatatgacgatcctggcactctcgtgaccaagaagccagctgcgggacataatgaaggcgctactgagtgaacgactactgggtccacgcctggaggatggacatcctaactcagacacaatgtggcctaaccttggggagcaggatcctgtggtgtgcgctccgtgtcaccggccaagcgacgtggtccttgattgcttgaagccaaggccttgggtcggcacgcccagtgccttgcgtccccttccccaagtagtgccccaggatctggtcattccgtgccgtgctgaagacagcaacccgtcggcgacccctgcctctgacttcacattttcctcaccgctcctgatgcccgcccccgtgtcccctcacctgtgcctccagtgttttgcgcccc

SEQ ID NO: 586308 - DNA, 778 bp, Homo sapiens
  misc_feature (44)..(44): n is a, c, g, or t
  misc_feature (76)..(77): n is a, c, g, or t
  misc_feature (79)..(79): n is a, c, g, or t
  misc_feature (104)..(104): n is a, c, g, or t
  misc_feature (122)..(122): n is a, c, g, or t
  misc_feature (145)..(145): n is a, c, g, or t
  misc_feature (193)..(193): n is a, c, g, or t
  misc_feature (228)..(228): n is a, c, g, or t
  misc_feature (251)..(251): n is a, c, g, or t
  misc_feature (270)..(270): n is a, c, g, or t
  misc_feature (285)..(285): n is a, c, g, or t
  misc_feature (334)..(336): n is a, c, g, or t
  misc_feature (338)..(338): n is a, c, g, or t
  misc_feature (347)..(347): n is a, c, g, or t
  misc_feature (404)..(404): n is a, c, g, or t
  misc_feature (489)..(489): n is a, c, g, or t
  misc_feature (698)..(698): n is a, c, g, or t
  misc_feature (771)..(771): n is a, c, g, or t
ctcattagtttactggctcactttacccctgtctgacttcagantgctgttatgacatattgttaaagggccaagnntngggtttccataaaggtattgggggngtctgggggtactttggngcctatgggggtggctgggtctnggttgggcccgtgggttgggtgggtgggtccggaggggtccacctganaggcgatagctgaggttgcctgtgggaaaccagtnatgtggacgtgtcagcttacccnggggggcaacggggtttgngcaattgggctcgcngggggggagcttcaggtactttcttggacttagctccatttacaatttnnnanatgcgaaanatactcactatacatagggttgatgtttctttggagagtgagggtgaggtgattgancatgagctaatggactgctaacagagaaaccaccaggtacaagtgcacacacatgcttggtgcctggccagccttccacctagtnggggaggagctgtttctcttcctggccgccagggggcagttagctcatggctgagaagtctctcaagggttcagttaaacaagcttccaaatcaaactcatcctccacttgactgtccatgtgtctcaccttggtgggtgtgcagagtacacatcaaagtcatcctgagagctggtctggggctcggagctgctttctgcagattcaangtctacagggtgtatttcttggcaatcacatccttcttccgctggaggatcccaaaatgcagagcaccttccngagtttg

SEQ ID NO: 586309 - DNA, 792 bp, Homo sapiens
  misc_feature (102)..(103): n is a, c, g, or t
  misc_feature (134)..(134): n is a, c, g, or t
  misc_feature (164)..(164): n is a, c, g, or t
  misc_feature (182)..(182): n is a, c, g, or t
  misc_feature (184)..(184): n is a, c, g, or t
  misc_feature (202)..(202): n is a, c, g, or t
  misc_feature (212)..(213): n is a, c, g, or t
  misc_feature (256)..(256): n is a, c, g, or t
  misc_feature (258)..(259): n is a, c, g, or t
  misc_feature (264)..(264): n is a, c, g, or t
  misc_feature (272)..(272): n is a, c, g, or t
  misc_feature (281)..(281): n is a, c, g, or t
  misc_feature (305)..(305): n is a, c, g, or t
  misc_feature (311)..(312): n is a, c, g, or t
  misc_feature (345)..(346): n is a, c, g, or t
  misc_feature (394)..(394): n is a, c, g, or t
  misc_feature (398)..(399): n is a, c, g, or t
  misc_feature (404)..(404): n is a, c, g, or t
  misc_feature (406)..(406): n is a, c, g, or t
  misc_feature (421)..(421): n is a, c, g, or t
ctcactcctcagctgcaggagccagacgtgtggagtcccaggcagaggcaactgtgtctcttcatctccctgggaaaggtgcccccgaggtgaaagagatgnnctggtggaaatcctggattgaacaggagggngtcacagtgaagagcagctcccacttcaanccagaccctgatgcaganancctctacaaagccatganggggatcggnnaccaacgagcaggctatcatcgatgtgctcaccaagagaagcnannacgcngcggcagnagatcgccnagtccttcaaggctcagttcggcnaggacnntcactgataccttgaagtctgagctcagtggtnnagtttgagaggctcattgtggcccttatgtacccggcatacagatacnagannccaangnagctgcatgacgccnatgaaggggccttcacggagaccaaggcaggggtgtcatcattgaagatcctggtctctcggcaccaggaaccatggctgcgggcacgatgctgaaggcgtatgaggaagactatgggtccagcctgtgaggaggacttccaaggcggacacaagtggctacactggagaggatcctggtgtgcctcctgcagggctgctgggcttgtgtgagctgtttctgtggcccctggggtgtgcctctaagacgcgctgggctctgtatgcggcaggtgagacgcttcgtgggactgatgcgctgaggttcatcacgcatcctgtgcacgcgcaggggcgttcggcctgtgcgagtgttctgacgagttgatggat

SEQ ID NO: 586310 - DNA, 880 bp, Homo sapiens
cagcagtcactaagcttgtaaccaacgtcagtcatggttctacaacccagaagccaccagtggtataactgcttcacagtcctctctggtcagtaatagcagcagtggcagcagcagttctaccaccatcacctattcctaatacagtgtgcagtaacagctgtggtgtcctctacaccatctgtggtcatgtcaacagtagcacaaggtgttatctacatcagcaatcaaaatggcatcaaccagattccttcccccaaaagcttagttgagtgcccccaatcagattctgtgcaagttccctaaaaaatcaaagtctcctaagcagcagttatatcagtgcacccaggacacagcaacaagtggcccagccttctccagtatctcatcagaaaagctcagaagttctccttgtgccaccgtgtattaaactaccatccaaatcaaacaggagtcagggtgtcaaaaatcatcaccacaacaggttcacccaaagtaaaaatcttacccaaaccagtgacagaactctacccaccagtagcaattcccctatttatggtggttagcaggtaagtggtgcaattatgacaataaacgtgctaacccacttctagttggacacaaagcaactatatctgtgcaaaagtgagccatccattgtcgatggttgaaccctggagctggcccttttgtgaactcacgcgtgggagctcttacacgtgcccaatcatacgacctgggggaaagaataagagaaaagtctcgggcgactgacattgaaggtgcggtcttgggggacacacaatctggggtattgcactcgtcgacacatggcccttgcgaaacgaggcaccacacacgggagacctcgcgagcaacg

SEQ ID NO: 586311 - DNA, 243 bp, Homo sapiens
tgctgggattacaggcatgagccagacctcatgagaactatcagaaggacagcaacaaggggatggtactaaaactttcttgagaaagccacccccatcatccaatcacctcccactaggctccacctccaatactggagattactacaattccacatgagacttcaaggggaagggacaaatatacaagctagatgagtaagtataaattatttggggatcccagaggttgggacaacatct

SEQ ID NO: 586312 - DNA, 1534 bp, Homo sapiens
ccttttggggaaattaatcataaatggtgggttatgggcttgccctagtagcatcatattaggttagttatgctaccaagctttggtgtgcctatattcgcagtatacagggagagtatttaatatccgcgtggtggtgtgggcgacctctcacccctcccgaacatatgttgtgtgctcacacacgtttatatgtggacaactatagaatgcccgttgtatgataatcactcccatccgttggggacgcacaaatatagtgtggttttccaacaccgccttctcacgcggtgattgagcccccacctatattattgttgtcctgttccgcccgttgttgttgctgctccccccacacccgggggcgtggtgcccgcgcaagggtgtattgtttttagtgcgcgtgggaaatttctggcgcccaaccaatacatgctcccaccctggggagatccgccctagattatttggggacattcgatgatcttggctgtcgcaccaaagtgggcgttcttgggagaccccctctttatggggagatttctaatccgctgttgtcagtctgtgtttgtccacccccccgttattagtggttgtggcgcccttgcagcactggggcccaattttggtgtatattcttagtgcccacacatcctttcaactgtcaccctttttggaagccatctttcgggtatacttatacactcggagaccacacggcggatatgtatccccccttggtagatgagcctgaccaaaagggtgcccacccatatatgttgtcgcctctgtccacacatatcgggggagctctcggtaaattttggccccactctcactatagggagcggtctttccacatttgtccgccctgggattttttcccccctaatatttttctcccacggggctaatacacccccctcattagagccccaccaaaccctattactgtccacaagattgtcccactctgttcacgctatgtgcactaatgttcacacgcgcggcgtataaaatttctagacactttgttcttgcccgcccccaccacactctttttctccgcggctctatctctccgggagaaatgcgcccctctcgcagcacgctgtattctctcgcgagtgctatctctctcctgcagtgggcacatatacaccccaacactcgtgaaacaattctctatttcactttctcgttatgtggctccaattacactcttttctcttctaccacgcgcacgctataatatattataatatatatattttcacatgagatttgcacgacacaccactctccgcctttcgagaagacgcaaaaagttcctctacttcgttgcagagacccctcccacttaacctcggaggtgactatatggagtgccccccaccccttgccaccaccactttcgcacgaaccccgtaataacactataaattctagaccccacaaaggagagaggagattctgaacccccccaagactaggtttcaagccaacaccacatggcctccatgacatttttcca

SEQ ID NO: 586313 - DNA, 218 bp, Homo sapiens
attaggtttgtgtttttgtttttgtttttgttttttaaatctccttgagagacagtgtctcattctattgctcaggctggagtgccatggcagtcttggctcactgcagcctttgcctcctgggtttaagcaattgttgtgcctcagcctcccaagtagctgggattacaggtgtgcaccaccacacctggctaatttttgtatttttagtagagaca

SEQ ID NO: 586314 - DNA, 1261 bp, Homo sapiens
ggcattacttgaggccaggagttatgagaccagcctggcaaacatggcaacaatcctgtctgtacaacaacatacaaaaattcagctgggcatgcatggcaccatgcctcataacccccagctactccggcaggcttaggccaacgagaatcgcttgaacgcaggcaggccagcaggcttgccagctgcagccgcagattgccatccacctgcgactcccagacctagggtccaaacacgcagcgagcactctggtcctcccaacaacacaacagcagcacacagcaccagcacacatcagccttccagcctaaccgatcatcttccaatcaccatgcggccacgacacctcgcgcccagcgcagccctgccggccacacgccaaaacggcctccaggggcacaatccaagaacccgatcatcatgcccagcgagatcaacctaccacggcctccacatgatcacgccacagaacgaactaaccgtggcactagtataacaacgagcccagcttgacgacccaaacattggccagacccgacggaccacgcagattccttccccaaatacatatattgtaaaacaacttatggaggctccaaagcgtttccaagccaacccgcatgtccaccacacaggcttacatccaatcccccgttccctacaacacgccaataagcggcacggccagtcacagataagaaccccccgggggacaaacgagcatcgctcgaaacaatacatggggcacaatcacccgtataccagaactcaacccaggcccccctgggcccacgaacagccagcaaccaacaaggcggcacccactcaccacacggggcgaatacacttccacacacaccccacccgcgcacaacacacacgccagcgcgcgcacaaggctccacacaaacgtcgcgcgctcccaccccctggacgtatccggcccaaccacacgccccgaacagcacatagccaccatacaggccacactacgatcgccttcagcaacaccacaacaccacccccaaatctgcactcactctcccgtcccactacaaccataacaccgctccatccgcactctaaaaacgccacctgcgcgtataccagcccacacacaccataccccccggcgcacacaacatctatttcacaggagaacatttcaccaacacccagatacaacacatgggataccacaacaaacaacattcccacaaccgcacaacattcaccattacacactcaccgcacacta

SEQ ID NO: 586315 - DNA, 717 bp, Homo sapiens
  misc_feature (99)..(99): n is a, c, g, or t
tgtaggtgcggccatgcatgaacgctaatgtcaaatctttgagtcatgaacactaagtctcggttgacattgttagccttaccatcatgcagaagttcntccaagtttggccacagtcaagtatgctttaccacaagttcggcatcatcttgttaagcaagcgtgaacctttaagcaaagtccagtagtacgtgatcctaatagtacggatgtagtccggcattctcatataagtagtcttcaaattaagtctagtcagtgtcatgaatacaagtgcacatcacatcatcctcaggtctcgctctcaggttcatgtccttgcgcagcagccagtgcatttcaccataggtttcacagatagtcgccactgcgcataatctgtgtccagcaacagtatgaagcgaccggtcacaatgaccagctgcctcatgagagacacatgctcgcgcgcattcagcacagtcattcacttattctccatgatctacgaatggtcactactgatgacagtgaacgacggcgtatccacaaccaggctcttcactcttctgctccctaagctttacaaccatgaccaccctcactaatgcgtacatcccgtcttaacacacccctggaatcagtcgagctagagaggagctgcaagtatatatatggttctcacttcagtgttcataatgcgtctctgctcgacactacacatgagctaggccgtcc

SEQ ID NO: 586316 - DNA, 241 bp, Homo sapiens
  misc_feature (116)..(116): n is a, c, g, or t
tttgtattaatttgtaatagctctgctttagaaaaaatcaaagaccatgattctcatgaaactaatgtgacataatttcccagtgcacttgttgcatgtggaaatccagacacggncaccttccagtttttgtactcattcggctttgaatccaagccaggctccaaatctagtgggaacagtcagtttaactttttaacagatctctatttttttattttgagtgccactattaatgtaa

SEQ ID NO: 586317 - DNA, 314 bp, Homo sapiens
cgtcccggctggtcatgtatacaatatattctataagtcttcagataattatctagtcagacatgctgatggtcggcctcaatcacatatattgatgcactgggatttctattatgtccaatataaaagggtggagtacctccacattcaacaatgttctcttgagacgagtgctaaagtcatttgtcaaggaagagaggagggggttccagctattacacaaatgagttcaagaattcctagagaatcaacttgctacataatctctgtccttgaagggcttttgcctatacccttggaaattatctttctag

SEQ ID NO: 586318 - DNA, 329 bp, Homo sapiens
ctagcctgggcaaaaagagtgacactccatttcccccaaaaaaaaaaaaaaaaaagaggggagtgtgaaacgcacgcctgtaatcccagcacttgctgaggcaggtggatcacctgaggtcaggagtttaagaccagcctgaccaacatagtgaaaccccatctctactaaatattcaaaaattagccaggcatggtgattgagtgcctgtgattccaactattagggaggctgaggcaggagaatggcttgaataaggaggtggaggttgcagtgaaccgagatcatgccattgattccagcctgggtgcagagcgaaggctgccaaa

SEQ ID NO: 586319 - DNA, 1302 bp, Homo sapiens
gtgctcggtccttccgatggaatgctaatggctgcgttgggagtgaggtcctcacttcatccggcgaccgtagcaccagatccggcagcagcctagtggcgctagcactcgacccgacgccactggtctgctgtctccgggagctcagactgctactctaactcgagccactcacttctagctacgatccgatgaaggtcgaactagttcactgggagcgactcaatgatccaacctcgcgcgctcgattagatagcacgccgtgtagtaagacttgttgagcgcgtttaagaggactgtggtttgtaaaggtcaaaggccacattgagtccattacagtaccagacatatgttgggagcctgcaattacatgtcacataggtaggtggggacctggagtagtgatgctgctcacaggacgagacttgttgtgcgtgtcacccgaatgcaatgtgaaggtgccgtgattgcaactcctcacctgactaggtcatgctctcaagctttgatgggagcaagcaagctgtgggaaaagacaatgcgaatacagaaagatataccgccaggtaggtcctgaatgacttagacatggtggctcgggacttgttttttggatcgtaaaaaccccttcctatgtaattaggcactggtttcggttcaaaaccaatagcgtgccactttgctattccagcattgcaatttagccggggttgggcccgggacttaagatttaatcccccacgattgaggggttccgccatccaagtatgcaggacgattacaccagggatatcacgtcgtttacctgatggatcccccaccaatggggagatcttgaaaaggttaacgtctcaggtcccgaggcccttccttgttgaccccacacgcccgcgggcccggggcaacaccttgctcgagccgaaggcggaactcctttagaatagggcacccctcttcctcctcgttgtggcgtccatatcttggcaaccttgcgaacacacaatttaaaggcttaacgctgcgtgttaacacatcgacgcggcacttcggttgaagccaccacgtttgccggcggtggaaccatgctaacggaaggggcaaatgacaatttaccggacggagcaacaaccgagcccccgttccaacacgagcgccgtgtcagcgtccaccggcgccatagacaaccggtaaacgccggcagactccacatgtctcaccagcgcacacgacgagtatccatcactaactactccgctcagaccaacacctattccacacacagactgatgcatcgattccaag

SEQ ID NO: 586320 - DNA, 1358 bp, Homo sapiens
  misc_feature (1135)..(1135): n is a, c, g, or t
gcccatggctgttctaggctctgctgtgtgcatagcgcaatggcagagtggaacccatgcctccatgccagcgatctggcgggcaaggaacggctggcatcatccgagtgaggaggctggcgcatgttggagaggctggctggctgcgacagacgccgtgaggggaggagaggggctgcatgtgcagggcgtgtggagtacggagctggctcccctgagcagccatgcagggcgtcgtgcagcccaggcctctggccaaccaggcgtcttgtgacccagtctcgtttggatcaggtgtgctgagcaccgtggcgacgaatgggggggccgagcgaagggccgtagggtcgccatcacagtaccgtgtcgtctaagcaagttctgggaaagagctgctgggccgtggtgccggctggcctcacgtcgctggtaaagtcaccaaggcagctctttggcgaaggccacaggggcgactgggacaggaatcgctgggatggcccaaggtacgggtccaacggatccaacgctcaatggcgggcaagcactgactgatgacccttggtcgtcctgccaacgacacaaagttttgtctgtagaaccctaatttactggccttggaccgatggtaatgcggcaacggccttgattgagattccccaaggcattggctagcgctgcaatgggcctcgaaagctacgggacgcgactctagtcttaattggcctttggcgggacggtgcttctggacgtcggcttggcacgctctggacggttccatgttgcgaactttggtactctcgcaccatttgactcacttcaccctcaaggacgccgtcagatgtgtatgcacctcaccggaccggcccatgacatgcaacgcccgccttgcgatccatctgccagagaaccgacacgtcgaatgctcagacacgcactccgttcggtgcgatgactccagaacaggtccgatacaccgtcacatttggagcgtttgggtaccaaaggcgttccttcaccattcgcgcgactattgcacacgtgtctccgctcagactgccctcacgagtgcacactcgccggccgtcgcatactagtcatctcgctggggacaggtcgagacttcccagtttcgccncactaggtacttcggcggtgccttcccggcatggaacgcatcgggctctactgcttcagaagcaagttcccctgacacatccctagtctccgctcgtgcccgcactagattgggcatatccctcatcatccaatcggcgctactatatccatatccatcttggaacgctgaacaccactgtgtctcgtgccgctcccatggcagcgcacttacgacatgtctc

SEQ ID NO: 586321 - DNA, 121 bp, Homo sapiens
tatgcatgtctcggctgggatagtctgccagtcagtgtgcagagactgtgtagagaagatttacagtgaaactatgcatggcccacccctttcaggagggaaaaagaattacagttgtgga

SEQ ID NO: 586322 - DNA, 476 bp, Homo sapiens
  misc_feature (35)..(35): n is a, c, g, or t
  misc_feature (94)..(94): n is a, c, g, or t
taatatgatttctaaagcttgacttaatacattgnaatttaacatttagaaattattttgaattgagaaattctagtttattaaaataaaattnccaagaaaaaaagtagagaagtagaatgtctgctccaagacagaaagcaaaaaaatatttttagccattgtaatataaaagagtagcttctgtgtataggagcttctgcttttctatcttttacaaaatagtatcaagtatattaataagcgattataatagctaatgttgattgctcactatgtactaggcactgttctaagtactttatatttactaatttaatatttttggcataattctgttttacttatttacttttaattgacaaataaaaattgtgtgtgtgtatatatatatatggtatacaacatgatgttttaaaaatgtgtaaattgtagaatggctaaatcaagttaattaaaatatccattaccttaaa

SEQ ID NO: 586323 - DNA, 238 bp, Homo sapiens
aacacaagaaatgatatgatgacggataccctaaataccctgactggggcattacacagtctatgattgtctcaacacatcacacgataccccaatcagtccatgcaacatactaagttatcaactttttaaactttcataccattttactacacgtgttacccttggtacgcagggatttttatttttattataacccttgaaaatagcgacatcctacctcattttggtagcattt

SEQ ID NO: 586324 - DNA, 283 bp, Homo sapiens
ttgagcatcggggtggtgacctaaaggatagtgcttttaacggtctgaaaagaaaggctggcgtagaacaggtattgactatcgacggtctttccacacagaagttggagctattacgcaaggctgatccgatggtaaagctcagctagggagggtgctcacgggggtcaactgagttgtgtaatgaagttcatggccatcaacatccgaaggaaagggaaaaccagacccagcctggctgagcctttagtaaaaaaatgtgtggttaaggatcagtcatggg

SEQ ID NO: 586325 - DNA, 599 bp, Homo sapiens
  misc_feature (373)..(373): n is a, c, g, or t
tcgcgaacgtgttatcccaataattgcaaacgaatacattacaagattataagaggtgatagaaagcaccagcacattgatacaaaatataaatatcataaaagtaaattcaacgtcagaaggtccccattcaggcaaatactttgtaaagatatggcctgtatgtaaatatgtgctaaatcaaggactttttagcagaaaattgctctgttcttttatctaaggcttgaatttgtaaagtgaaggcattaaagttatcaaacattaagtaactcttaaatatggcacacaggttttacagctattgtgttttccttcctaactctctgaatttttcccatggcctttgtagatcaactatttcaaacgtatnttacaccatgcaactctcaacatacttgtctttgcagatatgtcatcagtcatgtctaacaggcaaatagcaaaataacagatttataacaatccttaactagctaacaggacatttactttggattctgcataactgccaactggaatattttgtaaagctaaaaatcagttttaatacatgattaacagaaactctcatcatgctcatttatttaactattggc

SEQ ID NO: 586326 - DNA, 1135 bp, Homo sapiens
tgctggactgcgcagagcgggctggcctcgtgtccccgtgttgggggccggtattcacagttactgccgaaatccggatcgaggacccgcgtcgggcccgtggtgctacgtcagtggcgaggccggcgtccctgatgaaaacggcctttgcgagtgcacctggcgctgtccagagaccacctcccagtgccctgtccatgccttcacgtacagaaagtccagtgaagtcgttctgaagggcctaggtgccaacggtatgagcgtgcacgccgtgttcgacatcctgaccaatcgcccgtgacccgcgtcgtaaggtgagggcggcaggctgatgcggcgcaggtgatctggcgatcagccgagcgggttgcgtgattaactccataggagagaacggcacctgggaactctgggctacgatgctgggcgttatcattgatggtcgatcgatctagtgccatcggtagcttggcatcatcttcgggctagtcctacaagcagggggcaatggagtctgataacgcacccacgtcattgcactcacgtaacacgtacttgtgacgaagggagattgcagcgagattctacctcttgcccctttgtctgcctttcacctaagctccaggcttgttgacactttgtgtgcttgaggaagaccttgttctgtggtccatcggcctagccagagcgtccagttgtatcctcaggaggggctagtaaacccgcccttattggtgccatggcccgggactcctgtgggccttgagcccccccagtgggccgtgatccctatgcctgtagactggtgcgggacttgcccgaaccttcattacggctagggagggaacttacgcaacttgggggtgcgtgggttaaaacccgtaactaataccgcgccctattcttgggcgaaatcctaagttaggagttgacacgaaaggccgcgtggccccctgttgggccttggaggggtacgggctaggggtaaggggcccttaacgaggggctccgttgaccgtccccatttggaagccgaacttctggcatcgggagattgacgaacaggttgggagtccccacaggggatgcgtgtcgtagggcgtaccagattgcttggaggccgtgaacgtggacc

SEQ ID NO: 586327 - DNA, 311 bp, Homo sapiens
gacccaacatgagggatacgttctgttgagaatccatgggacagctgtgcgccgcggctcacgcctgtaatcccagcactgtgggaggccgaggcgggtagatcatctgagggcaagagtttgagaccagcctggccaacatggcgaaactctgtctctactaaaaatacaataattagccgagcgtggtggcacacgcctgtagtcccagctactcaggaggctgagtcaggagaatcacttggattgtagtgagccaagatcgcaccagtgcactccagcctgggcgacagagcgaaactccatctcaa

SEQ ID NO: 586328 - DNA, 1106 bp, Homo sapiens
gagctgcgtcgggctgcaggagaagatgtgctggtctccacaggagttaacagttcctcgtaattttcgcttgtaggaagaaccttgaagaatggacaaaacatggacgctacggcgaacaggtacatgatttagactgagggccttgcaacgatgatgaagatatgacacttacaaggctggacaggcatgattattgggccaccaaggacaacttatgaaaacagaatatatagcctgaaacgtagactgtggacctaaatacccagaagctcctccgtacagtctagatttgtaaccaaaaattcaatatgaacggaataaatacattccagtgggaatgcgtcggatgcccggagccataccacgtgttcagcacaaactggcaaaattcatatagcattcacagttgtacattcaacgagctaagcacgtctactgactgtccaaagaccacatactgacagcttcacacagccacccagcaagggaccaaacccatacagacacaattcaattcacctggatctcaaacttgactaaaactcaacaacccttactactccatgttcattgtacttgcttaacactactcccattgcaaaatacacaataaggtaacaagaattccactgcttataaacattgactggcacacatcgtacgaattatattacaaccatttggttcccccccaacactagtgttctacaggtgtaaacagggaaggacaacacaagcccggccaaaacaatagccatcgcgcatgtgaaacaggccacgtggtaacttcaacccacattaacacagtgacgtaacctgaaacaacaagtacagggatacgaacgaaacaaaggatgtggacaagaatcaaggtcaaatgaaaaacataaatatatattaaatataacaattacaaaaaacgcaacagctaattatccctacttaccattaatcctcaacctaacaacaatgctcaacaaacaacaaaataacctctcccaagattacaaaataacaaaatttgccaaagactataacaatgacttacttatctttaatacatatgcacaaatataaaaactttataacatacagactcttat

SEQ ID NO: 586329 - DNA, 286 bp, Homo sapiens
  misc_feature (141)..(141): n is a, c, g, or t
gtatgtatcgcccaacacaagaaagcagtcacatgaatgtttttggtttcccaatgcatataaaagttatgtttacactatactgtagaccagcaagagtgcaatagcattgtctaataaaacaatatacatacctaaatntaaaaatactttattgctaaaaaatgctgattatcaatctgagccttcggtgagtcgtactctttttgctggtggagggtcttgcctcgaggttgatggttgctgactggtcagggtggtggctgctgagtgtaggggataaata

SEQ ID NO: 586330 - DNA, 212 bp, Homo sapiens
cccccccccccttttttttcccccctaaaaaaaccccggggcggttccacccccgggtttttaccttgggcccggggggggttaccatttttccccgggaacaacttttgccctttggccctttttgggggcccctttaaaccagttttttccaaaaaaccgggtggggccgggtcgggatttcccgggtttttttccccccccgggtccca

SEQ ID NO: 586331 - DNA, 521 bp, Homo sapiens
tctagaggatcccagcaagtctacctccaggatctctagggtgcttttttaattcagacgaatatttcaaaacctagtgagaagaatattactgattacattcttatccttagggattaagcaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggcttcgataacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattctcatagttacctacatgtgtgacctagtttcaacagtgttcttacatattacctctgacaatacaaa

SEQ ID NO: 586332 - DNA, 284 bp, Homo sapiens
tcttggactgttgccagaagacagttcttgaccaaacacctttatttgcatagataaaatgcttcttgtgctagacatggtggctcacacctgtaatcgcagcactttgggaagccaaggtgggtggctcatttgaggtcaggtgtatgagatcagcctgaccaacatggtgaaaccctgactctactaaaaatgcaaacaattagctgggtgtgatgtgcgggcaacctatggtcccaagctactcgggaggcagaggcagggagaatcccttgaaccccagg

SEQ ID NO: 586333 - DNA, 122 bp, Homo sapiens
tattaaacttaattttttaaactaaactaatgtgaccagtagggaaacaagggccccaaagcataagtttttttgccctgttgcccttccttaaaacaaaaaaatgttttttaaagctttta

SEQ ID NO: 586334 - DNA, 978 bp, Homo sapiens
  misc_feature (674)..(674): n is a, c, g, or t
gcctgtagatggtgtggtagattgacggccccgcgctagcgcttcagagttcctggttcatccttgagactcatctgctctgagccatcctcatggatgaacttcaggatgttcaactcacagagatcaaaccgcttctaaatgataagaatggcacacgaaacttccaggactttgactgtcaggaacatgacattgaaacaccgcatggtatggtccacgtcaccataagaggcttaccaaaaggaaacagacctgttatcctgacataccacgacattgggctcaaccataagtcctgcttcaacacattcttcaactttgaggatatgcaagagatcacccagcactttgctgtctgtcacgtggacgctcctggccaacaagaagcagcaccctccttccccacagggtaccagtaccccaccatggatgagctagctgagatgctgcctcctgttctcacacacttaagtatgaagagcatcattggtattggggttggagcaggagcctacattctcagcagatttgcactgaatcatccagagctggtggaaggtcttgtgctcattaacattgacccgtgtgctaagggctggattgactgggcagcttccaaactctcaggttttaccaccaacatgtggacataattctggtcatcaattggncaggacgagttgaggcccattggactcattcaaactaacgaacggacatgtcaagatatcaacgagaaaactcagactcgggtactatagggcaaaccgggatcgaagcgtaatggcaaatgaaaagattggaaggcaaggttcactaaggcgggggaaacacgcgaaacaaggaggagataaccgacctaaaagtagagacggggaggccagacacggaaaagacgaaaatgggagaagacgaaccaaacacaacacgaccaaaggagataggaaaaccagtgcgctggaacacatagaaggg

SEQ ID NO: 586335 - DNA, 156 bp, Homo sapiens
tgtgtctgtgctggtgagactcaccttcaaagaactggacttggtgtggtgagaagtctgtgagctccttggccctgctgaagcctgcccagtgtcatggtgatgggcttcccacctgcagcttctggagcacttccttgggaaggagcacaagaa

SEQ ID NO: 586336 - DNA, 236 bp, Homo sapiens
taaggtaaaagcctttttcggagtttattgggggtcaactggggttttttaacaactcaggcgagttttagctttattggggggggggaaacataaaacactctttacgccggtttttattgacttgggtaaaccgggggaccgcgggggcttgcacgaaattgaccaaccctggggttagtatagcttagttaaactttcgtttatggctaaaggttaaccactgctgttccccg

SEQ ID NO: 586337 - DNA, 263 bp, Homo sapiens
  misc_feature (256)..(256): n is a, c, g, or t
gttgctgctgcggtcgatctaaggatcccggtgctagctggatagtgaacgctctcatagactcagtctcatctgctcttcctagttgcttcttccatcagatctttgcttttttttttttttttttggtttttggtcttttggtggttggtgtgtggtggtggctttttctggtggccgccgtccatttattggccgttacccgccaggggcaggggatcagacacctggcggttcatttattggccggctagcngcggtgt

SEQ ID NO: 586338 - DNA, 508 bp, Homo sapiens
gggatcgcggggagtgagggacccctctcccggcacgctcgtgagttggccctcccatcgaggctctccgtgggcggggttgcgggcttggagtcgcgcggcgcagagtcggagccgcgggcctcggacctgggggccccccggacgtgttacagcggggcggcggcaggggccccggacatccgtcggcgcacataccccgtgcccagacgcagagagaccaccccaggaaaaagcccgggtggacagagagtcatagggtgaccgcgtgccttaaaaagccttgtgccacacagagcctctcctatctgggggggcccccacgattgcagacgctttcagacgccagaagacctgtggctgggaagacccctgtgaaaggagggccctgtgtgcggggcccccagagcgaagctaacaggcgacgcacgacgagcaaacacgtggaagaactgggggattggggacctgggccagttgaccaagatgcctctcccgtgacaagact

SEQ ID NO: 586339 - DNA, 218 bp, Homo sapiens
attgcattgaaaccacaaatccggtaatgcctcagtacgttctgtggacaaaacttagcaaatccatcagacagggatctgtgcccctctgttggctgagataggaatattgtgtgtgtctacacgggataatcccattacttattgttctgctcagtgattaaatgggtgcatttcctcgtgagccctcggtgatatttatgctgcaggtgggatcc

SEQ ID NO: 586340 - DNA, 828 bp, Homo sapiens
atctcacttctagtgaatactagtatatcgctcacacctcatgtggtccctaggatgcctagaaggaataatactatcgcttgttcacttatagctactctcataaccctcaaacatgccactccgccgtcttagccagatattgcttcgctctatttgtccatactcacgtcttccgcccgccttgtcggaaggcaggcgcgttggccttgagcccgtacatatatcgtgcaattgctccgagagcgacgagtaataggcacgtaggagctagcggtatcagtagacgctagagagacatagcgtccatatgtgctaccacacctacacttcgtcgcccaaccacactaatagtgtactagcgccactgatctatgaagtggtccaatataaagcgacagtagagtgttgaattcaaaccacaaacccatctcctctaccgagtcgctaacttatttaggccctcaattctcctctacgtacccctttaaaccacatactctaaccaatcatacctattgtgagctgttcccccaacgcttttccctcctgatctccctaacaagtgccccctcctcactactaagctacctgaggtacctagcgcctcacaggtcatgggcaagtccaatggggcgacttatcgcagctgaaccacgtgagtcacgaaaaaaacgtctaccgtctctatactaaatctccctacagaagtctcccttacattatgacatgcacagcacaggaagtagtcatatcatatcttcttcgaaagcacattatcccacctgggtattatgacccgatgaggggacgccgaaggctaagcag

SEQ ID NO: 586341 - DNA, 269 bp, Homo sapiens
tgctgtcggtcgatctacaggatcccccgccatttcactatctcgtctacccacagtgacctcacatagaggccctcctgccacccatgctcctttggtgtccccaccgtccacttgtttgatgtcacttactgtctactttattttttttcttgatattttctaccctcactagaatgtagactccatgaaggcacagacttttcttattctcttctctatcccttgagtaagaccaacttgaaccttgcagatagttgtaaattgcg

SEQ ID NO: 586342 - DNA, 124 bp, Homo sapiens
gcgctggttccagcagaaggtatgatgggatcgatccttcctggcaaagtaaattcccgtgtctatccaacaagagcgaataacaagtttctcatgtgcaatacaataataacagaaaacatga

SEQ ID NO: 586343 - DNA, 468 bp, Homo sapiens
  misc_feature (93)..(93): n is a, c, g, or t
  misc_feature (310)..(310): n is a, c, g, or t
  misc_feature (397)..(397): n is a, c, g, or t
  misc_feature (411)..(411): n is a, c, g, or t
gaccaccggacatttctcgttgccgatttttttccagtaccactcccacgcttccgggttaattggctcgcccacggaaccgagaatgcgcangagcggaacggtcggtgccttcgatcgctttatcgccttccgccatcagcgcgcggttcgccgtgggtgcggtatagagaatattgacctgatgcttgtccaccacctgcgccatacgggcaggcgtcggccagttgggtacgccttcaaacatcagcgtggtcgcaccgcaggccagcgggccgtgacagcaagtaactgtgtccggtcacccagnccacatcggcggtgcaccagtagatatcacccggatgataatcaaagacatatttaaaggtcagcgccgcgtacaccagataaccgncggtagtatgcagnacaccttttggcttaccgggtagaaccggagtgtaggagaataaacagcgggatctt

SEQ ID NO: 586344 - DNA, 280 bp, Homo sapiens
ccacagtcctgcatcacatctatggtaagttcacggactgggcttcaactaccctgcttagtctatgagttagcgactcacggaccggcatgcctggagcgaagaggctgaactcggattctatacctgagcactggctggcatccggaatagactgatgattgatggcgatggagtctgtgggacatgctagctgataagcttcagcagggaccagttccgatacgtgtatgtgacgatagagttcgataactatgtaccctagctccaggtctatcgc

SEQ ID NO: 586345 - DNA, 316 bp, Homo sapiens
gctcagacgcagggtcacaccatgatgcccgggttcgtctagaactctgggctcacacgatcctcccactttgggaggccgaggcgggtggatcacctgaggtcgggagtttgagaccagcctgaccaacatggagaagccccatctctgctaaaagtgcaaaattagccaggcatggtggcgcatgctcgtggtcccagctactcaggaggggggaggcaggagaatcgcttgaactggggaggcagagttgtggtgagccgagatcgtgccatcgcactccagcctggacaacaagagtaaaacgttgtctcaa

SEQ ID NO: 586346 - DNA, 713 bp, Homo sapiens
  misc_feature (30)..(30): n is a, c, g, or t
  misc_feature (66)..(66): n is a, c, g, or t
  misc_feature (99)..(99): n is a, c, g, or t
  misc_feature (118)..(118): n is a, c, g, or t
  misc_feature (154)..(154): n is a, c, g, or t
  misc_feature (163)..(163): n is a, c, g, or t
  misc_feature (166)..(166): n is a, c, g, or t
  misc_feature (212)..(212): n is a, c, g, or t
  misc_feature (225)..(225): n is a, c, g, or t
  misc_feature (251)..(251): n is a, c, g, or t
  misc_feature (285)..(285): n is a, c, g, or t
  misc_feature (287)..(289): n is a, c, g, or t
  misc_feature (329)..(329): n is a, c, g, or t
  misc_feature (342)..(342): n is a, c, g, or t
  misc_feature (406)..(406): n is a, c, g, or t
  misc_feature (426)..(426): n is a, c, g, or t
  misc_feature (451)..(451): n is a, c, g, or t
  misc_feature (475)..(475): n is a, c, g, or t
  misc_feature (509)..(509): n is a, c, g, or t
  misc_feature (516)..(518): n is a, c, g, or t
  misc_feature (533)..(533): n is a, c, g, or t
  misc_feature (546)..(546): n is a, c, g, or t
  misc_feature (634)..(634): n is a, c, g, or t
  misc_feature (644)..(644): n is a, c, g, or t
  misc_feature (650)..(650): n is a, c, g, or t
  misc_feature (690)..(690): n is a, c, g, or t
ccaaagatcaacctctgccgacccggaggnatgccttccttatcttggatctttgccttgacattntcgatggtgttactgggctccacctcgagggtnatggtcttaccagttaggntcttcacgaagatctgcatcccacctctgagagggngccccaggngcngggtggactctttctggatgttgttgttagatagggtgcgtccatnttccagctgtttncctgctaagatcaacctctgctggtnaggagggatgccttccttgttttggttctttgcntnnncattttcaatggtgttactcggctccacttcgagggttanggtctcaccagtnagggtcttcacgaagatctgcatcccacctctaagacggagcaccaggtgcagggtggactctntctggatgtcgtagtcaganagggtgcgtacatctaccagctgtntcccagcaaagatcaacctctgcnggtcaggagggatgccttacttgtataggatctntgccttnnnattctcaatggtgtnactcggctccacntcgagagttatggtctcaccagtcagggtcttcacgaagatctgcatcccacctctaagacggagcaccaggtgcagggtggactctntctggatgtngttgtnagagagggtgcgtccatctaccagctgtctcccagcaaanatcaacctctgctggtcaggagg

SEQ ID NO: 586347 - DNA, 176 bp, Homo sapiens
  misc_feature (176)..(176): n is a, c, g, or t
ggccgtgcaaagttcggtggggggctcttagcgttggtgggagcctttgcacgtctccagcttgaattgtggagaaggccggagggagtcccataataaagacgcgcctcaaggtctaaaagactcgatttggtttccccaaaaggggggggaatacctttggtcaaggaattatn

SEQ ID NO: 586348 - DNA, 139 bp, Homo sapiens
ctttggagtagctaatccttctcagggatagaagatattcctcttgaagggcgcctaactcctgaggaaaacaatgccaattcaaggtaccgatctcaacacatcttcaacactatgtgaagggttccatcttaacctg

SEQ ID NO: 586349 - DNA, 136 bp, Homo sapiens
cgacacatgacagaggatcctggatgctgcaggcgcaatctcaaagtcatcagcaccatgtctgtgggcatcgaccacttggctttggatgaaatcaatgaagcgtgggatccgagttggctacaccccccgcgtt

SEQ ID NO: 586350 - DNA, 435 bp, Homo sapiens
ttggtcgggttacgcacccgaagttggctcgatgattcgctttggaatgttcttcaggtatggggcgccataagcgtcgctgcagcagctctcagtcagctgcgattcaaggacaacgttgccgttgctcaacgcctcggtgtagtcggcgatgattgtgttttcaattgcagaagtcattagtcacatctcccgtttagcagcacgaagtaccatcagcgcagcacgattcctcggcagagcctgcgatgggtacaagccctttggtgaccttgggatcccggattgaaggcgtgttgcagtcgaagaagccactcttgtctaaggctggctcgacatagcagcgcactggtatgaattggccttggtaaggagcggacatcagcagattgaaggtcttctcgcacaccgctgtacggacgccgcgcagagttt

SEQ ID NO: 586351 - DNA, 1027 bp, Homo sapiens
ctcaaaagctaactttaccacttgtaccactcttcttggaccctatacttagaagacctcgcttcttagagaaatggaaagtataaggcaggaatgcccttattaatttgtcttaccacatcatctaagtacatgataacaagtattatgtacataatccatctttcattccagatatactgcagtaaatgccctcctcctatcaaaagccaatccctaactgtgctaagagcttatctatctctggcattggtcattctcaacatcttcattattctttatttcctggagtacaggttatatatcaggcactattctgcatcctgggtatatagcatactgcagtgaacaaatcaaccaagcttactctcatggaacttctagtggggagaagttggacatttaacagtgtaatcacctacatttcattaatctcagtcaacaagtgctgtaacagaacatcacatttaggagaccaggcgcagaggctcacgcctgtaatcccagcactacggcgaggccaacggcgggccggatcacaaggcactggagatcgacaccatgtaggctaacacggtgaaacccagtctcctactaacaataccaaaacacattagacagagcctgagtggtcagagagacagccatgagggatcacaggctaattcaggaccgctggaagcactgagaaatggagagaaacccagagaggcgggaaggagcacgtgagctagacaagaaaccactgaacaaccaacacggcgtgacaaagcagagaaccaccgacacacaaacaacacaccaacaaaccaacggacaaaagcgaacacactcaaacaaaacgagaaacaatgaaagaaggcaacaaaacgacgagaacaaaaaccgacaccacgagaccacactacaaaaggacaacaagaaaacagccaacaccagacgaagtcacacaaccgacacacacacaaactacaataccatagacacaccccagaagaactcaccagaacacacccaatgcaaccaa

SEQ ID NO: 586352 - DNA, 241 bp, Homo sapiens
gggagtgaattcctgccagcacataaatttcagacttttgggccccagattgtgaagaataaatttctattgttttaagccactcagtttgtggacatttgttacagaagccctaggaaattaatacaaccctcaccacctgctttcccaagttgtgttaccaaatatctgatatttatttagcacttgttatgttcagctttaaataggataattacattaaactttagcagcaatctta

SEQ ID NO: 586353 - DNA, 541 bp, Homo sapiens
  misc_feature (89)..(89): n is a, c, g, or t
  misc_feature (95)..(95): n is a, c, g, or t
gatccatttcatgcgcgactacaacaacaggccttttttcttcattatacgaccgtaatacgctcggcatgctcggcgctatatatttngcctgngctgcgccctcctcctccccgggacaaaaaaaagatcgaagctcctgtggccaacagacttacctgcgcacgtccgccgcccaagaaatatgaatgtccttctctataagaggactgtagtgagaacacaccaaggttgtttcttcacctgttatagaacaatcagtataaacagcccggtgtctcctcaccaagtgttggcttcagcactcggaatcacctacagcatgaagatgaaactctcttactccacacaaactatgtcaaaaaaaacacaaatcagcggcagtaacaatattcagaccatttcttctgggagattaaaacaccatctgtcatctctccctttgctcacaagatagtctgttcaaacaaaaaccgcggggtactctgggctgccaacaaaccccccccgtcaagcatgtgtgaccacagcccacaaaaca

SEQ ID NO: 586354 - DNA, 331 bp, Homo sapiens
tgagatctaactgatcgcaccaagatctgcacaagatctgcacaagcccggtcgggctggaatagtggtctagcctgctatactcttagtagattacaatgcgagcatcccatccagtgagtcacctctaaatcacacgacaaagggacaagctcagcacgcagaatgagtcaaagcttagctaccaacccacgggaaacagcagtgattaacctttagcataaacgaaagttaactaagctatactaaccccagggttggtcaatttcgtgccagccaccgcggtcacacgattaacccaagtcaatagaagccggctccggcgctgcgg

SEQ ID NO: 586355 - DNA, 130 bp, Homo sapiens
gtctcctggggtggatgctcatcgagcaatgatatagtactttcctgcctgtttagttcctgtgcacagaccctaagtcaacttagcatttctgcatctgcgcactggtagttagctgagagcttccatg

SEQ ID NO: 586356 - DNA, 152 bp, Homo sapiens
tgttagttacctaagtgtgttccggtttaccaaacattccccgaactaaatactccatggctcatgtgttccagtctgggttcaaacgtgtgtgtaatgtttcccttaagtttttttacaccagagacgatgatttcccaataagaaagccg

SEQ ID NO: 586357 - DNA, 162 bp, Homo sapiens
cagggtatcgcctgcgccaggtcagcgccggaaacgcctcgcgcacctggcgcttgagcagcgcgatgcgggccggatcgatgtcggcattggcgctgccgatgtccaccatggccgcgatccgcagcaccccgccgacgcgcgcatagacgatgcggcgct

SEQ ID NO: 586358 - DNA, 712 bp, Homo sapiens
agcgggggcggagaaggaaccgccaggcccacgacagacggtgtctggggtgggggccggcctggggacgcgggctggccctgcctcgtgttctagcagcgggacccgcaccgcgctcctcgcggtctacggagaaggcgtgcacggtgcctcatcacggatgtgacggtagaagcgcccgtcaaggacctggatggatgtcgtgaagagcaccaaaatcatcatcggcatgcttcgtggccatcatcgttcatggtgcgcggtgatgctcgtggccttctacaaagtctgctgcaagcagtaccagactccacaaagcaccatgggcccatgcagcaccggtggagatcatcaaccgtggacggaggaagctgactcagcggactcggtcgtgtggcgtggtcgccagtggtcgccgagagcacaggtgggcgagtggtggtaggcgcggggaccactcgagacttggggcacatgtcccagccacctggagcgatgatacatcattaaaaagtatgcaacacacgtacgttagttatgggcagacattcaatggctgaattaacaagaaagattatccctggatgggtgggagggattggcggggaagtacaaaggtgtgggcaggagactctatgtgccattccagaaatacctacttgatactgtaccagtaacggggatgaaaaggaagaatggtgacaagtaggtg

SEQ ID NO: 586359 - DNA, 527 bp, Homo sapiens
ggaccaagagctcacaagctagtgatagaggcatataactgatgccatgaccggaacgtgttgacgatgctcagtgctcgaaactatagttatcgctgtggtaaccaagctgcgatgacggaacttgacgatactcttactctttgttgcaggttgacccaacacctaggaaaggccagccacatgttactagtcctacacgagactacttcctgggtgagattgtacacttggacaggattgccatgaaccatatatcgacctaatgggaaagggaagaggaacaattgcttcaaagagtcagaagagtagctcacattcaatgtcattaagagccgcgaacactttagaatgaaccagttcattgcatgctgaaacgacattgttggtgaagccagtttatggcataacgcgatttgtagagacactttgggttatctgagagagtgcggatagtaagatgtgaacattaacacctcgagtgtacactatgcttcatcatagtatagctatactcagcatgctgt

SEQ ID NO: 586360 - DNA, 113 bp, Homo sapiens
tagttgtcagaacacacgcgttatcaatgtcacatgctcctctgcgttggtgcttctgtaatgtctatactgccaaaaatccaagaatcacaaccaagtatctggtttgttac

SEQ ID NO: 586361 - DNA, 349 bp, Homo sapiens
  misc_feature (28)..(28): n is a, c, g, or t
tctcatagtctgtgcggcgcggtcgatnacgtcccacggctgttgttgatgcggacgctacgtctaactactgacccaccgtcgttgatttatccactactttgctcactctgcccctcctcacgacccctcggtgactacctatcgttacacctgcgctcggcgtctcgcacacgggtgtcgtcgtctgcccgtgggtcggggcgcgcccccccccccggggagtgccgccgcgcccttattattacttttttccccctgttctccccccacccaccctctccccctcttacccccccccctttaccccctttgggttttaaaaaatttaatgggggttttaatttta

SEQ ID NO: 586362 - DNA, 171 bp, Homo sapiens
ggggaggaactcggtagtacgtgacacattacaccaatacatcttcatctacttttacctgtgtgaagtggttcatccgcaagtcaaatctggttaaaagcatggactgtgccacacacccagtgatccatccaaaaacaatggactgcagcctaaattccaaataccaga

SEQ ID NO: 586363 - DNA, 943 bp, Homo sapiens
gcggcgggcgcggcgcgatgtgcgagcgggcggcgcgcctgtgcagggcctggcgcgcacaggctgctccttgtgagcctcctgcgagcatgggcctggtgcgctgtggcgggctgctgctgctgcggtggtgctgccagtgattgggctgagcccctggtgagtcgcctggccccctgcctgaccccgctggacccctggcccatgcgctcgcctgcgcggtgggcaccgcctgtcgatcctggcacattcttccgccgatgcggaacaaagagatgatgactgggaagcctgtccttggagcgaattccaggctcttcttatgcacgattggcgctccttaacttgagaaagaactggcaggatctcgtttcacacgattgactctgacaacagccaagccatgtggacaccaaggagctgtgctgattacctctggtggaccacatgggctgactatgaggcatgtcctggcctccccttggagaaccttgaacatcagtctgtccctgaacggccatggcgcgtactacccaagcaaacggtactatgagcggatgggaggcacacagtggacccaggtttgctgaccccgtcttcgctccttgaacgggaggacgagcccaaatcaggattccaagttcggctcgcttgaggctccaggtgtgaacgaagttgcggctgcgacgggccactccgaggaacacaagagccaagccgatgctcctgaacagcaacccacattcaaaagcccatgccaccaggcggcggggcgaccagaacccttgggtcgttgggaaaggcccccagattcaccggaccatctgagcccccaagaaccacaatgcctcacttgggcttattgcggaagccaacggccaaagaagccgtttcaatcttgcccacgcggagggacggcacaacgaacgacgggtctggaaca

SEQ ID NO: 586364 - DNA, 543 bp, Homo sapiens
catatactactgccagtctaaaatgtgtgtgcatttagacagataatgtaaatttaatcctagtaagtgcttattctgaagaccatcttctctctagcgtaaatgtgtgcttatcagtatagaataaatgtattcaaagaataggagagtaaatggccctttattcaaattgctttcatttatttttttcttttggaagtagtgaaagctttattatcaatcacttcatttttcaccagcttcagatttagagggtaaaaaaaggaagcatttgggggtcagtgttttgaatcaaaacaaatcaggaattgataaaaccgtagtttcctgactatttactgacctgattggagtcatattcttagcttggaagagctgtgttcattcattttttttttttcctgccgctgggtttagtaggtaatgtggaaaccatctaccataaatcattgctgcaagataacaaatagaattggaatctatgcttgcatttccctgagtttctggttttttttccttacatcctgctctgcctggcaaggc

SEQ ID NO: 586365 - DNA, 320 bp, Homo sapiens
actggcgacagatcaacactgagggaccacgtacagatgtccgtataataaagtatacaagaaccgtaaaggagtattcatcaagagatggatgagaatttctgcaaacaggtcacatctgttcttcagacaaagggcaaacctggaaattagatatgccagagtacttcagtaaactgggcgtcgtgctgaacaaagcattacagaacacgagaaaaagttgtgttagcagtgcctgggcctgggcctcagagggaatgaaatccacagcggacctgcatcaaaaacttggcaaagcaattgaaatggtcgccaatccg

SEQ ID NO: 586366 - DNA, 429 bp, Homo sapiens
  misc_feature (6)..(6): n is a, c, g, or t
  misc_feature (48)..(48): n is a, c, g, or t
  misc_feature (58)..(59): n is a, c, g, or t
cgcttnggcgactaccacctggatcttgaaagggaagtggcgccgctnagctacacanncaaggtgcttgaacagaccccatagatggggagaacctgatcgagagacgagcaatcaactttgaaattcagtcgcttaggcagcttttggccctgtacgtaatgattccctgccgaccctcttcaaggttcatcccagcgactgcccagttgaaggccgctctttcgtgggcattgagttccgcgtcgatagcgtcaattgactgccggtattgctgctgggttccattcgtaaccatcttcttgtctgtcggaccgctgcagccagctagcagtgctgatgctgccaggatcagtgttgctctgcttctggccgcgatgaatgaagcggtattggctgtacgctcatgcgtccccctgtcaatgaaga

SEQ ID NO: 586367 - DNA, 777 bp, Homo sapiens
  misc_feature (9)..(9): n is a, c, g, or t
  misc_feature (61)..(61): n is a, c, g, or t
  misc_feature (85)..(85): n is a, c, g, or t
  misc_feature (115)..(115): n is a, c, g, or t
  misc_feature (125)..(125): n is a, c, g, or t
  misc_feature (140)..(141): n is a, c, g, or t
  misc_feature (143)..(143): n is a, c, g, or t
  misc_feature (158)..(158): n is a, c, g, or t
  misc_feature (162)..(162): n is a, c, g, or t
  misc_feature (183)..(183): n is a, c, g, or t
  misc_feature (187)..(187): n is a, c, g, or t
  misc_feature (189)..(189): n is a, c, g, or t
  misc_feature (192)..(192): n is a, c, g, or t
  misc_feature (196)..(196): n is a, c, g, or t
  misc_feature (200)..(200): n is a, c, g, or t
  misc_feature (203)..(203): n is a, c, g, or t
  misc_feature (212)..(212): n is a, c, g, or t
  misc_feature (219)..(219): n is a, c, g, or t
  misc_feature (225)..(225): n is a, c, g, or t
  misc_feature (231)..(231): n is a, c, g, or t
  misc_feature (238)..(240): n is a, c, g, or t
  misc_feature (244)..(244): n is a, c, g, or t
  misc_feature (246)..(247): n is a, c, g, or t
  misc_feature (276)..(276): n is a, c, g, or t
  misc_feature (282)..(282): n is a, c, g, or t
  misc_feature (287)..(287): n is a, c, g, or t
  misc_feature (324)..(325): n is a, c, g, or t
  misc_feature (340)..(340): n is a, c, g, or t
  misc_feature (396)..(396): n is a, c, g, or t
  misc_feature (425)..(426): n is a, c, g, or t
  misc_feature (433)..(433): n is a, c, g, or t
  misc_feature (439)..(439): n is a, c, g, or t
  misc_feature (444)..(444): n is a, c, g, or t
  misc_feature (446)..(446): n is a, c, g, or t
  misc_feature (450)..(450): n is a, c, g, or t
  misc_feature (466)..(466): n is a, c, g, or t
  misc_feature (475)..(475): n is a, c, g, or t
  misc_feature (688)..(688): n is a, c, g, or t
  misc_feature (777)..(777): n is a, c, g, or t
atttcaatnactctgcatggttgctgccacgcatggaacatttttaggccaactttttacnattcccagttaaggtaagccgganattagatgatcttcattaagactccatggntgtctctccnctcctgctgccaaanngntcacttatagatgtntttnttgctctcccaagatcatgcntctntngtnttcntatnttnttcattttntgatgantctgtncttttnttcctgnnncgtngnncttctttttgacctcctaaggcataaatnaatggnaaatnagggctacatgaagagcagaagagaactcccattttnntgtccctagaatggnctagacttggcctatctcctaagatgtcccagatcttcacgtatttgtgagctgangcagtcacgggagagcccttggtttgaannctaaganaaaaanaaaananttcntcattgtgtgcattangtgtaaaanttgggttatctgaacgtgcatccaaattatatacaaagccgtcatctgtactggccaagaaatgacaaggtgaaaagtgattccaagtcactctctctatctgcccactgaatcgccacattcgatggctttcatctggacttcggcagtcatacaaagccactgacttatcatatgagccagaaatcagagtctgtgcttcaaatggatganactgcagtgtttggaccttgtctgtgtgtacagcgaggctagctgctggtttccccaaggacatatcccacaaaattacagtgttgttn

SEQ ID NO: 586368 - DNA, 124 bp, Homo sapiens
tacttccggtattgcacattcagtataatcattcaagtcatgcatggacctctagagctaatgaagtataaagcgttgagagtatgcatggacctctagagctaatgaagtataaagcgttgag

SEQ ID NO: 586369 - DNA, 122 bp, Homo sapiens
ccgcagctcctggacatcttccggatcgccaccccgcacagcctgggtagcgtgtggacgatccgagtgtggcacgcaccacaaatgggctctacgccctgacctgtgttcctgccagcacg

SEQ ID NO: 586370 - DNA, 224 bp, Homo sapiens
atgctgactattgcttgagccaggagtcacgcatcactatgtaacatggcaaaacccacctctaccaaaaatacaaaaaattaggcttggtggcgtgtgcttgtagtcccaggtactcaggaggctgaggtgggagaatcacctgagcccgtgagttgaggctgcaatgagccatgatcatgccactgcattctagcctgggcaacagagtgagaccctgtctc

SEQ ID NO: 586371 - DNA, 113 bp, Homo sapiens
cacaatccagcagctctggtttgcaagtctccactgcgtgcatcactggtcgtatggtgaagtccgacgtgacagaaaatcgagcacaggatcaactcatgctacccaaggta

SEQ ID NO: 586372 - DNA, 363 bp, Homo sapiens
gaattgcaaaaagaaaaaaaaaaaaaaggttctgcaaagttcactttctcccgtgtatggagttttatgaagccctcaagatggcaaatagattaatataaagtggtcactgattgcctggccatttattctttctggccctgaaatttcacagtgaatcttaacattttgaaagaacagaggaactgcgattctttagcttgggaagaacttattcagcataagactgatcagcaactttcactacacccttcccaaaccacccccaacctccatatcacttctttactgttagtttagtaaaagttcattgaccttaagtgaactcccagaaaactattaaactggattttgaaagttaaa

SEQ ID NO: 586373 - DNA, 166 bp, Homo sapiens
ttgtgtatattttggagagacagggttcaccatcttggcagggtggtcttgaattctgacttatgattaccggctgtgccctaaagtgtgggattacggtatgagctacggacggggctggggttgcactttcaaggtgtcttggcccagttccctcccctgtctc

SEQ ID NO: 586374 - DNA, 594 bp, Homo sapiens
gtactaacaccatgtgcatagtcctggactgtgcaattgtgtttacagtgtcactgtctagatgaacacagcttgtgcaggaacgaacactcagaacgatgtgagtagaggctgctgctcacctttggtgacctgagcaatcccaggcctgttttaaattcaaaaccgcacattgcagcacatgatgccagaaatagcactgaatcaagaaaatagccattgcggagctgccctcttgagtctttctgtccatcccattctattctgtactgtgacttcagttcaggaagtttggtttagtgtataaaataaaaggaaagagcaagtttgctcagtcaagtgatcagatcccgaatctagattcccagttctaaggccttatcacctcccctgcccataggccaacaaccatagttcctcacattagagattagcagactctttgtggacgagtgaatttcacaaacagcacaatatcagaagaaatcgagggcacaggccctcacttttcttcttttgacgcatcatcctgtgatgttgaaatgtcaattgcaggatgctgatgttgtgcacgtcaatcaccgggcacttgca

SEQ ID NO: 586375 - DNA, 461 bp, Homo sapiens
accagcctgtttaacgtggcaagacccccatctttacaaaaaatttaataattagtcaggtgtagtggcacacacctgtggtccccattagttgggaggctgaggcaggaagactgcctgagcccgggagtttaagactgccaagaccctgtctcaaaaaaaaaaaaaaaagccaagccaggcgtggtggctcacgcctgtagtcccggcgctttgggaggccgaggtgggcggatcatgaaggtcaggagatggagaccatcctggctagcacggtgaagccccgtctctactaaaaatacaaaaagattagctgggcgtggtggcgggcgcctgtggtcccagctactcgggaggccgaggcaggacaatggcgtgaacctgggaggcggagcttgcagtgagccgagattatgccactgtactccagtctgggcaacagagcaagactccatcttcga

SEQ ID NO: 586376 - DNA, 1292 bp, Homo sapiens
ggtggcctgtgtggctggaacctgaccaagaaacactgccatgccagtggcagggtgctgtgcagtgagggattctggtaaccccagagaggagtgggaaatcaggaaaggcttggagtgcagttggcgtgatctcgtgctcgactacaacctccacctcccagcacgcctgccttggactcccaaatgtgccgagtgttgcaagcctcatgaccgtgacaacagccacgtctgggacagtgatggagacgataaacacatgccatggcacaggacacaatcgatacagggaactgatgagggagcaccctaacatgaccggacatgaacacagaacgagggacagatgagggagcgcaaatctgatcacgggacagaaataacacgatcatagagaagatgagggaagatggtcataatggaaccgagcacggcacaaaatcagatcatggacagaattgagcgtggcagacgaagctactggaccacagaacaaaacacacgaatacaggggaactgatacaggagacagaacatacttgaacgagagaacaggcgcaacacacaaaacatgggaaaacaggacgagaacgcacgatatacgagaaacacagaaagcttaaaccaaacccaagaaacctgaacaaacacatggagcagacagcaggcatagagaacccaagggcaaggcccccggaacaagaaaaacggctgaacaggaaagcaaaaaaaaaacggaacaaggaaagaaacaaaacaaagcgaaatgagacaaacagtgaacagaaagaccaaaagaaacagaagaaagaaacggcaacagaaccatgaagaaacaaaaaaagaggaaaaaaaacgaaaaaaagaaaagcgagaacaacgacaccagacgaaaaaaaacaagaaaaagaaacaacgcaacaaagaaaacgaagggaaagaaaaaaaaaacagatacgaaaagagaagaagaaaacaaaaaaagagaagcgagacgagagggggaaagagcgggagaagcgaacagcgaagagagaaagaagaagagaaaaagaacagagaaaaggaagagtaaaggaacagaagagaacaggtaagagaaagtggaaagtaaagaataaaagaaagaaagaaagaaaatgagaaaagataagagagagagtagcaaaagaaatagttaaagaagattaatgagtgcgggtcttcagaaggatagaacaaggaaatagaaatagttgaggagagagaagagagagaggagaagacaaatacagagaggtatataattagag

SEQ ID NO: 586377 - DNA, 215 bp, Homo sapiens
accggaggtggaggttgcagtgagccaagattgtgccactgcactcagcctgggtgtcagagtgagctccgtctccaagaaaaaaaaaaaaagataagaccaattaattaattaaccaactttatgccaataaatttaagaagttagatgaaataaattccttgaaagtcacaacctaccaaaactcgcaaagaaatagataatctaaagaattc

SEQ ID NO: 586378 - DNA, 275 bp, Homo sapiens
cccgttaaatgggcgcaatgggcaaaccagattgtatcatcacttggtgatggtaaaaacctcaccagtaaacagagctagagaagcactattgaaaacaacacagttttcttgtaccctggcgtagcagaagtttgaactgaaaccactagctgcatggctagaacataactccagactggtgctggaacttgtactcagactggtgcgattgcgcttccagcgatctaggcaggtgcgcgatggcgataagaagagccaccaagtaaccaacg

SEQ ID NO: 586379 - DNA, 133 bp, Homo sapiens
cagctggtaccagagtcatggtggcctcactttcccagaaaagcctggattgagcttggtgtctgagagagatggaaggccaccatggctctagagaagtctcttgtcctggctccttctgcttgtcctgata

SEQ ID NO: 586380 - DNA, 430 bp, Homo sapiens
ttaggcgcgctctgcgtgcaatttcatactgtttccccttgggcccagcttgtagatgcatatatgagatcatagtttatgactggcggtcgcatcttccacttttttccatctcactggcggagatgtgggaggggagatcagaaactgcttgtctggatttggcggagccaggtgttatcttcctatcttctcctgtctgatctaaaatataacttcatttcctttcccataaactcagtcttactgcatcttcgagcctggatagtctgccgcggacaacgtgttgctgaattttattctagactcgtttgaatctcttataagtactgaccggtgatgtccttgtcatacgtcctacacagggacttccatttggccctggtttcattttcgctccaacatctcagtgtttgccatacaggcaatc

SEQ ID NO: 586381 - DNA, 109 bp, Homo sapiens
atagaaaacagagatacattccattccacaatggcagaagcaggaagcaggcagaagcaggaagctggcagtagcaggaagcaagggtcttaggggcagaagcaggaag

SEQ ID NO: 586382 - DNA, 292 bp, Homo sapiens
  misc_feature (240)..(240): n is a, c, g, or t
  misc_feature (261)..(261): n is a, c, g, or t
cgggcagatgacaaggtcaggtgttcgagaccagcctggctgacatggtgaaaccctgtctgtactaaaaatacaaaaatcagttgggtgtggtggtgggtgcctgtaatcccagctactcaggaggctgaggcaggagaatcgctccaacctgggaggcagagactgtaatgagccaagattgtgctgctctactctagcctgtctcaaaacaaaaaacaagaaacaaaaacaaaacanaacaaaaaaacactgtctcanaaaaaaaaggtgattaaagagagaagaaggg

SEQ ID NO: 586383 - DNA, 398 bp, Homo sapiens
ctgaagagacggagccctcactcaagacggcccagctgcggggacctctctctaaccccaccatgacgtaaacacaggagcccttcttttgagatggagtctcgctctgtcacccaggctgcagcgcagtggcgctatcttggctcactgcaacctccgcctcccgggttcaacaattctcctgcctcaacctcctgagtagctgggaccacaggcgccaccacgcctggctaatttttgtatttttaatagagacgggggtctcatcatgtcggccaagctggtctcgaactcctggcctcaaatgatccacccgcctcggcctcccaagtgctgggaccacaggcatgagtcaccgcgccaggcctgggagcccttcttggaagaggtccttgttt

SEQ ID NO: 586384 - DNA, 997 bp, Homo sapiens
aatgcttcatgtcaacgcgtggggatctccgaagcctatcgttcacaagggggctgggagctctcttttgagtgcctgctgctgtatcttgtccctccttcagtgaaagagtatttatccataactctatgggaagaagtcttttggattccattgtcgcgtctcattgcgtgtgtgctgccatctcagtcacacgctctactactctaagtgtaatcgcttcgactgggaggcagatgacactggtggaagacgcacctgtgatcacacaggaatcctagatgtatactcttgtatgaacaagacaagttgtcaccttctcagaccatggagtctaatgaatggagaagccatatgtttctaacaatatatgaatcatcttgtaattaatccatctctctctatgtcatttcgcattcagggttagggttgactaagtaggagtagaacgtaggtggaaggggttatgaatcttctggtaagtggtatagctataggggtgtcagtatctctgttaatctaccaattttcaggagatagttcggtaagtttaaagtatccatattatgaggtaggccgaatcgataagagaaatatgagttattctacatgttggtaaaagtgtatgtaagatctgtatagcatttttagcatgcgtgagagatttaaatgacttatctgagcgtgcaaggaattggtgctgttagtatggttttgactcttaacatcggcctgacgtctgcatttatgagtttagctaggagatactggtcttgattaccgggaaggaacggcctgcaccaggagttcaatttggatagaattgattgctctccaaggagtgataaccaagtttttgttacgcaggggcaattaattcgcattgtggggtataatagagccctggatccgggggggaggaaaaacagagggttgagtgaggggggcaaaatcaagaaaaaagggccaaaaggggaagaaaaaaatatagacagaa

SEQ ID NO: 586385 - DNA, 480 bp, Homo sapiens
aacgtgcgcgacatggacaacagaagaacagatcaggaaagctcatggcccggtgcagtggctcactcttgctatccagcactttgggaggcgaggcaggcgcatcacgaggtcaggagatcgagatcacggtgaagccccgtctctactaaaaatacaaaaaaattagccgggcgtggtggagggcgcctgtagtcccagctactgggagaggctgaggcaggagaacggtgtgaacccaggaggcggagtttgcagtgagccgagatcgcgccactgcactccagcctgggcgacagagcaagactctgtcaaacaaaaaaagaaaagaaagctccctttcctccctctgttgggctaaaagcaggacttagatttacaaagacaaatggccaccccctaaaacagggagaacaaagggttaccaccaaaaacaaactttaaaaccttataatctagagatagtactgagactgtgcc

SEQ ID NO: 586386 - DNA, 348 bp, Homo sapiens
ctgcgcatgctgtctgcaggtctcacatatccagaccagtatgtatgaaagcacagcacgtgacctggccagactccatctagttaaaggagacagctggccgccttgcttaaatatgtaccatttaaggggatgtcctctgtgcgcctggccacagacatccatttgaggacactacaagcaattttgcacagacaatattgagaatgcaaatttagagagagtaatcatttctctcaatgtgtatcattgtataaacaaacaattgtgtaaacttaatgttaatttacacttacacagcttatatggacaatttcctttcatctgacatttatttacaagggtacc

SEQ ID NO: 586387 - DNA, 195 bp, Homo sapiens
catatgtcgatctagagatcccctctcaaacatatctgagtatctatctctcttttggccttagggttcattgtgggcctcggtcagcagcactgggtgctcctccggtgccacgcgcaggctcgctagtaccaatcgtagtggtgccaggatcttttccactgtcgtccccacgctgattgtatcccgactaga

SEQ ID NO: 586388 - DNA, 361 bp, Homo sapiens
aaccacccccagtgccttcaagtacaccaagctacacattggctggcagggtccgggcagctccgccccagcctggcaggacaccagtgcctctgctcacctcagggcggcagggttctgcacacaaccaccccgtaacccttctgccatctctaccaagtcctggcagcaacaaaaaaggccaagcgtctcaccacccacagtgcagtgcagccaaggaacgaggtcactcacgggcgcagatgccaccagatttgagagaaggccacacgggggtaggtgtgtcctcccccggtgctggaggccggatgcctggtgggtgggcctgaactggcccaccttaatccttccagcctgggaa

SEQ ID NO: 586389 - DNA, 758 bp, Homo sapiens
ttattgttcttggtcgtacagtaaggttatcttttatttaaaagatcattcacaagaataccatatccatagattatactttctggtcatatagctgaaggtgttaagtggtttgggaatcccattcttcacatttcaaaagtcaactgggattggcccagcagttaagatgcatggtgtattggtgtctttatcttatccacattggaagatgtaagtaaggtcatctgaaagcatcgggttggattaccacccacataatggctatagtctattctggaagtataagggtgtggggttgttccaccaaatgtgggtctcttactctcagaagcagagaagctgacagggtggaaggaaggagagagagttctggtggattgctgaggcctggtaacaagacacaggtaggaaaagcccaggatgcacggcgtggtgaccaaactactaagcacattccgctgggtgccccaggccaccctggccctgccatcacctggagagggcctctttcccaggctcctgtatgccgagcgccccaaattggtccccataggacagactgggactggggtcctcgaaggatttccatctgttcaacacgcaggcgtcaagctcaaaaggctaacccctagaatcccaataattgtgaaccctgcctgggaaccgcccattgtgccccaaatgtggccggagactaacagtgagccccaggcacggaagccggaacgctgatagcactttccaggacggtatca

SEQ ID NO: 586390 - DNA, 506 bp, Homo sapiens
  misc_feature (217)..(217): n is a, c, g, or t
  misc_feature (252)..(252): n is a, c, g, or t
  misc_feature (392)..(392): n is a, c, g, or t
tcaggattttcaggcaaaacttgtgtgcttaccattggccataccaagtgttcttactgattgcatgtgtttggttctcaagtgctgccaccctgtgtatggcagtgccttacgtagaactagttttctgtgctttttaaaatcaagcaataacatccaaaatcacttctggaaaatgagcatatgtattaaaattaatataaaagtcattgtggtntactctggttctgtgtttaatgctgtactaaaatntagatctttttcaagttgcacagttcagaagtgtggtcttcaactgctaagtataaaattcagaaaattttaaagataagtaactttatctcatccatcatttcactgaaataaagtagaattagactagtattttaaanctagcttgaaattgatcaaataagaaagcagaggttctgatcctttaaagatgagatgttacaaaattttttatttcagccaagttttagttaaaggtttttcctagtaaaaac

SEQ ID NO: 586391 - DNA, 873 bp, Homo sapiens
ggagagaactagtctcgagttttgatatttttttggaaactttaaaatccctcaaaaacggtttattatccaagtgagtttggagtcccgaggggctaatcggaaggatttcgggtagcgagcgcgggcaccagggcctccaaacttttgggactcgcagcgacgagggtcagctaccagcagggtccggtcatacgggatgaggatgtcttggatctccttctgggaagcctcatccacatatttctggtaataggccaccagggcttgggagatggactggacggatagctataaatctggggccacgtgaccaccaccctttaacacggacacggattgtctaccaccagcaaatcgctccttgccgagaagcagaactgggctcccagaagcttgtcactggtagctgtgcagcggttacaatcatctccaggggccgcccgttacaccttgatgagaccattggccagcgttaggcatgtgcggccacagttgtcgctggtcttctgagggtccgaagacctgaaccgattagaaggggacccttggaccggcatgggtccgaagcgtggactagaacaacctcaccgcgcggcgcggaggtggcggtggaacggccatgcgcatcctaggcggagtcatcagggccatcagagaaggcggttgcccagtacaacccgggagccccggcccccaggcacacataactccacctattggcgccacggagcacgtgaggaggtcccgagaagttccggagaactcttggccccagctgggtttggagaatgacttggaaggccagtgccacaaaaactccatgaaacttctcaatcagggttgtgcccggaaccctggatctgcagactg

SEQ ID NO: 586392 - DNA, 407 bp, Homo sapiens
  misc_feature (241)..(241): n is a, c, g, or t
  misc_feature (270)..(270): n is a, c, g, or t
gactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaaaagggcccacgacntcggggattctccaccccccaagatcgancccaggtgagggaggggcagatctggacagcagaatgttataacgcaagttcatgtgttgctcccaactccattctcttttctctcgtgcaaccagtttgcccattctcttcctattacttgctccagggataggta

SEQ ID NO: 586393 - DNA, 268 bp, Homo sapiens
  misc_feature (10)..(10): n is a, c, g, or t
  misc_feature (32)..(32): n is a, c, g, or t
ggaagactancaaaactaatccaaaaattaancttaaagtcaaaagcaaatgaaacaatggacctaacgtgtgtccaaattggtagcataactacacggaattattttcaaaatgtcgttaaaacagtaatttgaggctaggcctgtaatcccagcactttgagaggctgaagcaggagaatcacttgaacccaaggggcagaggttgcaatgagttgagattatgccactgtactccagcctgggcgacagagtcagactccgaccc

SEQ ID NO: 586394 - DNA, 137 bp, Homo sapiens
  misc_feature (134)..(134): n is a, c, g, or t
cagaacgccatcactaaatcgtgtctggtagcatagctggtggttcgctggatcagacccctcctttcaagatctctgtgaggcttcgaagctgcagctcccgcaggcctcctggggaggcccctgtgacaggngtg

SEQ ID NO: 586395 - DNA, 139 bp, Homo sapiens
ttaactgcatttggagaactgcatcacacttttaaataaaatatacaacacacattttgcatagctaagaaactacaaacttaggctgaattactgcgaaaagatctgaataaaaaaagatgacaagctaacagacgga

SEQ ID NO: 586396 - DNA, 1188 bp, Homo sapiens
tctgggggatagatcaatttaaatacaattaatacattcatgctggtggggggtaacaactttcacattaatttggtaggactacttttctcaactcatgacaaaggccacaatccaaaagtataaataaaacattacaataaagtttacaaacaaatgtggcacaagaggcaccaattttgaagattattaaacgagaaaacacaatcgtgaaactagtggctatcaacttgaaatatattttcatttccagaaaaatatttggtctttttaaaccacgtgtcctcaatttggctagtgggtggcacacgtttgggtgttacaccgtgggtgaactataactactataaatacacccatatcaactatgttaaacaatttataaattaaagccattcacataacgcggtataaaacaacctaaaaatatttaacaatatatgtctgaatattttataacacatatatatttaaaagtgaaataaatatcgtgctaaaagtggtctttacatttacccattatcagataaatcagtgtttgaacaataacagtgcttttatcttccccttatagaaatctcagttacactccagacatatatacactctgagacataacgtggtgaaatttcagccaagggattatttaccaacaagaaacaaacagagaaagaaaaacaaaaaaaaaaaaaaaaaacaaaaaccacatgcaacgacaacaaccacaagacaaaacaggggggcgacacagataaaagcaaccacgaaagcgacgagccaaccgataacgagaaacagcgacagttacaagaaaaaacacgcgcccaaaagaagagagacaccaaaaaccaaacaaaaggaagcaggaatacacaaaaagccggagaggaaaaaaagcgcaagaggaagtaggaggaggagcacagacgagcgggcagccgcaaagcgggaaccaaacaaacaggaaaagaaaagccgaaggaaataactaacgagagcaagtggggaggcaacacgaattcgggggagaaaagaatctctggatataaaatcaagagcgagcgacagacgaatcagaagccacaggaccgaacgaaacgagagagcaagggacagacagcgcgaacagaaaccaggacagacaccgcgagaacaaccgacccacagtcaagagaccacacgcgggag

SEQ ID NO: 586397 - DNA, 1257 bp, Homo sapiens
  misc_feature (667)..(667): n is a, c, g, or t
ggtaacaccatgtctgtgcccctgctcaccggatgctgtcaccgatgtctggcagctgagcgaggaaacggcccgcggtgattgctaattacatggcacttggacgacacagggcacagctgagttcgtgacgcgccgtctccatccagtcccggggtcacctcaacgttcgagatagagtatgtccgccatgcgcctaggatccctgtgagacctcaagcatgaacatggtgatgaccctccatggatttgacctgagtgtgcgtgcttgatgtccaggagtcggccccaagatggaacgaaggactggacaatcaatgaatgcgtcggtcaagagaaacattcaatgggccttgagttggactcattgacacactgacagacagcgggactcgccttgtccaagtcgagacttcgtcgctgagcgaagagcatttttccagcatgaggccatggcgtgcccccttggtacacacctccttatcgaacggagggcactacactcattgccctctcacccacttcatgcgccttgggtctactccttgttgcgccgttttagaggcattgtcattggaccttcgcactacattgtcaacgctgggaggcccttgtctcctcccgaaaggccagaccttaaattggcgcgcagagtgcccatatgtgnaacgcatgagtccgattatcgtcacgatgctgccggaatgggggggaaagccatagtgcacaccgcaaatggggttgcctctggttgcggggacttttgtggcgggggctcgcttgccactgggcgctggagagcaaaggcagtcgctggatcctaggtcaaagttgaagacaacgacgttggcaccagcggtggattacgcaaagtgttgcgaaatagcattggattatggcccccagggggtaggtacaatgcggccaaccaaaggcttttccctgtggttgcgcttactaaggggaaggaatttggggccatgggcgttggttgggacactgtggagacttttatcgttgtggacaggccaaagggccttgggcaatggcccgttcaccgtgtctctttaaacgggttagagattccgggcttgtggactcggccaaagagtggcccagtgctaagcacacccagggcacatccagttgtggggggcgaaacctcctaggggataagaccaaaacggatcggatggaacatgccaaatcagtgggacgcatccttgacgccgccggggcccgtaaggggacaccgcg

SEQ ID NO: 586398 - DNA, 1100 bp, Homo sapiens
tgggtgagctctacacattcgagatgaacaaaacctcatcttagtgataggccatatgctgcagctccggtaatgagtgatgctctagtttcgaatgcgtttgaagctaccgatcagcatgcacgatacaggacgacacttcggaaggctattgaggcttcacgtggtagactgggatcaatggtgtgaaactttactacaattctacgcattcaatcgcgtgaactgggacgcacacctaatagttgggggacacgatcaagtcattggcgccacaggaaacgcccttgggtcattcgattcgcaagaacaataaggacctacagttatcgcaagttgtattgatatcctgtggttcgtctccgaaccttaactaaccaaaacaaggatttctttgtacgtgaaaacaactaagtattccctttgcgtgggcaaaggttgttgatacaccgcaaggcaccttatcgacgtttcgtttccgaatgtgggacccatttcaaggaaaagggaaatatgtgactttatgtggggcccttcatctcttattcggaaagcccctaagggtaccttccagctggtgggcctcggttaacctttctaggcttggctttctccaatatgctagcccaatttacacgatatacgtagaccatgggtgtgggacccaattgtcgagataggcgccggtagcacgaaccacgggactccgggcaacgcgctggggccagcacttgcacaaagtgaccccaatctatattaacccaggcgggacaacttcatgaggcaaagataggtccgaaaccagatggttttaccatcgggcgtcttgacttccctcttgaatgcttcctatcgtccaggggatcacagcatgccttcaacttgatccaagaagaccctattgaaatctcggcgcgcatatctgcctacaacacagccatttctttgtcacaaggcctagggccacactccacgtgtgatggcctccacaccgccatgaacctgtaaacgtggcctgtatctttcaacatctttatcagcacagaatgatcttttcgccatcaggaaatccactgcagcaagcaagcgtgatcctcgag

SEQ ID NO: 586399 - DNA, 485 bp, Homo sapiens
  misc_feature (6)..(6): n is a, c, g, or t
  misc_feature (23)..(23): n is a, c, g, or t
  misc_feature (161)..(161): n is a, c, g, or t
  misc_feature (176)..(176): n is a, c, g, or t
  misc_feature (472)..(474): n is a, c, g, or t
aagacncctgcggggtccctttnccctagaacatttaacctgagaaatccggtgttgaatgtttaaaacttctaaaaactgttattattactgcccttgatgtggaaaattcgtgggtattcctacccagagtatagcccagattatcatgaaaccacagnaaaatatctcccaanagtttccttaaagtccataattttgggcccaggcacggtggctgatgcctgtctgtaatcccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagcnnncaatctgtctc

SEQ ID NO: 586400 - DNA, 1243 bp, Homo sapiens
ccggctcccggtccctggcccctcagcggcatggcgtgcggggcaaactgctgaagctggcccatggaagttctgaggcggctgctgctgagcccctggctcccctgaagctggctgtgcgctgctgccctctctgcccaggccccgactcctgggcctacaggccccctggacggcctgagccggccgcctgcgcgtttcatgacgcatgaccccaccgacagagtcttgcatgcagccctgccccgcccggcacgcgagctggctgccgttccaagctccggaagcaagactctctctcaggaagcactacaacaccaagcacatcatagctcgcttattcacgagcgctgggcacgcaccacttctacgcaaggctcaggtagcgtataattccaggagctgcacagccttgctgcctctcgagacaatgtcaaccgcttcagcttcccatcagggcagcttcaactaggcgaccgtaaaggcttcttcgcagggcttacccgtcagtggtagttgaacgcgaaacgggagcccacgaccgcagcaatcttaacaccatccgtagcaaacgcctttggcgccacttaaactagttggctgaacgcgcgccccattcctctaaccacacgcaaccttaacttgcacaggcacttacacagacttcggcccggcagcggcacggatacttggaacgccacaagagttccccttcaacacttagccccaaaggagccctcaaggccaggcacaccaaagtcacttgaacactacgatatttaggggtgcaaagagttttccaaccagcactttgcaacttccccggaacctctcacttggccgaaaccggcgctacttgcgcgcacccaaaggggccccaaagtcagacacgggccgtaactaggttgcatccccacttggctaccggacatttctgggtacaaacgcacattaacttcctttcgggaagagttacaccccacagagcggctatcagggagccgcagttccagaaactcgaaaggcaacttgggcgctttgagccttgagtctacgcaaccagctatcacgcagttgcgccaaagcccagtcgggcgacctattctgcgaagctatggttccaaccacggactcttcgtccaccagtcgctttccccagacaaccgcattatccagtggcagcatctcccccttgcagacgtgaaaacccaaccgttcttaacaacacgcgcggactctaccg

SEQ ID NO: 586401 - DNA, 261 bp, Homo sapiens
aagcagtttcctcaagagacatcgggtacatgacacgtactacttagtaacccactgcctctatgtcctatcgctaggagctgtatttgccatcataggagccttcattcactgatttcccctatactcaggctgcaccctaggagcaaacctacgccgaactccatatcactatcatattcatcggtgtacctctaactttctgactcaccgcaccccttagaactaggtgtggaggaaaccgcggtcgaattcgtactc

SEQ ID NO: 586402 - DNA, 205 bp, Homo sapiens
  misc_feature (16)..(16): n is a, c, g, or t
tcagtacatgggaccnaaaggagtggcactcttctttaaggtttgttttaataactggttatttgggggtttctgagaatattgcctgtgtattaccttggggttgtgtttcagttactgggagtttgttcaatccacccaaacttgggaggcagcatcatgtagaagaaagggtgtgggctgtgagccatacagcctaattatt

SEQ ID NO: 586403 - DNA, 1424 bp, Homo sapiens
tggtaattaagttttaatttcataatcataaacttaactctgcaacccagctaggcatgggagggaacaaggaaaacatgtggaacccaagagggaacgtgcagcgagaagcacaaagaattctaggatacgtgcgagccaaagtgggggtggagggggtgctcttccgtgagcctacagaaaggaagtgatcgtgggtggtttaagaataaaacacaagttcaaactttattctcgagttgtgctccaacagtctcagaaagtggtggactctctttggccgtggctctttgaccaatctccgtggaccccaaaaggcgcctccatgtggccctccaacaatatattctcagtggcctttctttctcccctttgtgcacaaacacacccaccatgtgtctgtgtgtccactctcacaaacccaccttacaatgtctctatgtggacagggtgtgtcagagatgtataaaaacctgtggagaaaccccattgtgtggtgtttgtggggtctccagcgacatatgttggaggcgcgggaggtggcggcattacacctgcggacagccgaagaaagcgacaagagagagaggagagagccaagtctctcacattgtggtgcccgcggggagagcgcccttgtgacaacacacacagtgtaaggtggtccccccctcacagggaataacaaagataccagggagccaccaaggacccacacttctaaaaaagaactcttaccccaaaaaaacccccacaagagaaaaagcctggcccacagggggggagactcattagaagaaaacgcgcggggaccccacagttggagagcacgtagcaggagaaaaagaaaagataagagagcaaattacaacactaccaaaaccacatacaaaaagcccgagatgggacaagaaaccgatgggagacacaaagacatcacaatagaggaacaaatcaggacctatcatggcaaacaagaccaacaaacccccacgggacacgacaataccccgggcgataacaaggcaagcacagaattgagaaggagggagaaaccccgcaggaaaagaaaggcagagataaacaacaagagatagggaaaggaaacaagtgagagtgaaacaaaaagaaaagcaaaaaacctcggagataaaaagaatgaaaagtgtgacaaagaaacaaaagagaagaacacgcacgaaagggaatgagataacgagagggccacgaagcgagcccaagcggcacgatgacggagcggagagacagccgaataagtgaagatcagggaagagaaacgagaaacaccgagagagcacaggtaacccctgaaggacaacaaaaccgagagaaacaaaaaaggaaaacacgaaggagacagagccagagaacaactagagacgcaaaacaaagagagtgagcga

SEQ ID NO: 586404 - DNA, 683 bp, Homo sapiens
  misc_feature (512)..(512): n is a, c, g, or t
acttatcgccgtcttatatactacatattctgtttatttatttatggtttgtttcatcattaaaatataagctcaataagattataaagttttgttcattttgttcactgatctttccacagagcctcaaataatgcctgacatagagaaggcactgaatatataatgatcatagcaactgaatttctcaaacaccttttgtttgccaggcactgttttaagtgttttgcatttattctttcattatggatattaagacattataacgtgccttagtgcagacacaggatcagcacaggttatgtagttgaacatacatactcaggggccatgccaaactccacagtgatgcaggatctcccacgttgtagtgtcacaggttttctgatcctacccctaaagcatagtctctattctatatgagtaatatgcactaatagggggactctaaataaccaatatgcacttacataaagccagatttcatttttgctgggatatttctttatgtngtttgggagagggtgatgcctacaagaataagattctgatgacacatacaagctagcccacctgattcgatccctgggtgaacaggtatctcttttacttctttaagctcctcaaggaatacatatatttcactttattaacttcaagtttcttatctttgagtctctcct

SEQ ID NO: 586405 - DNA, 250 bp, Homo sapiens
  misc_feature (1)..(1): n is a, c, g, or t
naaatggagggtcccacccaaaaggtcccccctgaaccccagccccctccccatggaaaaacaatggtgtgccaattaggggggaaaacgggtttaaggagttttttaaactaaaaaaaagggggaaaaatttttccggttaaaaaaaaaatggccattttaaaaacttgggaaaatgcaaattaatagaaaaaaaggggggggaaaaaacccttaaaatccccccccccggaaaccccccttttgaaat

SEQ ID NO: 586406 - DNA, 317 bp, Homo sapiens
  misc_feature (128)..(128): n is a, c, g, or t
ccccccgggttttttccccccccttttcccttggggaacccggggggcgcccccaatattttttttggtgggggtcccccccccgggggtttttttgggccctttttttttaaaaaaggcccgggganatcctcccgggggggggtcccgggccccttttcaaaggggggattattttttttagcccccattcccggggggggggcgggggtccccttttttttcccccccctttggggggggggggggggggtttttttttgcccctggggtttccccccccttttgccccttggggggccccccccttttcccca

SEQ ID NO: 586407 - DNA, 971 bp, Homo sapiens
  misc_feature (123)..(123): n is a, c, g, or t
  misc_feature (125)..(126): n is a, c, g, or t
  misc_feature (128)..(131): n is a, c, g, or t
  misc_feature (136)..(136): n is a, c, g, or t
  misc_feature (139)..(140): n is a, c, g, or t
  misc_feature (154)..(154): n is a, c, g, or t
  misc_feature (166)..(166): n is a, c, g, or t
  misc_feature (191)..(191): n is a, c, g, or t
  misc_feature (205)..(205): n is a, c, g, or t
  misc_feature (210)..(210): n is a, c, g, or t
  misc_feature (221)..(221): n is a, c, g, or t
  misc_feature (260)..(260): n is a, c, g, or t
  misc_feature (273)..(273): n is a, c, g, or t
  misc_feature (597)..(597): n is a, c, g, or t
gtcgacaacggtcaactctcccttatccacacacagatggccacttctgcctccatccactcaatgccaacaggcaccattcctccaccgaccacgatcaaggccacagggtccacccacacngnncnnnnaatgncanngacaccagtgggancagccaatcccnaagctcatttagcacggccaaaacntctacatccctacnttacnacacttcctcnacacaccatccgtgaagtcaccccaacttctaccaccancatcacccccaancacaccagtacaggcaccagaacccctgtggcccacaccacctcggccaccagcagcaggctacccacacccttcaccacacactccccacctacagggagcagtcccatctcttccacaggtcctatgactgcaacatccttccagaccaccactacctatccaaccccatcacaccctcagaccacacttcccactcacgttccacctttctccacctccttggtgactccaagtactcacacagtcatcacccctacccacgcacagatggccacttctgcctccatccactcaacgccaacaggcaccattcctccaccnacaacgctcaaggccacagggtccacccacacagccccaccaatgacgctgaccaccagtgggaccagccaagccctgagctcattcagcacagccaaaacctctacatccctacattcacacacttcctccacacaccatcctgaagtcacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagatcact

SEQ ID NO: 586408 - DNA, 219 bp, Homo sapiens
gcgtggtcgcggccgaggtacggaatagaatggaatggaacgaattgtaatggaatggaattgaatggaatggaatggaatggaataaacccgaatgcaatggaatggagtggaatggaatggaatggaatggatcaacccgaatggaatggaatgtaatggagagtaagggaattgaacagaatcaatctgaatgtaatggaatggaatggaacggaa

SEQ ID NO: 586409 - DNA, 670 bp, Homo sapiens
  misc_feature (288)..(288): n is a, c, g, or t
accacctcagccaccagcagcaggctaaccacacccttcaccacacactccccacctacagggagcagtcccatctcttccacaggtcctatgactgcaacatccttccagaccaccactacatatccaaccccatcacaccctcagaccacacttcccactcacgttccacctttctccacctccttggtgactccaagtactcacacagtcatcacccctacccacgcacagatggccacttctgcctccatccactcaacgccaacaggcaccattcctccaccnacaacgctcaaggccacagggtccacccacacagccccaccaatgacgctgaccaccagtgggaccagccaagccctgagctcattcagcacagccaaaacctctacatccctacattcacacacttcctccacacaccatcctgaagtcacctcaacttctaccaccaacatcacccccaaccccaccagtataggaagcagcacacccatggcccacactacctcagccaccagcagcaggctaactacaccattcaccacacactccccatctacagggagcagtcccttctcttccacaggtcctatgactgcaacatccttccagaccactactacctatccaaccccatcactctctcagaccactcttcccactg

SEQ ID NO: 586410 - DNA, 1498 bp, Homo sapiens
ggatctgcatccacaccaatgcgcacgtcagccgtggaggtgtcggcgcgaggacctagctcaccgtgctagtacgcagacatagtgtaggcggaacggctagtaactggtcggcttatacctagctagaagccttgcgcaactatctaggcaccaacgcaacaacgggcctaggctatctctaggctagggcctactaactgaaataccacagtgctacggcgactgccacgaacacggtaaactacgcgatacaccatccgcctgactgaacgacaatccaaccagcatctacaacgcgcccatccgcagagcctacacgcaactgaccaacagtgcgagcagaagagcgcacgaactaccccgcgcacagaacgcttgctcacgcccacacggaaatcatagatgcaagacccatagcgccctaatccacgactccctgtatccgcattaaccacatcaccacgggcacccaacgcgccaccgtatccggcgccacttacccaaactctacacccctaacccaagaaccgggatcactccgcaaaacgtcacggtccggcaagccacacgggtgcaaccaaattcccagttagcgctcccccgcaccgcaagtacggttaacccgacaaaagcaagaacccgctggcccgcccccggcattcgccgccacacgacggcggacacagtgcccagtgtacatcccgtacccactaggccttgggttaaacatagctacctgtcgcaatcctgttgtcaccccccctggagcgattcccaataaacccgcacaacgcgcctccccacacacaccgacaaagcacaacgggcatacagcccgccgcacaaccccgcaaaacagcgaggttcgcaaacaacccctcgcgcgcacacaggcaaaagagaccactggaaacaccgtcgcgcccggccaatgggcggcccaccgaacctcgggcacgcccctcgactaatttacacacccgtgtaagaaccagataagtttacaacaccaacctggcgggccgcgcccccgtctagagcgcctagcacgatccaaacggccacatttgtgtcgtctcaaacgtgcccaaacacacttatgggagtgtagccccacaatcactgaaagacgcagcagccaccagcctttagataccgccactatctgtcctcgcaccaccccacactaaggcagccctaaatttaatgagggggacagacccacacacaacaaaagaccagagatagttccaccactccatacattatggacagtgataaacaaacacgtacatcagcacacaaactacgaataatgacggagaaccgacccccgcacttacgagaccagaagatgtcgatgaggtcatgtatggtgcaaccagccccgcaggacaagcaaacgtattgaggctacggtcgtgccgacgtacaagtcatccccacatagcacatcgcgaacaagccacaactaacagtagcgtaccgtattaaa

SEQ ID NO: 586411 - DNA, 296 bp, Homo sapiens
  misc_feature (89)..(89): n is a, c, g, or t
gcggggagagctgcctccacggccgggcacccagaccccaccgtcgcagtcgccaccacctcagttcctccttgggacccgcaattggntttggattcctccagtgcacttttaactcgattggccaaggattactaagactcacttctgtcctcatcccagtcgcgccggcggtgaccatctcggctcttttgggcttaactgccgctcctctggactctgtctgactctgggggcacatggacacagtgggatggagattcctgtgaccctatcattaaagcaccgatcagaga

SEQ ID NO: 586412 - DNA, 743 bp, Homo sapiens
  misc_feature (123)..(123): n is a, c, g, or t
  misc_feature (125)..(126): n is a, c, g, or t
  misc_feature (128)..(131): n is a, c, g, or t
  misc_feature (136)..(136): n is a, c, g, or t
  misc_feature (139)..(140): n is a, c, g, or t
  misc_feature (154)..(154): n is a, c, g, or t
  misc_feature (166)..(166): n is a, c, g, or t
  misc_feature (191)..(191): n is a, c, g, or t
  misc_feature (205)..(205): n is a, c, g, or t
  misc_feature (210)..(210): n is a, c, g, or t
  misc_feature (221)..(221): n is a, c, g, or t
  misc_feature (260)..(260): n is a, c, g, or t
  misc_feature (273)..(273): n is a, c, g, or t
  misc_feature (597)..(597): n is a, c, g, or t
gtcgacaacggtcaactctcccttatccacacacagatggccacttctgcctccatccactcaatgccaacaggcaccattcctccaccgaccacgatcaaggccacagggtccacccacacngnncnnnnaatgncanngacaccagtgggancagccaatcccnaagctcatttagcacggccaaaacntctacatccctacnttacnacacttcctcnacacaccatccgtgaagtcaccccaacttctaccaccancatcacccccaancacaccagtacaggcaccagaacccctgtggcccacaccacctcggccaccagcagcaggctacccacacccttcaccacacactccccacctacagggagcagtcccatctcttccacaggtcctatgactgcaacatccttccagaccaccactacctatccaaccccatcacaccctcagaccacacttcccactcacgttccacctttctccacctccttggtgactccaagtactcacacagtcatcacccctacccacgcacagatggccacttctgcctccatccactcaacgccaacaggcaccattcctccaccnacaacgctcaaggccacagggtccacccacacagccccaccaatgacgctgaccaccagtgggaccagccaagccctgagctcattcagcacagccaaaacttctacctccctaaccttgccaaggtgatcgtggggtcgtaaggc

SEQ ID NO: 586413 - DNA, 2421 bp, Homo sapiens
  misc_feature (123)..(123): n is a, c, g, or t
  misc_feature (125)..(126): n is a, c, g, or t
  misc_feature (128)..(131): n is a, c, g, or t
  misc_feature (136)..(136): n is a, c, g, or t
  misc_feature (139)..(140): n is a, c, g, or t
  misc_feature (154)..(154): n is a, c, g, or t
  misc_feature (166)..(166): n is a, c, g, or t
  misc_feature (191)..(191): n is a, c, g, or t
  misc_feature (205)..(205): n is a, c, g, or t
  misc_feature (210)..(210): n is a, c, g, or t
  misc_feature (221)..(221): n is a, c, g, or t
  misc_feature (260)..(260): n is a, c, g, or t
  misc_feature (273)..(273): n is a, c, g, or t
  misc_feature (597)..(597): n is a, c, g, or t
gtcgacaacggtcaactctcccttatccacacacagatggccacttctgcctccatccactcaatgccaacaggcaccattcctccaccgaccacgatcaaggccacagggtccacccacacngnncnnnnaatgncanngacaccagtgggancagccaatcccnaagctcatttagcacggccaaaacntctacatccctacnttacnacacttcctcnacacaccatccgtgaagtcaccccaacttctaccaccancatcacccccaancacaccagtacaggcaccagaacccctgtggcccacaccacctcggccaccagcagcaggctacccacacccttcaccacacactccccacctacagggagcagtcccatctcttccacaggtcctatgactgcaacatccttccagaccaccactacctatccaaccccatcacaccctcagaccacacttcccactcacgttccacctttctccacctccttggtgactccaagtactcacacagtcatcacccctacccacgcacagatggccacttctgcctccatccactcaacgccaacaggcaccattcctccaccnacaacgctcaaggccacagggtccacccacacagccccaccaatgacgctgaccaccagtgggaccagccaagccctgagctcattcagcacagctacagcctcttcttccttcatatcctcctcgtcttggtcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactggatcagggtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccactgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaaggcaaaaaaaaaa

SEQ ID NO: 586414 - DNA, 2062 bp, Homo sapiens
  misc_feature (238)..(238): n is a, c, g, or t
aagaagcatcattgctgaccggccagggtactggccagagcatacgccttcagaatcccagccttcgtcgccttctccgaccccatcacaccctcagaccacacttcccactcacgttccacctttctccacctccttggtgactccaagtactcacacagtcatcacccctacccacgcacagatggccacttctgcctccatccactcaacgccaacaggcaccattcctccaccnacaacgctcaaggccacagggtccacccacacagccccaccaatgacgctgaccaccagtgggaccagccaagccctgagctcattcagcacagctacagcctcttcttccttcatatcctcctcgtcttggtcgtcttggctgcctcagaactctagctcaaggccaccgtcatcacctatcaccacacaactcccccacttgagttctgcaaccactcctgtttccacaactaatcagctgtcctcctcattttctcccagtccttctgccccctctactgtttcttcttatgtgccctcctcccactcctctccccagacttcatcgccttctgttggcacatcttcctctttcgtgtccgcccccgtgcactccacaaccctgagctcggggtcacactcctcattgtccactcatcccacgactggatcagggtctgcatctcctctttttccttcttctccagctgcctctactaccattagggccactctcccccacactatctcctctcctttcaccctctctgctctactccccatatccactgttaccgtgtctcccaccccatccagccacctagcctccagcaccattgcatttccgtccacgcccaggaccacggccagcacccacaccgcccctgccttctcctctcagtccaccacctcgcggtccacttctctcaccacccgagttcccacatcaggctttgtgtcactcacctcgggggtgacgggtatccccacctctccagtcaccaaccttaccaccaggcaccctggtcccaccttgtcgcctaccacacggttcctgaccagctccctcactgcccatggaagcacccctgcttctgccccggtatcttctctcgggacacctacgcccacctcacccggggtctgcagtgtgcgggagcagcaggaggagatcacgttcaaggggtgcatggcgaacgtgacggtaacccgctgtgagggcgcctgcatttccgctgccagcttcaacatcatcacccagcaggtggatgcccgctgcagctgctgccgccccctccactcctatgagcagcagctggagctgccctgccccgatcccagcacgcctggccggcggctcgtactcaccctgcaggtgttcagccactgcgtgtgcagctctgtggcctgtggagactagcagggtcgctgcctgctctcctggggctgaaggactgcagatgacagacaggaaaacacccaccagcccccttcccgcttgtgccagcagctgctttcctggtcaccaggcctggcccccaagtgccctgggccgtggctccctggggcaccggttggagaggggctgccaagcaggggctcagactaccacactcctgcagaccctgagccagcagagagggactgaggcggacagtggtcacggacctcccaggcacacagggcactcccgaccacccctgcccactgtccaacacctcccagcccctgaacttggccccagccctgctgggcccagaaccctgcagatgaagccacagagcaggcgctcgaccagacccatcaggggcgaggagggcacggaaacctgtgccgagatgggggcaagaggcccaggcagccaccagcacagagaagaggagatccccagagtcagggagggcagagggtggcagcgagggcagggcagccgcccccgctcccagccaggcagaaggcccccaccagcaccacacccatccccagcagcctgtccttgggagagggcgtcacccggtcagagactccaaataaaccggttcttgtcaaggcaaaaaaaaaa

SEQ ID NO: 586415 - DNA, 104 bp, Homo sapiens
gcccaacactatcgcccacctctggttgagaaactttttttcttcttcttcttcctcctcatcaggctgtgtttctgagtcttcctcaggtgttggggataacg

SEQ ID NO: 586416 - DNA, 597 bp, Homo sapiens
  misc_feature (223)..(223): n is a, c, g, or t
ggcacattcttatttaggagcagcctctcttaaggtctagaagaaatcttagacactatactatcaaccatcacaccctcagaccacacttcccactcacgttccacctttctccacctccttggtgactccaagtactcacacagtcatcacccctacccacgcacagatggccacttctgcctccatccactcaacgccaacaggcaccattcctccaccnacaacgctcaaggccacagggtccacccacacagccccaccaatgacgctgaccaccagtgggaccagccaagccctgagctcattcagcacagccaaaacctctacatccctacattcacacacttcctccacacaccatcctgaagtcacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagatcact

SEQ ID NO: 586417 - DNA, 499 bp, Homo sapiens
cacgaggcatccaccagggtggccacgaacggcgccgaggcgctggccggatcgaagccgagccgcttcaggacgaagggcagcatcgagccggacagcgagccgaaggtgacgatgccgaccagtgcagcgccgatggtgatcgccagcaggatccagtgctcgccgtaatcatgcaggccgcccagctgccagatcacgatgcgcacgatggccaggcagccgaggatcgcgccgagcaccatgccggtcgggatctcgcgcagggccaccttccaccaatcgcgcaggcgcagttcgcgcagtgccaggctgcggatcagcagcgacgtggcctgcgagccggagttgccacccgagctcatgatcagcggaatgaacagggtcagcaccaccgcccgcgccagttcgtcctcgtagtgctgcatcgcgctggcggtcagcatctcgcccaggaacagcacgctcagccaaccggcgcgcttgcgcagcatctcga

SEQ ID NO: 586418 - DNA, 196 bp, Homo sapiens
ggacggggattacaccgtgattatgcatccggccagaaatcagtgtttttaactggattattttattattttatagagatggaggtctcactctgttgcccaggctggagtgcagtggtgcagtcatagctcactgtaaccttgaactcttaggctcaaatgatcctctcgccatgactcaagaatccccggtcga

SEQ ID NO: 586419 - DNA, 128 bp, Homo sapiens
tgtcgagcgcttcttgggtacacatatgctctgtgttttgatctgaagactagtatgtgagtttgtttttttcctttttttgggggtgggggtgaggagtgtggagaaaggggaaacaaagatcgagc

SEQ ID NO: 586420 - DNA, 574 bp, Homo sapiens
gaggcgggcgggcgggcggcggggctcggcgatggtaggcgtccctgtgagtggccgccttccagtcttggtcctggacaaaagggtgccagtcgatgcctgtgatcgcctgtggaggtgaagatacagtccagatcctcacctcccatcatgccatcgcctcccatcaataaatcctggaggaccgaggccagtgtcgttcactcctactgcagtagagcaatggcatcgaaccattctcctcctaccctgaatggtgccccagtcaccgccacggagattcagcaagggtccggcctcctccacatcatctgcactcacaactcagcaattgccagcgcacttgtggtgttcgagaagtcagcaagttgaaacgctttcttaccattctgcaatagtttggcaaggacatctcccctgacatgggggagaaggtgcggactcttgtcctggccttggtgagctcaacagtgacaattgaggagtccactgtaagctccaagaagccaaaacttccccttcgcctttcgtgatgcattctcaaggcaagctgcctgctgagtgggaatgtgag

SEQ ID NO: 586421 - DNA, 2130 bp, Homo sapiens
ctggacgggcaacacggaacggtgccacgcctctctcctgcggcgacaccttgctcttcttacaacctcccaaacgcacctctgacaaccaaccacttccccggcaccacgactgcacaccactgctctctggcctctctatactcacccctctcctccttcaatctgcatcactcccctatcccacaagtccatctaagcctaccaccactctgggctcacgctcctacgtacaccacccaactccctggccaccttcctccctccacccgaacaccgcccacctctccacacccccgcaacgtctcccactcctcccacccacccctccacgcccccaccttcccccacaacgacaaaaccccgtgcgccagtgggcaacccgggcttacccacgtgggcctggggggccaacttgggatcaaggcgaaggccatcacgcttacaacaaacaaacccccttacgccggcacccaccccaagcacacacacgtgcgcgcacacacacggcgaccccgctcggcgccaccacccgggcacacaacccagcggcggccgaccacacccctctcaaacacccacgctaaacaacggccgcgcgacctatacacccttactacacactcccgctggcgccactgccgcgcgcacccactacctcagcacgcgtcaagcaccgacccgagtcttaacacagcaaccccgccgctacgtcaccacagcagtaaaaacaccgctgttgagggagcgcgcgccacccgccacacacgggcgtgggcggacacccccttgtacctcgcggcgagcagcacaacaaaccggcgctcctaataagaacgctcttatcaccaccaaccggggcgacccgaaccgcaccacaccaacccctgtcgcggcgggcaccccaacgcgacctatcccgcagaacacaccccacgccaacgccccacacacaacgcggggccctcctttaaacacgaaccctcctggcgcgcgcttataaacacacaaccaaacgaaccgtctcctcccgacccaaagcattcctaaaccaccaccacacccccccgccgccaacacaaacccgacacctagacgaaccaaacacacgcaccctcgcatacacacaaaccacacacgacacacgcacacacaaactctccctcgggtcagccacaacaaccaccccgccacccaacaccaagcacacgcaacaaacgaccacggcgaaccctctgcgtcgcgcgcaaaccatcacataccaagcgccgcccggggggacaacaccaaccttttactaccacgaaaccagacccccgaccactactatcacgacccccactcccgaccagaacgcacccgactggcggcgtgccaccccacccaaacagctgccccattcatccaaacaagacacctaatcttccgcacccgaactacattaactccatcacccccccgtactctacaacaaacaatcacgtacagaggagcggagacgaagataaacaacaacacaaaccgcccccccaactacgggggctgcgggtccacataccccacgacacatcaggttcccccagacacaaaccacacgacgagccggggggggcggaccgaaaccaccaccaagcagctcactaacacataagacaccgtcactcgtagatataacaagaggcacggacactcgtgtgtgcgtcacgcaacaacgccaaccatgttagcatcgctaccactacaccaccactacatatatccgaccagcccttatctattcataaacaacgacaacaaccacgctgacactcaccacaccacgagcggacgagcaacacacaccaggtgagcagccgcccatccacaacacgcacaaccaaccagacacacccacccagccgccctaatcagccaccacgacaagacgcataaatcaacatcacactcagcacacgcacgaccgacaccacccagcaatccatcgacaacaacaccaccacatcgaccattcgcgccaccccaacctcactacaccaaccccagccacaactaactcgaaccacccaacaacacccggcacataagcagtacaccccacccgaccttcgcgtgtgtgcgcaaccccacacc

SEQ ID NO: 586422 - DNA, 109 bp, Homo sapiens
caggcacagactgaccgagtgagccagcgaacctgcgcggctactacaaccagagcgaggccgggtttcacatcatccagaggatgtatggctgctacgtggggcccga

SEQ ID NO: 586423 - DNA, 990 bp, Homo sapiens
ggattcctccctcttttggagatcccggggtaacaatacactttcgggcagtccaaaaaggttgacccaggtcatgtggttttttcaaccgcaacaatgggggcgcgcaagagctgtgcgttgctgtcctaaaaaaggcaccccctggtcttgccatgagactggggaaccctcgccttcctggagaacgcgacattgttgtgcagttcggagcattccgatgaagaccacttgttgcactgtgaaacaatatttaggttccatttcccctctgcggtggaaattccatttattggagcgaccacaagtgttatctgtgctctctggcttatatgagggaagggtgctgcctcacatcaccacctcccgtttgtggcgggcaattctgtcagttacaatttagggttccaaacgaaagtagcctcatttacggacacacggtgttgctcattgggcgggcccccccccaatgaacccccgaaggcggggggtcctcctccgctagatgcgaggaatcataatgcagccattgaaaggtgttgttcattgtagaccccatgaccagttgtgaaacaagagtgtgaaaaacattgtgggagcgacaacactccggacaaacatatcggcgcaagttgttttcctctgtgaacatataggcacacctccgcatcattgttagtgggggcacacatctcccacatttgaaagaagattattctgctcgcagacagttatttctgtttgtttcaacgtaatagtagtgttgtggaatatcgggagtgagacttacgagggaaactccttgtgcccaggaatatatgggcgaacaattgttcagtcgtgcatgcgcttgtacagcaaccctaggaggccaccaaacacggccctatcattgacagcaagcctccataaacaatggccgttctttataatattttaggtgtcccccccggttgccagaggtttcccccatttcatttaaacataaca

SEQ ID NO: 586424 - DNA, 1124 bp, Homo sapiens
gccttgcctcccgcacgccccgcaggtagcgcccccgcccgcggcccagagtgctgctcgctgcctgtgcaccatgctccctgtgattaaactgtgctgctgccgctgcgggaggatgacatgcctgaggcagatgaatggctgacctgagagctggggcgcatgtctggctgccgctgcccatggagggagtggacatcagccccaaacaggacgaaggcgtgctgaaggtcactcaagcagagatggtgcacatggtacaggagatgcccatgatttggggaccgagtctttgtccactacacttggctggctattagatggcacaaagtttggactccgaggtctggatctgcaaggacaaattctcctttgaccttgggacaaaggcggaggtcatcaagggcttgggaccattttgccatagccaccattgaatggtggcgcggaggtgtgccacaatcaacctgcaaaccagaatatgcctacgtgttcagcaggcagtccttccacaagattccccccaatgccacgcttgtattcgaggtggagttggtaggacgtaaaacgggagaagatctgacgggaaagagtgaataattggcggaatcatacgcagacataagacctcgaggataaaggctatgcaaagccaatgagggtgtatcgtggaagggtggcatggaaggtactacaaaggaaagaccattggacaggcggaagatcacgtatgagattgggagggggaaaacatggatcatgaatatggtatggaaggggctataatggattgaacaaggacagagatcaatgtgtaccaaggccggttatattggagaggtgggaagaaaagtcaactacacaagggataacgtaattgaatagaacgacgattggaaaacagaggattgagggagaatagaaagaaaaagaaagggatccagatgaggagggcgatgaaaaaagggagggaaagaagagcttagatcagaacttttgtggaaagagatataagaaagaagaaacgatacgaaaactaagggagagaaagaaatgtgaaataggcagagagagaggcgtgacagtaagactataacgaggtgtagatgggatttgtagtagtt

SEQ ID NO: 586425 - DNA, 173 bp, Homo sapiens
tgtggtctggcagccacaccacagccggccacccacagataccatcttggtgatggggctcccctgtggtgcccaaggatcactgattgtgaaggttctgggggtcccgagaaatggcctgcttcccttaggatagaccacaagctctccataggccagaaccacaaatatcg

SEQ ID NO: 586426 - DNA, 246 bp, Homo sapiens
gaacgcccaccaacactggggaacgcccaccatctctcctcaaaatgaaaaacattttaaaatattcattttacagaagataaaattgcttctctttatggcataacttcattatgtgcttctattgtcaagaacacacgaggtcacttgaggctcaacaagaaagaagaaattgaaatcatggcattttccccatagaacttttccaggatagaaactattatgcaaggtcccagtgttggtggg

SEQ ID NO: 586427 - DNA, 242 bp, Homo sapiens
ctcaagccgagatcgagcagaactgaacggtgtcaaagatgcgctgcgtgcccaactgggtgctctggccgtcggcggtgctgagaagatcctgggtgccacaatcgatcaaaacgcgcacgcgtgagctgtgtaaacaaactgtgctgcgtgaaatttaacgcgagtgtgcgatcatgtgcagaattgaccactgttggccccgacccttacgcctaaggcagccttcgtggcactgccca

SEQ ID NO: 586428 - DNA, 1153 bp, Homo sapiens
atgcagccttttccagttaaccaaagactataattcgtgaaattgggtggtattccaattgtttgcaaacaaaatcaaccaattcccaacccagaagtattacaagcaggaaacgcttttaaatgcactaaaataacctgagtgtgaatgtcgaaacatccaatcaagatacacgatatacatcagtcaagtatgtgaggatgtcttctctgtgttcctctgaactctgctgtgcagctggctggactgacattgttgacaaacatgactgttaccaatgaccaccagcaacatgcttcaccagttacatttacagacctgttccaggtgttacttactggacacatggaaacacgaaaggtgcaagttttgaaaactgcttttgaactctggtctgaatatccagcccatgaaccggaagggaacttactacggtgccccaagtggatttcatcaattcccttttacccttttattgcacaggcaacgataggccacacagggacgcatctctacttcgcagatacttcacggctatatacacgaagtaatagcagaactgcgctcacaaatacgaagggccatttaagcctcgtgcaagccctacctataccactggaacggtacacagggtcataaaccctgataacacttggacgcacgcactgttgcccagaaacatcacgaagcttatacacgcaggatccaccaatgattgcacacggatgacacgcgtcatacaacgtctgttgaccccctcaattaacaccacacagtcctgccattcgcgcctcattcttcccccacagacgttcactgcagctcctggacttcttaccacgatgatcacacccagacttaccttaattacacgggcaattctaccccagcatgcatcatgatgtcaaaaccaccgttacacgcccttacacacatattcagctgccctttcaacgctcaccactatatacccttatgcctgatagggatatcaccacaacactatgatatactgggaacccaaatacacatgccagcccacactacgatgaccattttaccaacatcttggtaacgctgtagtcacagcattcataacctcgaaaatatggcgaatagccgacgacttgcatattgataaattatcccacac

SEQ ID NO: 586429 - DNA, 1843 bp, Homo sapiens
  misc_feature (406)..(406): n is a, c, g, or t
  misc_feature (446)..(446): n is a, c, g, or t
  misc_feature (478)..(478): n is a, c, g, or t
  misc_feature (973)..(973): n is a, c, g, or t
  misc_feature (1071)..(1071): n is a, c, g, or t
  misc_feature (1195)..(1195): n is a, c, g, or t
  misc_feature (1228)..(1228): n is a, c, g, or t
  misc_feature (1296)..(1296): n is a, c, g, or t
  misc_feature (1299)..(1299): n is a, c, g, or t
  misc_feature (1306)..(1306): n is a, c, g, or t
  misc_feature (1308)..(1308): n is a, c, g, or t
  misc_feature (1314)..(1314): n is a, c, g, or t
tcgttatcgtgcttgcggaagacgatagggcgtccttgtgagtgatagtgacgatttcggtgctaccagtgcaatggagaatccaggcattggcaatgcgcctccagattggggatagtccccttgtgagttccggttccccccgagtacccgaagcctgggcaggttgtgacgatttggtcgtgcagaaatcttggggcaacccacaagcccccttttcgacctggtgtggaaggctcagaacacttgggcttcgtggaacaacctggctgtacggttttcaaccactccccttgggaagaatggccatgcgcaaacttggtgcgctcagtggactgtggttgaggacatcgaggatgaggatggagattacctgctccatcacccccgcgggtgccaactgcancagctcgggggacccccctgagtacaacctgcgctcgcgncaccgtgctgtgcgggacctgcgggcagcctnccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttcccggcttccaggaaactccacatntggccttaaaaaccaaagaagggcttcctctaagaaagccagagggaaaggggtgctttttatcagaaggctaagcttctggcttttctggccctggntgctggcccccaaccccgggggaccctggtgacatgggtgcctggagaggcaggcatagaggcttctccggccaagcctccttctgggcagggcaggcctcaactggccaaggccaagcctccngagaagggagaagagagagagagaggacagctngagccggggcccctgggcgctgggcctggtggtagattcccaactaacacctgggctgaggtccctcnggnctggccncnggcccnaaaagccgccagacaccgtggcacccgagagccgcagggggctagatgccaattcatccccaggggtacccaagagaggacgcagaggcaataacagagaaataccacattacacgaccaaagcacatggggcgaaacctgaacggtacgagcaacgagtagaggcaacacgacagagggccacccacagcacacaggagagacacgccagacaagacgggccccatagccgcacatacccctagtgaagcacaccacagtgagatcggaacgacactcggccaccacagcacacagcgggacaaggtataagaacacagccacaaaagaagtgggacaaactagccagtgagaagaacaaaccacaggcccaacacaggccaaagtacaccacacggcggcacaaaaagggacagagcgaagacacaggaggaggacacacccaaacgccgggtagcaaacgcacagacaaaacgggccacacaacgggcaggatctacaaccagaagatgaggacacaaaggagaaa

SEQ ID NO: 586430 - DNA, 119 bp, Homo sapiens
  misc_feature (73)..(73): n is a, c, g, or t
ctgggagggggtgatctaaaacactgcttctcacgccggcttctattgacttgggttaatcgtgtgaccgcgngtggcatggcacgataattggaccagacccgtaggggttagtatag

SEQ ID NO: 586431 - DNA, 1651 bp, Homo sapiens
  misc_feature (406)..(406): n is a, c, g, or t
  misc_feature (446)..(446): n is a, c, g, or t
  misc_feature (478)..(478): n is a, c, g, or t
  misc_feature (973)..(973): n is a, c, g, or t
  misc_feature (1071)..(1071): n is a, c, g, or t
  misc_feature (1195)..(1195): n is a, c, g, or t
  misc_feature (1228)..(1228): n is a, c, g, or t
  misc_feature (1389)..(1389): n is a, c, g, or t
  misc_feature (1408)..(1408): n is a, c, g, or t
  misc_feature (1487)..(1487): n is a, c, g, or t
  misc_feature (1646)..(1646): n is a, c, g, or t
tcgttatcgtgcttgcggaagacgatagggcgtccttgtgagtgatagtgacgatttcggtgctaccagtgcaatggagaatccaggcattggcaatgcgcctccagattggggatagtccccttgtgagttccggttccccccgagtacccgaagcctgggcaggttgtgacgatttggtcgtgcagaaatcttggggcaacccacaagcccccttttcgacctggtgtggaaggctcagaacacttgggcttcgtggaacaacctggctgtacggttttcaaccactccccttgggaagaatggccatgcgcaaacttggtgcgctcagtggactgtggttgaggacatcgaggatgaggatggagattacctgctccatcacccccgcgggtgccaactgcancagctcgggggacccccctgagtacaacctgcgctcgcgncaccgtgctgtgcgggacctgcgggcagcctnccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttcccggcttccaggaaactccacatntggccttaaaaaccaaagaagggcttcctctaagaaagccagagggaaaggggtgctttttatcagaaggctaagcttctggcttttctggccctggntgctggcccccaaccccgggggaccctggtgacatgggtgcctggagaggcaggcatagaggcttctccggccaagcctccttctgggcagggcaggcctcaactggccaaggccaagcctccngagaagggagaagagagagagagaggacagctngagccggggcccctgggcgctgggcctggtggtagattcccaactaacacctgggctgaggtccccccgcccgccccgcccccagcccccacccccgcccccagccccggggtgagcccatccccccaggtacccacggcgcttgcttttctgtattttanttagacaagagatgggaangaggtgggaggtggaagaagggagaagaaaggtgagtttgagctgccccccctagcttaagaccctgggggggctctgngcagtcactggagggggaagccaaggggggggcggggaggagggagagggaggtcactggaaaggggagagccggctggcacccaccggggaggaggaaggcaagaggggggggaggggtgtggcagtggttttggcaaacgctaaagagcccttgccncccca

SEQ ID NO: 586432 - DNA, 234 bp, Homo sapiens
  misc_feature (46)..(46): n is a, c, g, or t
  misc_feature (73)..(73): n is a, c, g, or t
  misc_feature (78)..(78): n is a, c, g, or t
taagatggagttttactcttgttgcccaggctagactccatctcanaaaaaaaaaaaagaaagaaagaaaganaaagnaaatagcggcccaacgcctcttcgtttccggattaaaaacaaacaaacaaacctttaagatggagttttactcttgttgcccaggctagagcgcaatggcacgacctcagctcactgcactccagcctgggcagcagagctagactccatctcaga

SEQ ID NO: 586433 - DNA, 455 bp, Homo sapiens
gccctcaatcctatcacagctcgactgacttttcccattcagctgtgagtgtccaaccctatcccagagaccttgatgcttggtctcccaatcttgcgctaggatgacccagatgccaatgcagatagctccttcttactagccagggtatctggcctgagacaagcaaggggtccctcagtgctggcaatgggagtctgagaactcctcattccgcgactcttagaccccgactcttcattcagtggaccccattttccttaggacagagatgagcattccccgtcagaaatgccagatctctgattccccaaatcggcatccttttcataacctaaaaacgcatcgatatacaaatcataacaaaaccaacgtcagaccagaactgtgttctcaacctgggacattcctagacttccaaaatgtgcctcttccagcaactgaaactcgccctc

SEQ ID NO: 586434 - DNA, 547 bp, Homo sapiens
aggaattcggcacgagaagaacttaaattttatcaggaactgtaagataaatatctagggcttataaattttctggccttaaatttatgtgacagggcaagatactttggctcttttcatttaatataggcatctgccatggacattaataaaacttagaaacagtataattagtataacatttactctgaattggaagatttcctgaaacaaagtttggacaagaagcccaccttggaattctgaagggctattttcttgttggataagcttttcttttaaacttaggtttaaaggtggggaaagacttaattaactaaaatagtattttctaaggggggacatctaataccacgaaacgttaatttggacagttctactgagcccggaaaggataaccactggcaaattttgtcagaataaaaatttttcactgcaagaaaaaatttcaggagaaaaaaaagggatgcgggggccaggtacaaatagtcccttaagagagggtaaatgattagcccaaggtttgggaccatgggaaaatactttt

SEQ ID NO: 586435 - DNA, 383 bp, Homo sapiens
  misc_feature (289)..(290): n is a, c, g, or t
ctctcctctcaaaatgactcttgcggtggtttctcttgtttctctttttaccttcctagcagctcctccagcttccccactatctcccactcatgcaatgtggcctcaacccctctctggctctgtcctgggcactttgtcccatccacagatccacagctccagacacacataaccaacttcctggtaacggctccagcgcctatcacccctgacttggggttagagggcaggacagaggctcagggtgtgctctcgtgctccccgctctgtcctccccgcagagtcnnatcccccaacgaaagtcggtgcttcccacggcgacaggagaaagtccccactccgagggcggcagagggctgcgaggagggacgggacgaagc

SEQ ID NO: 586436 - DNA, 430 bp, Homo sapiens
  misc_feature (4)..(4): n is a, c, g, or t
gttnctagaggatcccccaaacgcagagaggaccaaacccaaacacctacaaacccttagtgattaagcatcactgaagagattgatcctgcgtggttccgacgcttgttacctttgaagactgtgcttcttccaaacggttaggcgtcatggtctagagcatccaagaggaattgtggatcgccgagtgaccgagtctgtgaaggtttggaagtcgcctgaagacttaccacgagtgattggacgaggtctatgtgaccttagttcaaggagtatacggtgaggactgtgtgtcctgagctgcgtgctcagcaactgggtgtacgggactttgtgtcctcgagtttaaatactcagccgctccaaccagacgtacaactgagacaacaggtggaactggtctaacaaatcattgtcttcaccaacctta

SEQ ID NO: 586437 - DNA, 361 bp, Homo sapiens
aaaaaaaaaaaacccccatttttttcaggggggtgggctggtttttttgggggccccaaaccaacccgtttttcccccggtacccaaggggctggtttttccccccccagggggcccttaattttgctgggggtccccccaaatgggggggcccccctgggaaacctaacccccccaaagggtttttgtttttttaaaaccggccctttttaagggcccccttcccccccaaaaaatttttacctttttccgggggttacccctggttccgggacccggccggttgttttcccggcccaaggtttttttttttttttggggttttttaaattccctggttttattaattccccccaaggga

SEQ ID NO: 586438 - DNA, 182 bp, Homo sapiens
tggggggctttccacattttcagcccctcaggctggaggaccggggccacactctggagcctcggtgaagtggctgggcatgagccgtttctctgacgtcccccatagatctgggtcatggagccaaccccagcgccaccccggaggtacaggtgccgcgctggtggaaagcaggctcgcgt

SEQ ID NO: 586439 - DNA, 402 bp, Homo sapiens
cttttcaagttcccacattaagacattgatcagatgtgaatagttaaatacgaatcggcacttcttcaaatatgtactcaaaggtgattatttgcttttttcaactgcttcagtgagacacatcctttactatacaaacttccatcagtttaggagtcagtctgtatgccttaaatgagagagatccaagggcagattagatgggaacataaatgagaacgacagattcttcaatggcctgctggtaactaaactgagagtccaggagtgcccggataccgaatgagccatagtatgtggacagataccagcccatgtgaagatgatcaatgtatacatggcgaaggctccgaatcatttccatctgatataggactacatcaaattcagaatcatcctctg

SEQ ID NO: 586440 - DNA, 433 bp, Homo sapiens
cggggtcccggacagccgcgcgctgagggtctcggggcggtgcgccgcgggacctctccgggcccatggcagcccctgtcaaagggaacaggaagcagtccacgagagggtgacgccctagacccacctgcatcccccagacctgctggcaacgcagaacggaatccagaaccccatctcgctggaggactcccccgaggcaggcgggggcagcgggaggaggagcaggagcgggaggaggagcactgccttcctggtcattgactctacaagttcatgaagtgagcgacacatgcccatcgcagcagggtgccccatctcggcttcatgcacgattaacctgtggaatatctacaaagcagttggagaagctggtggcctatgagctggtgaccgggcgccgcctctggaagaacgtgtacgacgagctggg

SEQ ID NO: 586441 - DNA, 466 bp, Homo sapiens
  misc_feature (109)..(109): n is a, c, g, or t
  misc_feature (209)..(209): n is a, c, g, or t
cattggttttaaaaaatgtggttcccctgtgccccaggaacaatcaggtggttatcactttaaaaattaatttagaaatgaaaaatttttttggaatcccccccccccnccccccaaaactaatgagcagaacttttaggatagggcccacaaaccctgttgtataaaccctttcagccaggtgcagtggcccacaaccttgggaatcnagcactttgggaggccaacacaaggtggatcaccctgagtcaggagttcgagaccagctctggccaacatggcaaaaccctgtctctactttaaaaatataaaaaattagccaggcatggtgtcgggctcctgtaatcccagctacttgggaggctgaggcaggagaatcacttgaatccaggaggtggaggttgcagtgagccaagatcgcaccattgcactccagcctgggcaacaagaacgaaactctgtctca

SEQ ID NO: 586442 - DNA, 250 bp, Homo sapiens
cgggtcaggaactgggcgcggtgtggtgcgcaccatgccgggcctggaagagaacgtggcgttcccgttgcccaaggggctgtcgcgcaaggtggcgcagaccgaatcgctggaataggcgcggccccgccgcgggcgccgccaagaacaagaatcgaggagacttcatgcagttgtacagctatttccgcagttcggccgcctatcgcgtgcgcatcgccctgaacctgaagggcctgccgtacgaata

SEQ ID NO: 586443 - DNA, 339 bp, Homo sapiens
ctggctggggaatacaggatgacaagtgaagtgagaaggatgtgtctacctcacagacatccattgacaatacacatattctcctcacaaccggaagagtgcccctttgctttagtgagtgcagactcggcactcacacttgtgatgaacccaaatgcccacaccagcttccaaatctccctaagtgtcagttacacaagggagccgctctgcctccaacatggcgatcgttgatgtgaagatggtctctggcttcattcccctgaagccaacagtgaacatgcttgaaagatctacccatgtgagccggacagaagtcagaagccttcagataaaatg

SEQ ID NO: 586444 - DNA, 1278 bp, Homo sapiens
  misc_feature (1248)..(1248): n is a, c, g, or t
tatatggggcttgggtgagggaggtaggtgggtagttgggtgtttaattattttataggtgggggtgagtgaggaataggtggtaaggagtagtgggggttaattagtgggtgggccatacggatagatattatagtgggggcatttgtctatattcttttgggcaataagcacttatgttcccgtggaatagtggtccaaatttcaaaggagggtggttaaataaccttgtagttaacactaaatattatgtgggtgcgcaattataagtggactggtgagagaggacataagggtcatatagcgggaacttataagataaaactaattaatagtgggggtgggttttccgttcagagtcagcgtggagtggcgataatctaagacatagagtggagcgctcttgtagaagagccatttttctataagtgtgtggcgagaaaccttattaaagagatataccaaagtgtgtcaaactacaggtgggtaagataattaaactcgcacagagtgtctaagtgttgaagttgaaagcgccttttcctcttgtgaggagtggttggcataaacatgtgtggggaggaccaggggaccattacaagtgggaaggccatagttgaaagctatttagcgacagtgatggcaagcaaatatatttgtaaaggattagatacgttcctgtgacgatatataaggggggttagagaagaccaaaactttattttttgtgggaaaaaccacacaaggatgggggccatattgtcacacgaagcacgagttaagagaaagcaccgccggggagtacctaaaacggttgggggggagacgttagccaatccgatggatatagtctgggaacataaggaacagcgagtcggttcatgtataaacgacacagaacgacacctacaagggggtaataaagtaaccagtagataattggtatgagacaggcccaggcagaaacaactcggatggcgtggcaaggatatcgcacgttccgcccacaccagaagaagctccagaaaacaaactagggcgacagtaagggggacagaaaagacgaaaataaacgaaagcatagtcgaaggtatgtaatatgccacaccacgccgtcgtaagacagccccagagctgggcgatcttatgggggggagcgcgtgaccaaaacagcggacgacgcacaaacggctagtggagcacacacaagggtgggcctcatgaatacacacaacgagggcaagcagnctatctgaaagcatcattcaagacagcgag

SEQ ID NO: 586445 - DNA, 321 bp, Homo sapiens
caggtcttgtgtcccctgcacctggaggaaagcaggctaaaggcacagcggccacatggtgctggctttaaacgttggttggtgggtggaaaacagccctgcttttaagggccgctcagttttggacacgaaaccccctcctgaggggtcagctttgcccccgccctggggtgcagcctttggaagcaagcaccaggcatcctttgtgttggcaactccggggaaccagtaactacagccatttacaattgaccccgtttccttttgtaggtttccctgttggtgggtgttaggagaaaaataaaatcctatgaaatttga

SEQ ID NO: 586446 - DNA, 348 bp, Homo sapiens
  misc_feature (38)..(38): n is a, c, g, or t
cacacccacccgtaaattgttgaggtcacggccagagnctcaatggtctccatgtccaggtggtttgtgggtcatccagaatgtagaagttggggcaggcatagtcatctgagccaaggccactcggctcttcttgcccccaagacagcctggcagagggacgcatgcccagttctccggagatgccataccgaccccagctggtgacgggtctcctccttcaggccgccaggaaactttgcgttccacccggttcccacaggcactgacgtttaagggtccaggctgctccaccatggtgctgggcttgaaaatagcccaatcttcaagtttccctgcaggcaggaa

SEQ ID NO: 586447 - DNA, 121 bp, Homo sapiens
gtcccgggggggggggggggggtaccccccccttcccgggggctgtccctgtgggcccccaaaaggcaaaatttaaataaggggaataagggcccaaaaaaccccgtttttttccggggga

SEQ ID NO: 586448 - DNA, 275 bp, Homo sapiens
tactttatccacaggcagagtctggggaaggagggggagagagagaggagggttcctaatagtacggtgagaaacttaaaaagacactaaactttctctgcttccctacgctggccttaaagcgcaggtaattccactgctctgctcttcacatttcaaacaacctttaccatatgcatactaggatgaacgccataacacattaccactgaacttgactaaaaacaacattgacgcacggcgcccaacttactacaaatcgactgcgacacaca

SEQ ID NO: 586449 - DNA, 1564 bp, Homo sapiens
gaggagaagaaaaggagaactaagaagaaaggacaagaaggagaagaaagaagaactaagaagaaggagagcgaacgaactcaacgaacgcgaaccgcaacaacacgcaacaaaagctaaaacgcaacgaacgcaacgcaacgcgaacgaagcgaacagcaacgcagcgaacgaactcaagcaacgcaacgaacacgagcgagcgaaagcaacgcaacacgaacgcaactaacggaaccacagaaacggacgacaccgacacacgaactaccgacacgaccggacacgacacgacacacacacgacacaacgacacggacacacgacacggacgacaccacacggacaccgacaacaacacgcgacacgacacgaccacgtacgacaaacgcggacacgacacacgacaccccgacaccgtactacacgaaccgagacacgacacagacaccgacacacgacacaggacaaacgacgcgacaccgacaacacacaccgacacaccgacgggacaaacgacacgacaaccgggaacaccacaccgggaagggacgaacacgaaaccaaacggacgaaacgaaacacgacaagaaacttaaggacacggacgacacgaacacgggaccgaccgacacgaaacgaccgaagcaaaagacaaatcagacaccgacacgaacaacaccaacgggacaccaccacgacgacacgggcaccgaccccgacgcgacacgaaacgacaccctacacgaacacgacacgggatgacaccacacgacgacccgtgaccgggacgcaccgcgcccccacccggaccgaacccatatgacccgcgacgacagacacccgcactgaacccgacacgacagcgaacgacaccaagaccccagcgaggaaagaaccagcgacacgaacgggaggcaagcgacacgcatacggacgggcacgaaccgtgacgacccgaccaccctgaaccgacgcaccggaccgtctcgaacacgaaacaagccgacggatggaccgccacaagggaacaggaaagcgagcgaaagacagcgaaacagacagaccacgacagacacgcggagaagacactaaagcaacgacatccagtgaccaatggcacaacgaaagcaccgacgcgacggggacaggaacccaagaaggacgcaagacgggcacaacgcacctaacaggcacacaagaaagggcaaatgacgcaagacaaggatatggaccgtaaaacgaaaagcaagggaaacaagccaaccacaagacgaggacacacgaagacataccccgcaaggagaccacaataaaaacagatacccagcaatatgggaacaaagggatccctatacgagccaaaaatatataacaactgcgtagcagtttgaaggatacatctgaacacagtcgatagacaccagtacagaacaaccttgttttcacatatcgacacactaaactgtaaatcgccaatataattagtttactggcacgcaaatatcacactgtgcacaaagaatcaacacacataatcaatctgtaaactaatactaactcg

SEQ ID NO: 586450 - DNA, 222 bp, Homo sapiens
  misc_feature (103)..(103): n is a, c, g, or t
ggggggccccctccccccaaaattaggcccggggaggttttttttttttataaaaaaaaaattttttcccccgcccgggttgggcgccccctccttttttttnccccccccccccccccccgggggggggggtaaaaaaaaaaacccccccccttttttttgggggggggggtttttacccccccctttgaccccccccggaaggttttttgggtacaaaaa

SEQ ID NO: 586451 - DNA, 96 bp, Homo sapiens
cctcacagactggccggtgaagttgaggctgcagcgagccatgattgcacctacttgcactccagacctgggcaagactgagcaagactctgtctc

SEQ ID NO: 586452 - DNA, 385 bp, Homo sapiens
  misc_feature (8)..(8): n is a, c, g, or t
  misc_feature (63)..(63): n is a, c, g, or t
  misc_feature (375)..(375): n is a, c, g, or t
tcttctgntgtgtctgaagacagctacggtgtacttacatataataaataaataaatctttanaaaaaataaaaaaataaaaataaaaacaatcaaaaacaaaaaagtgaaatcaaatttacctcttgggtatacaattttcagcaagtgggttactgtaaaaatattaggcactattcaattacataatagaaccaaattaatactgtcatattggagggtatttaatataaagcaagatttgctttctaattagttttaaatgaagtttataatttaatgagacaaaaatggaaatagtttaagtaataaatgtttaatcaaagaattttacatattaacagcattcatttggccaaacatctacaggtctgnaggaatccta

SEQ ID NO: 586453 - DNA, 289 bp, Homo sapiens
cgtccatatagaatccacttgtcaaaatgagttgctgtagaggtatgaatttgtttctgggttctctattctgttccattagtctatgtatctgtttttaaaaccagagtaccatgctgtttggtacagtaccattactgtagctttgtagtataacttgaagtcggataatgtaattggtctagttttcttcttttggcttaggttagctttggctatggtgtgtcttgtgtggttttatataaattttaggattgttttctctctgtgaaggaatgtctaataggga

SEQ ID NO: 586454 - DNA, 833 bp, Homo sapiens
catattgcacaatccattcaactactatgagacggttctggagtgacactgttgagaagaggaagttccctcggagctccgggagcgagccatttgatctgccatattggactcctccagctgtgcggattcgcgtgcactataagaaacacatttctacgaccactttaaagctccactcattaccggtttgtgctggagagagatggataaaaagctgtatggctaccccaggctttcattttgagacagcaagagtacccagcactatgacggacgtaactagtggcgagcaagatcgtgtggcttctctctttgatagatcttctgtagctgaacagaatggaacttgtgtttttatgacatttttcaatttttctgggcagtcactgactcatatcattaccaacatcattttctctcacctgaggctaagagattttactttatgccatatcttaatacttcacccgttacaaaagattttccacctcttacattgggcagcttctaatattaggacatgcaatgcctgtgggttcgcaagccgtgtaaatggaacatgggagcaggagtatcatatgatccaatgcatggtgtattgtgtggcctattggtggtggtgttgtgaccagaatgatctagtgtctagtggttaacactataccctcgaagaaaggtcacttttgccctattcatttatggtcttttggctctcatgtggtgactgaacatttctggagattaatcagcgtcagggaataacaaatgtccgcgtttagggaaccatttccttcccgctctaaaatataaccttgttttcagggccacat

SEQ ID NO: 586455 - DNA, 125 bp, Homo sapiens
  misc_feature (42)..(42): n is a, c, g, or t
  misc_feature (109)..(109): n is a, c, g, or t
tcagagccttgagccgatgtatatatcgcagcgctatacgtnatccgcgcgaaatgaagaagtctttatgaacatccagctgtaaagaagcggttgtgatcggcgtccnggacgcttatcggggt

SEQ ID NO: 586456 - DNA, 147 bp, Homo sapiens
ccggtggggcagggtaagatatcacgtggatacatggtacggcagagcttctggcctcaatgatgcctcctgatcgatcgctgggctggacgaccaacactgggatgacgatagagcagcatggtcatgagtgatgcccatgaatca

SEQ ID NO: 586457 - DNA, 1478 bp, Homo sapiens
  misc_feature (1441)..(1441): n is a, c, g, or t
taaaacacagtcttgctcctgtcgcccaggctgggagtcgcaagggcactatctcggtctcactggcagcctctccacctctcccgggtttcaagtgtgattcctcctgtgcctcagccctccgtgagtatagcgtgggatctcacagggcgtgtgcgccaccacgccccgggctaattttgtggcacttttgggtaaaaagcgggaattttccaccagtgtgtgtggccgcaggcgtggtctctgtggaacactctcctgtgtcacctctcagagtataactccgcgtccccctctcggcctctcccaagagagtgtgcgtgggaatttcacgagggcgtgtgaacaccacactctctaagaatatagtgcctgtgtgcgtccccctctttatcttctcgagacagtgcgcacacacaaatgtgcgagagctgtgtctcacacccacaagaacagagagacttctcacagaagtcagtgtgtgcgacagagacgcgcagacatatctccgaacacggcccgagatgtgctgggccgctgtgggccacacatctcgagtgggggactgttgccccattactctctgtgtcacacgcaaaaagacactagtgcggggacgtttttccctgtgggagaagcgcgacaagcgctttctccaggcggggggtactaccgccggagagcacctgtggcgctctgctaccacacaaagcacgagtagtgccgccggcactgtggaggaacatccgctgttgggggcgctccccatcgacagagtagccacaagacgcggcgacaccaggcgggaacaacttccgttggggggcgccccccccaaaagacaaccgtagacggcgacagaacaagtcactaacagcaactcgttggcggaacaccctctgttgcaggaagtcggccgccacacaagcggcggcacaacagaagtccgagactgcccaacagacggcgggcgacgctgtcgaaccaaccagcaagcggccggccccgcccggcctaggttcgtcgcctcccccaaagaggccggcctcagtggcgtcggcgacagcgccaatgttggcgggcgcagagaacggacgccaccacaccagccggcgtgcaccacacaggacgggcgacatcacacccagcgagccggctagtatgcgtaggacaactcttctttcccaacgaacaaatcatgcgatgggggagaacaccaccccccctcaccaaagatggtggtgcagaacaagacggagggaggacggccgcacccaaaaaactcttttgatctgtggggcgagggggggggaacaccccccccccaccaaaacaagaacggctgtgcttgcgacgcttccggtcggacagacgacggctgggggggacagctcaactctaccaacaagaagaggagcggcggcccgcctgtctggatggntacaccacccatctgtttgtgtggtgggccggccccc

SEQ ID NO: 586458 - DNA, 341 bp, Homo sapiens
  misc_feature (86)..(86): n is a, c, g, or t
  misc_feature (133)..(133): n is a, c, g, or t
  misc_feature (193)..(193): n is a, c, g, or t
  misc_feature (293)..(293): n is a, c, g, or t
tgaggtctgaaaagctgcgtttctaacaagttctcaggtgatgctcatgctgctggtctccaggacaacaactcggaggacttctncttccaggagagtcttatgaaataccaaaatttgaaaaatcagccgntgaaggaagatgtgacagaaaagtcctgtccccagaaaactgtccttttggggcggcttnggagcaccctgtctgatctctttcaaaccacaacccagacaagtttggcaattgtggaaactgcctctgcttaggagggcaagggaccagaagcaagggngcttcccccttccacaaaatgttggccagcttttcaagtgctttggtg

SEQ ID NO: 586459 - DNA, 620 bp, Homo sapiens
gctcggtccggcggcggcggcggctgtagcggaggagacggtttcaggcctccggtgcggtgcaatgctgatctcccgggccgaggcggcgatgaccgtggccgacagggccatccatgcgcttccatgcgagaccagtgggcgggccgtcagatatcacgtcatgaagaacgtggggagatgataggtggaattagctgctgcgtcttgcagtcgagtgaatatatgtcatgagcgggtcccattagagcacatgaacgcaagcgtagcaaaagggcttgtgcctggtccttgttcatcttagcggaacaatctgcttcatgagctccctgttacaaggcctgtctgccatgtcctgctttcatcaggtggctggaagagttcacctcccagtactccagggatcaggaaggagcccccctcacaccagtatttatccttaacactcttgcaccttctgacaaggcttgtcctgccagagaagttactgatgatgaggtcttagatgcaagctgcttgttggatgtcttaagaatgtacagatggccagatctcatcatttgaagaacgggatgctcacgaattattcgcatgtcgattacctcgtcattggaagatga

SEQ ID NO: 586460 - DNA, 862 bp, Homo sapiens
accccttatctttgcggaatcaccactggcggactgggaccctgtacacgtactcctgacaaactggagggccttcaaggctctcatcgactgctcagatacagtcggggcctcaggtccgcgtgctctccgacaccacacccacattccactttgggccaaacccaaccgacaccccgtgaatttctccgccacatttcctgccggcaaggatcccagcattctgagggtgatgatggattctgtgtgtcagcgagccaacgccaattgcctactcatgtgcagcaatgcaggagctgcggggcaacgtcactccagcaggcagccagcccacaggtggtgccacagggctgagcatttgcatgattccgatcatagatgccccacagacagtacctgggatgtaaccccaccttgggcatcatgcacacaaccaggccactgagacatgcacaggaggacagtgcggcgcacattctgggcgctgctggcatgcctaccttgacacgaccaggagggacatcaacaggtggggagccgacaccgacgtcggacacatagggcactgacaatcacacagaacgtcatggcaccctggaaggtgggcccaactaaagacaggagcacacgaacgcctacaaagccgccacgggccctatccgcaaataccacacacggctgggtcgccatccacatgcacttaacgcaggcccagcgcacggggcggccaggggcgcacaagaccacatgcagtcacacaacgaagtgccaacacggaagccatacaccagtgcgcagcagacccaccccaacagcgccacacccacggaaagaacagggcgccaaggacaacacgcaaaac

SEQ ID NO: 586461 - DNA, 204 bp, Homo sapiens
accctgtggagcttggccaccgaatccctctagtctccttcggtcggacgtgctctgtctttgctgatttctctgaccttgacgcttctgtgggcgtaggccttgcttgcagtgactgcccccacgctgcgtctgatgtcctcacaggcttcagctgtgtgcatctttggcctgggattatcactggagctaccacgatgtctg

SEQ ID NO: 586462 - DNA, 732 bp, Homo sapiens
  misc_feature (136)..(136): n is a, c, g, or t
agcggattcttttccgacaaaacaccaaatggcggatgacgccggtgcagcgggggggcccgggggccctggtgtgccctgagatgggagaaccgacggtggcttcctgcgtgaggtttcaggcaagtggcgatcncggggcgcgggagtcgcaggccggtggaacaggggacctggggcgcgaggccagcgcgagctctgcggaggctaaggccctgaggcataatggcagtggatgcctcgtccaccaagttcgggcctgcttggtcgaagggacattgaacgatccaaggttcccgtgggacggagattctactcatcgttgcgtccactgtcccgatgtaacggaaatcatgacgatcgactttgagtattcattcgctgagggtgccgtcctctcaataggattgaagagttgtctggaacgaattgaattgcacagatggccaggaaaggcgacgtatcccgccgtgactctgggcgcaaggcagcatcccgaaggttttcagaacggccactttctcgtttgtggctcattgcggagcgaggtagcgtgaaccataactggtggcaccaaaccggttacggaggtccgtaaggggaggtgctattagaccggtgggcctacccaaaagggggacggcgttggggacccaaccgcgccccaatccgcaggttgggcagcggacccaattttccatttcacattggggccgcaaaaggcgtccttcc

SEQ ID NO: 586463 - DNA, 179 bp, Homo sapiens
cccctttaccccttggctttggttttttccccccccgaagggggggggggattttttgaaagatttttaaacccaaaattttttttaaagggaaaaccccggggggggggggccaagcctctttttttttttaatcatgtttgggaaaaaaattgccccccctggggaggggctttcca

SEQ ID NO: 586464 - DNA, 866 bp, Homo sapiens
tatagttctctaaaccgtttatttctccccaccacaaaggtgggggtgggcgggcctaaaacacagccggtgcggcgggtccccggggtggagccagcgcaaacacgcgtgtggtcccttgcggtgcctcttaagcgcagaatggtgggacgtttgtctccacgcccacattgtggcctgctgttcatgtccgtacatacgttgattgtaagacccttgctgctggtggatggatggccggactcaccgcgggtggctcagctcccgcggcctggcctgccgctgcctgccagccccttccccgctgccccctctccgggagactctccggggggtacccctggtcccggggctagattcgccgcatgagcggctcggtgcccacgcattgtgctcggccactagacacgcctgtgccgtgttcgagaaggtgtgtttctttgcggccgccgggccagacctcttggcccagaatgttgggtgccacgtgcttggcaatagactgcgtggctcacatcggtgtatactggattagcgaagcccggccctggaaggcgcccataagaccatggggctccggggggaccacgtgttgccacccgcgcggatttgtaacctcagggggggcgagcggcgcctatcggacgagtagttaggcacttatggaagcaccaaagacctgtggctttgggcgataaaatccaccccggaaaaaattggaaaacaccaggctcagtggagcaaccggagaatggctggcggttagaccacagataggacgtgtacccaccaacttgcaacatcacgcggcgacttgaaaaggcaaaagcggacccaatgaaaacccggcacaaaggagcccagac

SEQ ID NO: 586465 - DNA, 454 bp, Homo sapiens
  misc_feature (381)..(381): n is a, c, g, or t
  misc_feature (383)..(383): n is a, c, g, or t
  misc_feature (390)..(390): n is a, c, g, or t
  misc_feature (392)..(392): n is a, c, g, or t
  misc_feature (400)..(400): n is a, c, g, or t
  misc_feature (402)..(402): n is a, c, g, or t
  misc_feature (404)..(404): n is a, c, g, or t
ctacccgcggatcgatccagatcggccattcagcgggcagccctaccggggtgataccgccgtattccatcccggacatgccaacagtcacttgggcctgtgttatccctgatccaatgcacaccgcttcagcctcggctacccgcggatcgatccagatcggccattcagcgggcagccctaccggggtgataccgccgtattccatcccggacatgccaacagcctcatctatcggcgcgaaggatgctttacggacgtcgagctttttgcgcactactttgttgacgtcgacccttgtcgtcgccaaaaccagacatgcaacatacttttcgatgtcaccacgcttcccctgacgatgacgcagttggcgcaggtctncnggccctnancgaacgcntngnacaggcctcggtagataacacaggcccaagatgaggggatcctctagagt

SEQ ID NO: 586466 - DNA, 190 bp, Homo sapiens
tgctgggattacaggcatgagccagacctcatgagaactatcacaaggacagcaacaaggggatggtactaaaactttcttgagaaagccaccccatcatccaatcacctcccactaggctccacctccaatactggagattactacaattccacctgagacttcaaagggaaaggacaaatatacaagc

SEQ ID NO: 586467 - DNA, 895 bp, Homo sapiens
attggatacataggtatggtctagagctatgatatcaagtggtttcctagggtttatcgtgtgagcacaccatatattgtacaagtaggaatagacgtaaggcacgacgagcatatttcaccgtcctgcttgccaatgaatcatccgcatatccccaaccggcggtcaaaagtatttagcctgactcgccacacttctcacggaagcaaatatgaaatgatctgctgcgagtgggtctgcagcccgtaggattcatcatttcttttcacccgtaaggtggcctggactggcgatcgtatgagcaaactccatcgacgtagacatcgtactacacgacacgtacatactgttgtagctcacttgccacctatgtcctatgaataggagctgtattgggcatcagtaggaggcttcattcactgattgtgcccctatgctcaggctacagcctagacaaacctacgccaaaatccatttcactatcatatttcatcggcgtaaatctaactttctttccagaaagctttctcggctatacggaatgccccgaccgtgactcggactagcccgatgcatacagcagatgaaaagatcctatcatgctgtaggtcatgcattttctctaacgagagtgaatagttaactgaattttcatgagttgagaagctttcgctttgaagggaaaagtcctaatagtagaagaaccttcataaactggagtggtatttggtggcggcagcctaaaggttgagaaccgggtttaattggaaaaaagggggtttatcccccagtgtgttaacccaggcgcggtttctaaaacaaaggaaaaaagatgacgagacaacataaaattggggggcaaaaaatgcggggaaaaagagtaggtatggtaaag

SEQ ID NO: 586468 - DNA, 173 bp, Homo sapiens
  misc_feature (16)..(16): n is a, c, g, or t
atcagtgtgcgctcanctgtcggaaagcatcagccactctgggtgcggccggccgcattcttgcagaacgcggtgtggatggcattacgggtaatccggaaatcatggcgcgccgtgtggaggaatccatcggtctggccacagcgcttaatccgctgatcggctattatgcg

SEQ ID NO: 586469 - DNA, 931 bp, Homo sapiens
gctcttcccttgcgctagcgcagccttggctcgtggtcccaacagagcgtctgaagcgcggtggcagttccaatggcattggatgctgggataaattggatcaggtgtggtacgcgtccgtcgtccgatccgacgcggtcccctacaacggtgagaagcgtgtctcctccctcgatcattttctcatgagagaacagactgtaagtatgcgcctgacagtgagactgagacgtaataggaacgactttgcactgtcacgcgggtgtcacttaacacaatctgactggcgaacggctccggacagctggtatatatagcgctgagccctgtcgtggaagtgtcatgggtagtgctcatcagacacttgagcagagagcgggaggagatttgccagtctgttctagtgacaccgaagggtctgcttatgcgtcgttacaatcagtaattaacaacacgtgggagaggagtgccaacgcttaccaagttcgtcgcaagagctgagcaatagatcttgcgtgggcacaaagatagggaattccttcatctggtgtagtctatgatgcccgggaccgatccgttaccccgatcccctcatcaccgtgaatgataccattcagattgatctcagagactgctcaacgattactgaatttcatcacagttcgactactggttaacctgctgtatggtgactggaggtgctaatctaggaacgacttggtggtgatcaccaacagagagaggctgcctggggatccttatgaacgtggtgtcacgtgcacagatgccaaggcaacaggtttgcactcgactttccaacatttttgttatggcaaggcaacaaccactgattctcttcccggagaaaggtatccgcctaccattgtgagagaagacaaaaactgcggcaacaagcatggtgcactggtcc

SEQ ID NO: 586470 - DNA, 203 bp, Homo sapiens
taatggtatctcgagtgctagaaggaaaaagggcacataacagaaatccaaatacaaatgaccattcccacgaacttctggcaaaccaacatcaaagaggaatacaaccatcttggtttcaaaaaagggtgtcttttccagagcactaaataagctttctgaagccagtaccaaacctagattggtaacaaatctaccggggg

SEQ ID NO: 586471 - DNA, 523 bp, Homo sapiens
tctcccctccccccctttacattcccctgcggaggggttccccggggcaggggcagagcgggtctcaccccgcggggtctcccggagcccaggccgccgctatggagagagggagcccctcgcaaacaccgggctcgagcggcaggaggcactcagaacagggggtgcaacatggaacataaatccgcatgaccgacacaagatggcagaagccgtgcgctcccagatcgagagcgcacagatgtcaccggagactcaggagcacccccacgaatcgcggattctccccacgtgcatccttccgcttccactacagcgtcagggaccagacgactcgtatcgagcggcgtgcgtaccagccgacaacctagcggaggacggccactgatgaaagactgagcaagggctggaacacgggggcccccaccggggaattcacgcccagagggtacaaccaagatgtggaaaagggactgaaccaggagctcacgacccgaggagccaggcacggtataccagtgtc

SEQ ID NO: 586472 - DNA, 696 bp, Homo sapiens
cccttgttttaagggggagtagatgttactggaacccccactccgtttgctcgcatctaatccctcactgggagtcacatagtgaattacggttcgcccttaatccgtctccaccatcggcgcttcttcggctcctttggcagaccactgagctatgtaatatctgaacgagtaagctttatcgggcccataccactggatggaaggatggagaccccaggagatcctgtgtgcgacgaatcccatcagcagactcgggcatattgtcacagcgacctcgggcttccggtaacaaccattgacctcctggcgtgtacccagcacagcacacacgcttgagactgtttctcccgacccaaaccaccacgtgtgccccgaaccagaagcgggacccggcttgtgccggcctaccaggatgtcgtagcaaacgaggatctaactgccctatgctcgcttaccctcgtgtagcaaaactcaccatccgctatctgcgaggtactttgagaatgcctggatagaaccaccagtacccgagaccactggacactctccatgatactcggcaaaccagtggcgtcggactcgagtcccccggttttggaagagtggtgagcccttgaggtccccgtaacgacacatcaatgtgcgctatgtgtttgccgaatgtaactcaactccaatgaacaaaaatacaaa

SEQ ID NO: 586473 - DNA, 308 bp, Homo sapiens
ttataacctaatcgccttacgagcatggaccctaaggagccagatgtacgggaatttcaatggcttcgagcaactagcagtgtgtcaggtgtcaactgccacggaaaagactctgaaaaaaattgcagactggcggtcacgagcagccaagtctgaagagatgtgtggactagtgatgggactgttcactcggctctccaattgtgccaacaggacaattctttctgacatgtactcctatgtttgggatatcaagagtatcatgtctatggtgacctcttctgtccagcgattagggtatagtgggt

SEQ ID NO: 586474 - DNA, 255 bp, Homo sapiens
cccgggttgtttcaggctcctggggtcaggtggtccccctgcctttggttccaaaggccccggcccagttgtggctttttccctttcccccatggccccccaggggtttttttcccttttttggattggctttcgtaaattggtttttttggtgggcaagttcttttagttgggaactttaaattccccctgaaatgttttttcctcccgtttccttggatttttactcccttaaggggtggggttgggggtcca

SEQ ID NO: 586475 - DNA, 175 bp, Homo sapiens
  misc_feature (2)..(2): n is a, c, g, or t
  misc_feature (96)..(96): n is a, c, g, or t
  misc_feature (155)..(155): n is a, c, g, or t
cntgggcttcccaggcctggggtctttgtaccattcatggagcggctgataaccttttctgcataaggccacacagataacaccttgtgcctgggnctgggttacatggggccaggtgtcggtcggatgacgtgaggcccaatgctgtgggcacntgacccctggccccacaaaa

SEQ ID NO: 586476 - DNA, 456 bp, Homo sapiens
  misc_feature (199)..(199): n is a, c, g, or t
  misc_feature (230)..(230): n is a, c, g, or t
  misc_feature (286)..(287): n is a, c, g, or t
  misc_feature (293)..(294): n is a, c, g, or t
  misc_feature (320)..(320): n is a, c, g, or t
  misc_feature (339)..(339): n is a, c, g, or t
  misc_feature (397)..(397): n is a, c, g, or t
  misc_feature (411)..(411): n is a, c, g, or t
  misc_feature (455)..(455): n is a, c, g, or t
ccgttctgtttttgccttaaataaacaaccccccctttggcacaagggaaaacccaaaccccccaaaaagcccccttggggggaaaaaaaaaattttttccccttttttcccccccacaatttttaggggtttataaaaggccgtgcgttttttttttaaaaacaaaaattttttttttaaaaaaaaaaaaaagccggnccatatctcttttttaaaaaaaaaaaaaacntttttttttccttttttttaaaaaaaaaaaaaggccccacacaaaaaaaataaatnntctttnnttattggggggggagaaaaagaaggnccccccctctttttttttnaaaacccccccctttttcttttttttttaaataaaaaaaccaccccccatatattttnataggatattgcgnctcccgcccgcggggggttgtttaattaaagaaaaagaaaaatna

SEQ ID NO: 586477 - DNA, 498 bp, Homo sapiens
  misc_feature (92)..(92): n is a, c, g, or t
  misc_feature (158)..(158): n is a, c, g, or t
  misc_feature (260)..(260): n is a, c, g, or t
  misc_feature (262)..(262): n is a, c, g, or t
  misc_feature (264)..(264): n is a, c, g, or t
  misc_feature (296)..(296): n is a, c, g, or t
  misc_feature (325)..(325): n is a, c, g, or t
  misc_feature (335)..(335): n is a, c, g, or t
  misc_feature (378)..(378): n is a, c, g, or t
  misc_feature (382)..(382): n is a, c, g, or t
  misc_feature (389)..(389): n is a, c, g, or t
  misc_feature (403)..(403): n is a, c, g, or t
  misc_feature (427)..(427): n is a, c, g, or t
  misc_feature (436)..(436): n is a, c, g, or t
  misc_feature (463)..(463): n is a, c, g, or t
  misc_feature (468)..(468): n is a, c, g, or t
  misc_feature (470)..(470): n is a, c, g, or t
  misc_feature (477)..(478): n is a, c, g, or t
cgccccgggagcctacccagcacgcgctccgcccactggttccctccagccgccgccgtccagccgagtccccactccggagtcgccgctgnagcggggacatggtcctctgcgttcagggacctcgtcctttgctggctgtggagcggactgggcancggcccctgtgggccccgtccctggaactgcccaagccagtcatgcagcccttgcctgctggggccttcctcgaggaggtggcagagggtcccccagcccanananaaaaatgaaaccaaaagatgctggacccaaangagagatctagctgtgcataaccaaagancttctcctancttcgggaaatctggctggtattggggttccattacgagccancgangcccganaaaacctgcagaanatgccaaaaaggcaacgttcttantacagtganaacacgcaccccaactacctgttcacnctgtnantgaaaannaatcgtggccccacacaatg

SEQ ID NO: 586478 - DNA, 229 bp, Homo sapiens
ggacgtctggagggacatcagctgggagtggtgtcgtgtggacagtcagatcacacccgtgcccattgctgcatccagctctcttgatgctcaatattcgtcatttgtggacattgtgaacatggcaaacagatcaagtccatagatgcaggacctgtggatgcctgtactttggccttttctcctgattcccagtactctggtctcaggaactcatgtggggactcca

SEQ ID NO: 586479 - DNA, 829 bp, Homo sapiens
ggttgcagcagaaattgagttgcggcttgcccttgtccagacctatgttctgcttgcgttccaggaagacaggaggtgcactgtaccaccgcagattatctatgtgctaggccactgcatgtatgggccgacactgattatcagctctgatgtttcagagagaagacctcagaaaccgaaagaaaagcaccaccctcctatgtgtctgaagtttcatcgtgtgtttatgaaatctgaatgggaaatggatcagcacgattgtcttctaagggtaattaaagataaaagtaaaacagaattacggctttgacagcaataatacgattatcttataggaaaaaacaatgtcattgtaaagtatcatgacaatacgagtaactgacagggctgtcaaagtagatgacatcatgtgttagcctgttacctaatcccgctagaattgtatggttgtgggattgtagaattcagtttttatcatcctacttataacaatcaaagatgatcgctataagttgggcacctgtgctgattgtgcggtggaaactgctaaacgccatgtggtacatacttcctttacgaaatatcctgataagctgttgacggatactctgtgttcacccttttgtgtagactgcctggaactgccagtcactgttgtttgcaccagcagtatttgtcgcacacgtaccgtcgatttacttgaagaaggtgacagtatgttactggattaatctggcggcttttaagttccaacggccaaagtaacgaacttgggtccatacttgcatttttgtggtacggcacaaagcccgaaggtgccctgcaggcg

SEQ ID NO: 586480 - DNA, 1510 bp, Homo sapiens
ggtgcaccgtgttttggtattgttgtcggctcccgtgttgtgtttttgtttgggttcgacggactaggtgtgtctgttgttgtggcgcgtgtggcggtggggaggcggggttgggtgacgccccacggtgttgtgtgcttgggtggccggtccctgcgtcttatgttgtcgttggttggatcccccctcttgttgtcccaggtgtgtgttgtattgtggggcgcgcgtaggagtgggaggtgttgttttgggcggtgcgtccacagttgttgccccttgttgttggcagacaccgggttgtttgtgtgtgtgtggtggtctactcgccggcgtgttggggggtatgggtataatgtggggtggccggctggtcgcaaggagaattgagaaggtcttttttggccacgtaggatgccttgcgccgcggaaggatgagtcgcgttggtctagcagaagggtctaagcgagttagtgacaacattggtgggtcgttttttctcgttgtggagtgtccgctggtcgccggggtatggtatccacgaagtttgtccccaataggttttgtgcatatgtggaggaggccccccctccgggcgtaaccccaccggttgagtatcgctgttatgagcctttcgctgtagaaagatgcctaaagtggttgggaacttctcttgtagaactcttgttaagaggagaagaggagaggggagtaccgcagtgaaaacttctcgtggcttagaggggacccacctctgcttgtgaggagcagtggtgtgtgtctgtgcggtggtcactgacacatacacacagtgtgtagtgagagtgtgtgcacagtactcgcgctcacgcgtctccctccacgtcttcccacagtgagagggtgttgtgctggtgagagtgagaacagcgctgttgtgacaaagtcgtgtttctctcggcccaccacagagataatgacactctgtgtagacatcgagatctctttgacacacacatcgtagagagagactccaccgccgctagtctctctagaggtggggtagacacacgtctctctacatatgtgttatcagctcgggtgtataaaatcgtgtgtatatgtgcctcataagagaagagaccacattctatagagggcgcgcgcgcgctgtgtcgcgccgtcacacgcccgctgttagagatcccagcgccacacttttgtggagaggcccgagaggccgcgggtgtgagatcacacgagagggtcacgcgagcgagctccacagcacctttcctgggctctacacccgcgtggaaaccccgcccttgtcaccacaaaaatacaccacaaacaaatattagcactcgggccgctggtgtagacgcggcgccctcgttagttccccagcaccccttgggacaactcgaggcccgcgagatatggcgtgtaaccccgcgagtgcggagccttgccgtgagcccatatcgcgcccctgcactcccgcctgggcgaccgagcgagactccctct

SEQ ID NO: 586481 - DNA, 369 bp, Homo sapiens
  misc_feature (141)..(141): n is a, c, g, or t
  misc_feature (178)..(178): n is a, c, g, or t
  misc_feature (188)..(188): n is a, c, g, or t
  misc_feature (193)..(193): n is a, c, g, or t
  misc_feature (206)..(206): n is a, c, g, or t
  misc_feature (210)..(210): n is a, c, g, or t
  misc_feature (316)..(316): n is a, c, g, or t
  misc_feature (368)..(368): n is a, c, g, or t
ccaaacacaggcattctgtagcatagcaaaaccttctcaaatgacagagattctgtttgctgttgagaatgttgttatttggatttctgcactgtttaacaaatgaagtaaaagaaaaacactactgcaatcacgtctttnggtatgctagtatcagtcagatgcacttagagtgaanaaacactgtnttacngcacacagattgnaagnattgcgtaccaagtgatacaacttgaaatgcagttctcacttctggtttgagaaatgatattttatacgcctcaagcttcggctttgataatcttggatggtaacnattctagaccatcatgaattccctatggtactaatggcaggggcctttgtcnc

SEQ ID NO: 586482 - DNA, 952 bp, Homo sapiens
ccaggatactatgccttcgacctgtcaggagccactcgagtacttgcaatggatggatgacgaaggagatcttgtcgctggctatgaaagcctgaaaaagaatgaaattcttcatctgaaattacctctcagactttctgtaaaggaaaacaagggcttattcccagaaagagatttcaaagtgcgccatggaaggatttgcaggacaaggtcatatacttcgatctaaagcatgtgccacataccagattgctggtcaccagatggccttccaaggttgtgatctgcaaggtgtggcaggttgcagaggacagtgatgtcatgtaaagactgtcagcgaccatggctgtgcatgagaaagaggagagtctctggcctagggtggccgtcttctccacattggcacccggagtcctccatggggcgatggctccgcagtctgcaggtcgtcgatctggacgtcccggaagaccatgtacagtctcagatgtcagtgagagtgacgagctgagtagcctgcaggtcctagatgcagacgcctttgctttctgctgtgcttcgggccggctggggctttgtgagactcccggcgagtgtgggcaccgttggagaatcgcagcctggcctgggtctggtggagagagagggtgtgctgacatgttgggagctcgggggccgggccctggtgcccatgtatggccaggcttgggtcagatgggcgtctggtcttcttgacccgcggtgatctctggcatcctgtgagctcagtccagtggccagtatccgtacctagccctgaccgagctgctgcagtgattgggcccagcctgagaatggggggccctcgggttcgacggtccgcccggtcctgtgccccttgggtgtgacgggcccaaaccggccctaactctaccagagggacactagaggaggagcttgtggccgtccttga

SEQ ID NO: 586483 - DNA, 408 bp, Homo sapiens
tcaaccagggaggctggaaatcctataatgcacaggacatctccacaggacaaaggattatccagttcaaaatgtcagtagtgccactgttgagaaacctgttgaaaagcttggccagtcatagtgattcacacctttaatcccagtactttgggaggcctaggtaggcaggtcacttgagcccaggagttcaagaccagcctggccaaatggtgatacctgatctttactaaaaatccaaaaagttagccaggcgtggtgctgcatacctgtaatctcagctactcaggaggctgaggcgggaggattgcttgagcccgggaggttgaggctgcagtgagccacgatcacaccattgcactccagcctgggcaacagaatgagactctgtccataaacaaacaagaa

SEQ ID NO: 586484 - DNA, 433 bp, Homo sapiens
acctactggcctacttattttaaaaaatgcttagtttattgtgccatgaaaaacaggttttattttcataagccttctgtactgtcagctatggcaaatgcatacagtcaactcagtaacaggtgctgagtcccctttgtgtcctggagcactaagctgaccccagaggacatctgaggaaagaggtcagtgatgcctcccagggtctgaggtctgtgtgagggcaggagtgacgaatgtccaactctaggtgtctgggaaggaggcccaggtggcgaaaggctggcaaaggagagggtggcttttgagctgggcagagtagaaaacgtttccaggaggaggaggaaactgaaaaatataagaaaagaattcgttgaaggtattgccatacttcatacaaattagcatttgcttaattgggagtagaaaccaa

SEQ ID NO: 586485 - DNA, 187 bp, Homo sapiens
cggcacgaggttggaattcatccaatccaaatgcggcatcttcaaacctccatgatgctgcttacatgtctcgatcccacttaactatcttgggctgtgacaaagtcacatggttcacacggcaggcatggttgtggttaatctggtttatttttgttccacaagttaaataaatcataaaacttga

SEQ ID NO: 586486 - DNA, 127 bp, Homo sapiens
aacggggaaaaaaaacccggggtttttttttttgggggggcccgctcaaaaaactaggggggggggccaagtgcccccccccccccccccccccggtggggcgggccccaaaaaaaagggggtgctt

SEQ ID NO: 586487 - DNA, 404 bp, Homo sapiens
gttgatgtcttagtgcaagattaccaaaatcttagtcaaattgaacagtatattcattttcttctccaactaccaaaacacagtcttcattataaggtgattggggtgcggttgaaaaatctgtggtgaaacagagactcagaatgtttttgtgcacagagacccaaatgattgctcccaaacctgtcaatattcgcgtgctacgcactcaccaatgctgatattaaaatgtggttatctgataaatattcccttgtgtatggaatagctgttttgcatagtgtctccttccacagaagaatcttcacaaatctccttttcccatctcccctgtctttatgtgcaaaagagcacaggtgtcatctatatcctcatcatcatcgtggtctgtacactctcgtgca

SEQ ID NO: 586488 - DNA, 841 bp, Homo sapiens
ggccggcggtaggttgccagctagggtggaaagcggtggtagctgcatgggtgctggggctcggttgtagtagtcgcgatgtcttctccgaggcagagccaggtcgccggatgtgggaagccagtccttcgaaccacaggaggtatttaaagcatgtgatgaagatcagaaaggatatctcagcagagaggactttaagaatgctgttgtaagtgctgttgggtacaagccctccaagaagtgcatctgtgatgtcttcaataaatccaaatagttctggtatataactcgagggggttttgaaatatggtcgagggaaaaaggactggaagctcaagggatatcggaacgaatgtaggacacatcttcacagccttttgacacctactattgtgattttgaacctttggaagatttcaaaaaagctttttaggcagggtggctccaaaaattacccggaaaaggaactgtgcttgaggtatccaggaaggtagatcgaagattcaagatggtcacgtcagggttaaagagatttgaatatgccctgaattatggacagaaggagagcctaactatgtgtgaactactttgttggtaacttctgggggagatcactagattgtaatgtcagcagatctactctataatgatgtcatgctactgacttgtggttaacctttaaaattccaataaaaaaaaaaaaaaaaatttttggggggctggcaggaaatgttttaacaaattttggggggccaaggtattaaatggaaaggtttcaagagaaactgttaaatgtggttcacaaaaagggggcggggttaaaaatggggtttgtaaaggc

SEQ ID NO: 586489 - DNA, 846 bp, Homo sapiens
attatactagcatttaccatctcacttctaggaatactagtatatcgctcacacctcatatcttccctactatgcctagaaggaataatagctatcgctgtgcatgtatagctactctcataaccctcagcagccactccctcttagccaatattgtgcctactgcccatactagtcttggacgcctgcgaagcagccggtgggcctagccctactagtctcaatctccaagacatatggctaggactagcgtacataaggctaaagctactccaatgctaaaacctaatcgtgcccaaacaatgtatatagcgtaaccaggtgagatgactttccagaaaacacataattcgaatcagagacatgcagccagagcctaattattagcatcatcgcctctacgatttattaagcaaatctccttaatgataacagttcacaagcaagaataatcaatatttaatatcttcttcgaaagcacagtttatccccacttggctatcatcacccgatgagggaaccagccagaagggctgtgacgcaggcacatacttcctatgctacaccctagtaagtcccttcccctaagtcatgacgtgattaaactcacaaaggctaggtcataaagttctaataatcatctcagtgaccagatattaaatctgaagcagaattaatatgactagttaaaaaatagttgtataagtaaagtactattaggacacattatggtcctaaggcgttgtgggccagtgggaatggatgggaaattaaatggggaggaaagctaaaatgtaactgggaaaagacttggtacagggtaaagctgaaagaagtgagataaat

SEQ ID NO: 586490 - DNA, 459 bp, Homo sapiens
ccctcacccattttcttttcaacagtttaacaatatataaatacttctcatccttccttgtaatctcaagagagacatattacacatactactctctgaagctagcctctcccctacttgtaacttttttttttttttttttaacagtcctgctctgtcacccagtacccaggctggagtgcagcagcacaatcatagctcactgcagcctcaaactcctggactcaatcctcccacctcagtcttctaagtagactggactacaggtatgcaccaccatgcctggctaattttttttaatagagatgggatctcactatgttgcccgggctgatcttgaactcctagcgtcaagcaatcctcctgcctcagcttcctgagtggctgggattacaggtgtaagccaaaacactggctacttataacgtcgacgcggccgcgaatttagtagtagtaggc

SEQ ID NO: 586491 - DNA, 399 bp, Homo sapiens
ctattcatcggcactccctagagcctctaggaaatccacttgtcatgacttcccatgattcagatttccctgtcatttcggctaagccctggacccatctcctgttgcatgttctgaagcatgagagggctggacacactccttaacatttgttctctgaactgtggctcctgacatcgctctgagcctctatatgggactgtccattgtagggatcctagtccttctgtccctacccttgcgtttttcttctctcattctcccagcctttggcatttctatctgggtctctatttcggtgtattgtgaaagcgtgctcgattacctagcgacggctgccgatgaactcgcgtagggtaccggagctcccatcttcggtattcatcggtcatgccgtct

SEQ ID NO: 586492 - DNA, 1725 bp, Homo sapiens
  misc_feature (1)..(1): n is a, c, g, or t
ngggcgactgtgtgttttttatttttcggtatttgtcttctggtgggtggcgtctggctctcgtagtctcgttctgttgttctttgttcgagtccgccttagttgtgtgtgttgtctcttgtgattggtcttgttgtcttgtgtggtgattgttgtcgtctgttgcggttatggggtatcttttcccgtttgtggtgtgtgtgtggttttcttcttgctttggttttgggtttgctggcctttgttcgttgcgtgactcctgtgtgcggtcttgtgtggtatgtctagtctttgtgtatctggtgtctcctgttcgtttgttcttgctgcttcgttattgggctcgctgtttgtgctgtgtctttgtttgcttgtggtccatttcttctctctgtcgtctttggggtcttttgggttgctttggttggttcgcttcttgtgtggatccctctcgtttgtgtggtttttccccctctgtgttagtattttgtgccctatttgtcgctttctgtgttttactctgttgatattggtccttctttggttctcgttgctccttggtgtgatcaagtatctgtcaccggtggttatactgtattacttgccatcggggagtccttctgtgtgtatgtctgttgcggtgttcatttgtgggtcgatttcgttcttcggttgtgtatgtggcgtggtttggttggtacttgttgtgtttgtgtttaatcgttctgtggtgttatatcgcccctgttttgtgttgctcgctctccgtgtggtgtcggtatatcctgctcttgagtgtgctctgtcgttgtcgatttggtgtatgttcgcattggtttctttggtggttgtttcctaactgttcatctcatcctgtttttctttattggttgttgtggttcttgtctatgtcttccattcctcttgtttccattgttataggttgttgcggcttcgtggtatggtatcgtattcttgtttccaagcgtttgtgtcattgtttggctctatatatcttgtgttatgcattcgtgaacgggattcaataggttctatgccctattgttgttgtccttcatgtgagtgttatgtgttctccatgtgtttgggatgtcatactctgtgtatatgtgatattaaggtgccgtgtgctcttgtggtgtgtgattgctgcttgctagctaattatttgagttatctgttgcgctttgcctgtgttgagtgtgtgctcttggtggctactagctcctcttgatatgtgcaatcttgatgctattgttgctgcaatcttccactttggcatttagcttaaataccattcctatggtcatagaattctatgctgaggtggctcaaggatgactgcttgttgccgagagataccctttataagcgacgcttgcaccgcaatgcgcgtatgcctcatgctgtgcactggcacacctgggatgttggcatgacatgtgctgtgcagagatgccctatcttgaatattttgtcagtgactgaaaccatctggtgcattctgagagtgcatgatgatgttatatgttgtgcctgttaaaaaagcatagtgagcagtgttagcttagttctcttcttgatgtaggttattatgattagctttgtcactgtcttcactactctagcatggaaacaagatgcaattccatttgtaggtagtgagacaaatacgccgatcctactaaagaacatgaagtcagt

SEQ ID NO: 586493 - DNA, 191 bp, Homo sapiens
tttaggtggggttcccaaaaaccccttcagggtgggttgagctgctttcccccagggtttttgtgcagctggattttttttgttgcaaacaagcctggcatctgtttccccttgttcctgagtggccccccatggggtttttagcaggctgtttttggtttttggcaataaaagtactttggatgctgtta

SEQ ID NO: 586494 - DNA, 316 bp, Homo sapiens
  misc_feature (144)..(144): n is a, c, g, or t
  misc_feature (297)..(297): n is a, c, g, or t
  misc_feature (302)..(302): n is a, c, g, or t
tgcctttgctccagggcatttgtggaggatcgaaaattgtacaatttgggatttaaaggctattacatcagagacagtggcaacaattcaggagaccaggcgacagaagaagaggaaggtggtgtattcctgtgggtactgcangaatcacattgacaagcaaatggcatagcgcctgagatgaaaagtgaactgtgattgctgaggcttgaacttcatgagaagatatgggattgctcacttgcaatttggtaggtatttctgaaacataacgacttttgagggtatcgtatgaantaatnttaattaaaggtta

SEQ ID NO: 586495 - DNA, 188 bp, Homo sapiens
catgtcctgtaatttaccatggattttatctgtgaattactttccctatatttgtatatcactaagcattaatcaagtgcttacatttgtattatctcatatgatcccctcattaccctggacaggattgtctgattggcatatgtcgggaatgattatgtaataatggaaagtgtctaccgggagga

SEQ ID NO: 586496 - DNA, 103 bp, Homo sapiens
gggaaggcctctgatatgtaccatggtatgacgtgtgaagccctatccataagggccatgaggacgttgagttcatcccccgcgctttgggggactcctctag

SEQ ID NO: 586497 - DNA, 156 bp, Homo sapiens
tggggggggggacaccccatattacatgatgtgattattacacattgcatgcctatatcaaaacatctcatgtaccccataaatatatacacctaatacccacaaaacttaaaatataaaatgttttaaataaaaataaagaaaagatttcccaca

SEQ ID NO: 586498 - DNA, 2817 bp, Homo sapiens
cgccggcggccatcaagggctagaagcgcggcggcggtagcagccaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaaaaaaa

SEQ ID NO: 586499 - DNA, 348 bp, Homo sapiens
catatgtatgggatatcaggtcagtgggtgttgagcttgaacgctttcttacattggtggctgcgttaggcctactatgggtgttaattgttactctctctacaggtttttcctagtgtccaaagagctgttcctctttggactaacaagttacatttacaaggggatttagagggttctgtgggcacaactttaaagttgaactaagattctatacttggacaaccagctatcacccaggctcggtaagttttgtcgcctctaacctataaatcttcccactattttgctacatatgacggggtgttgctactttatagccagttcttcaggtagctcgtctggttt

SEQ ID NO: 586500 - DNA, 2475 bp, Homo sapiens
  misc_feature (54)..(54): n is a, c, g, or t
gcttctggtgtgagaatgtaaacctatgtgagaatgaatgctgaggcccctaanctcaccaggtactcgctgcttcacgtgattaagtctcttttaaaagccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaaaaaaa

SEQ ID NO: 586501 - DNA, 297 bp, Homo sapiens
taggaggccaggtggggatagcccaagttgagaacatatgaacaattattgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 586502 - DNA, 161 bp, Homo sapiens
  misc_feature (53)..(53): n is a, c, g, or t
  misc_feature (107)..(107): n is a, c, g, or t
  misc_feature (119)..(119): n is a, c, g, or t
  misc_feature (134)..(134): n is a, c, g, or t
  misc_feature (154)..(154): n is a, c, g, or t
atactggcaaagtttaaatgtagataatactggaaagtttttagaatgttganaagtaattgaaaaaggtgataggtaaatttttaggcaaagataatttatttcantaaatctttcanaagcctcaccttganatgctgttagtaaatttctntgatttc

SEQ ID NO: 586503 - DNA, 433 bp, Homo sapiens
agtcggtaccagtcttacccttactgacacctaatgtctaaaacaccataaacattttcatcctccttttgtgccccctattaagaagcaaacctgtgaagctactatcgtttatcatcagtgtgaatgcactgagattagtcaagaacaactttttttttttttttttctttttggaaacgcagtctcgctcggtggcccaggctggagtgcaggggcacaatctcggctcactgcaacctctgtctcccgggttcgagcaattctctgcctcagcctcccaagtagctgggattacgggcacgcaccaccatggtgtggctaattctttaatttttagtagagacggggtttggccatgtgggccaggatggtcttgaactcctgacctcaggtaatccaaccacctcggcctcccaaagtgcggggatca

SEQ ID NO: 586504 - DNA, 420 bp, Homo sapiens
ctagctatgagggtatctctctctatagtcttgcctgtttctcagtcgtagatttctacttatgtgttacttggtacttgctgatctcggtggtgcgggcacgtacggtgatttttctgttgtcctggtccaggctcattcttaagcagaccctgtgtggcctctctttctcctgctcctccttcccatgacagttaactttgccttctatctatggcaggttttgtacaaaagaattttagaccctcccaccaacagtaggatacctctaatggttttggcccgggaatgtgtctagctcctcttccagggatagaggctttattcctttactgtttcactagccccagtaagtcttcacctgtgccttgagagcaatcaagaaggtacgctgcctctgtcccagatagcctttattct

SEQ ID NO: 586505 - DNA, 169 bp, Homo sapiens
cgccaggaggtcacggctacagatgagctgcgatcacaccattgcattccagtctgggtgaacagcaagaccccgactctgtagctaaaaagaaaaatgaaagacaggaagaaatgcaggaccgacgcacgctgcagcatggacacttttacatacgcccaggtaagca

SEQ ID NO: 586506 - DNA, 1318 bp, Homo sapiens
  misc_feature (488)..(488): n is a, c, g, or t
  misc_feature (491)..(491): n is a, c, g, or t
  misc_feature (1092)..(1092): n is a, c, g, or t
ggtcctctaattatataggtaatacggcagagatgatttaggtagcagacacgggaaaatagaaaacaatgaagcttgtaaataactaggggttcaaagcaatacataggtgtcgtttagtggatcatttaaagcattttttcttctatttatattgataccaactcaggattgtttacagtctgcagaaagtgttggaacggaatcattttatttacaggcagttctgcttttttttttttttttaatgaaggaagaaaaccccaaaccagtggtgttttggtggttgtgggttggtggtttccccctagccattgcagcgggtggccagaaaccattcagttttggcccagtgctagagcagagccttttcctcaaatgactatcttaggacaagaactccagtgtataaacactaatattaacgggggctgctctgacttacatgagggcctggggccctcttctctgtgacacttacagttganatncctgtactgaagcagatatacctgccgtggccatcttcatttgaagggttgagtttcttaagagtagccttagatcctttctttagtcctaatttatttaatgtttatatacagttttaacaattccgactgctttccaaatttaaaactggcttagaaaatgtacagtagaagggatgatgggtacggtaacctgggaggtggaggatggagagttgatatcaccagagttgggaagaaggcaggaaaaacaagtagaagaaataaaaaactataattatgaatgtttttagttcagtgttctagggcctatttgataccataaattacttttaataatgaattggaataattagacaaagattaaataacgttctgagcttcctgccaaggaaagtaggtaaatgtgtaattgattctggagaaatttttgttcaagatatcataactatcttaaataactgatgccctgaaggttttgaattttagaagttttgatgtatttttaaagcgatacacaaataattgaaagttgaaatagtaaataatactgttttccaaagtttaattaaaatactttataaagcttaaaaggatctcnagttacttaaatttgagaaaatgagtttatattgtgatatatgccattaccattgcatttcaacaagttataagaatgatataggtcgggtggggtggctcattcctgtaatcccagcactttgggagaccgaggcggcagatcacctgaggtcaggagtcgagaccagctggcacatggtgaaacccagtctctactaaaaaataccaaattagccgggcgtgtg

SEQ ID NO: 586507 - DNA, 431 bp, Homo sapiens
  misc_feature (1)..(1): n is a, c, g, or t
nttatttggacccatatcctggataatggcagtcagtgtcatatgcactgtcaaccggatcgcctaggcaacatttcggtatctattcgggtatgagccgtcggtttctttgacactttcatcaaagtcagcgttagcatatctctggtacaggcgagctgctgcataagctttgaaaggtctttcagcaaaacattatagacaggatcagttgagtatctgttggcatgactaagcatgtcgataatgctgtagctcagctagctttgtgaacatgcagtgggcagttatcagcagctcggcaccattccgttgaaagtgcttaaggccatgtagctaggaaaaggagttccgctgcataaaggtaagggtctcagctggaagcttcatattagtattagttcaaatatggcgtctctctgccgtgtatg

SEQ ID NO: 586508 - DNA, 1014 bp, Homo sapiens
  misc_feature (6)..(6): n is a, c, g, or t
  misc_feature (268)..(268): n is a, c, g, or t
  misc_feature (359)..(359): n is a, c, g, or t
  misc_feature (793)..(793): n is a, c, g, or t
  misc_feature (900)..(900): n is a, c, g, or t
  misc_feature (945)..(945): n is a, c, g, or t
  misc_feature (997)..(997): n is a, c, g, or t
ctccanataccatttataataaatttttcatcaagaagggcttcttaaaacacccactttctccattcccacctccaaaatccacttatgacaagggccccacttttgaacctaattctgggagcccccttacttctggctggccagacgctgccgtccgtcaagggctttcctcccttcataatcattaacatatatcttaatttcaatttattaataaccatttatttactttagcttcctttatctctaccgaactctttttaanaactcaaactttaccacccttataaaacgggtttggggtttggaaccacaggccatttctctaatttgccttcttttaatttttaaattanacctctacctttatgacctttacccatttccttacttcacttcccttccattcttgcttcttcacaacattttttaaacagggttccgacccccccctttatacccgttcttctcaccattttgggctttactaccttgtggtctttttttctcttcacacaaattctctctcaccaacttgccccactttcccaactcctctcctcttacacaaaaaactgtgattacctcaacttgaatatgaaactgtgattgaaaaaagtcaaaacatgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttnaggactgaggccaggggatgcctcctggaacctgccaggcctctctgttctgtgaaggtcagtatccacttgattcctccaggcggcgctccaggtgggaggagcangggtcttctgctgtttccaaaggaatggccatgacactgcttttnaccttagaattggatccagggacccagcaaaagagcgggggttggttcccanggacaggcagtcctccc

SEQ ID NO: 586509 - DNA, 115 bp, Homo sapiens
cagtatgtagagagcttcccgccctccctgaggcagctgccggtgtgggcctgatggtggggtttggggccccagcaaatgtttccttaacgtgggaccttcagaaggctctttc

SEQ ID NO: 586510 - DNA, 132 bp, Homo sapiens
agaaataattcatcacactactacatatacaagctctccaagaatgcaaacacggtgacattgagcatgggtagtggctgcacatcaggtattccaagcaacgcactccattcttctccaccaagctcatcc

SEQ ID NO: 586511 - DNA, 239 bp, Homo sapiens
  misc_feature (121)..(121): n is a, c, g, or t
agatcgagtcgtacccctaggtggaatgctggaatgcagtggtgtatcatggctcactacagtctcagctcctcactacgaggtcaggagattgagaccatcctgggtaacacggtgaaancccgtctctactaaagatacaaaaaattagccgggcgtggttgcaggcgcctgtagtcccagctactcgggaggctgaggcaggagaatggcctgaacccaggaggcgaagtttgcaa

SEQ ID NO: 586512 - DNA, 197 bp, Homo sapiens
tagactgatacgaatcgagctcgtacctctgtgtgtagtcttttctctttttatgagacaggtccgctcactcgtgcagggctgcactgccgctggcgcgaagtcctgggcttcgagagtcctcccgcctcagcctcaaagcgcttggggctacaggggcgcgcgcgcgcctggcccattttaacttcttatttttg

SEQ ID NO: 586513 - DNA, 515 bp, Homo sapiens
cagaggtcaggtcgctgttcagtcccatggataaagcgaccattgaaaacaggattctcattctacccaatgttccgagcaaagtgaaacacgcgagctgtatcaatgtgaaatacgggaccgatatggtggcatccgcagtgacccagtcaccctgaatgtcctctatggtccagaactccccagcatttacccttcatttcacctattaacgttcaggaggaaaaactctacttgtcctgcttcgccgagtctaacccacgggccacaatattcttggagcattaatggggaagttgcaggtatcaggaccaaagctctctattccccaaataactatccaaagcatagtggggtctatgcttgctctgttcgtaactcagccactggcgaggaaagctcccaatccatcacagtcgaagtcgctgactggggattaccctgaattctactagtttctcccattccattttctcccctgggaatcacgaaaagcgagacccactctgttcccg

SEQ ID NO: 586514 - DNA, 110 bp, Homo sapiens
tagacaatagctcggactccaagatgttctcatcatggcggtaccgagtgggcctaacatttgggatgccccgggaacgggtaccacttctcatttcatttcccggtatg

SEQ ID NO: 586515 - DNA, 271 bp, Homo sapiens
tatgtctgtcaagtgattgctataaacaccccagacaccatattcatcagaagggcacgtcgtcgacgaaggcgactaattggccattcgcatccacctgatcatatctcaggacagccagcttagccttctttgctcttgtgcttattcttcttgggagtggcgtaggacttcttcttccttttcttagcaccaccacgaattctcaacacaagatgaatcagtatactccctttgaatattgtagtcagacgaagtacgtccatcttgt

SEQ ID NO: 586516 - DNA, 268 bp, Homo sapiens
tgcgcgtggattcaggcaggaggcttatagtgaggagtatccgcgaaaagcggaaaaaaaattccaggcgactgcgctggagatatcatacgggaccaacagtagcaggtggtctggccatacagggatttcttactcgcagcagagcaatgttgctgccactcaagtcaccagggcgctgaagagctcctgtggagacccacatgatctaacaacacacatactgaaaacagggaaatgcgcattttcgggagaggaagagacaaac

SEQ ID NO: 586517 - DNA, 534 bp, Homo sapiens
cgccccatctgtgatgaagagcaagatcttgtccgctagtaatgctcgaaagaggccagctaagtgtctcatatacttgaagtcacaggcgttgtagctacggtattcgttctccacgtgaatgctaatgatgttgcccgcattgtggtagagaaatggatatatctttggcagcaagaccttgaccgaggagtcctcagcttcaaggaaggcaggatctgaggttctcagatgaatattagggtttcgaagcaaccaagaggggagacctcccatctcccactcagcacagatgtaaggtcctggtctcagaataaccaacaggttcactttagctgcctcattcaggaaggcaatgaggtcccggctgccattaaagtaatagatcccaggctctggctcatggtagttccaaggcacataaaactgcacagcgttgaggccgctcaactgcatcttgagaagccggtcggcccacagaaccggcggtactcgaaagtagtgcaggctgccagaaacatagcggaagggggc

SEQ ID NO: 586518 - DNA, 937 bp, Homo sapiens
ggttttcacgccccttttggcgtggctcttccatgcctgcggttttcccgcctatccctccggggcttcctctccttctcccccttggccctctgctttgtcccttgccctgcgccttcgtctgccgtctgtctgcatggcttcctgtttcgcctattgggcaccctttgcttgttgtctttggctgtctcctgcacccctgtgctcttgtactgcctctcgaacggtccctctttctctgggggctccttgtttgccggcatatctactcgtctcctcacggtatctgcactttctgtgttcgcctcattaggcttgtgctatgttatcccccagctccgattcccctcaccctgagatcaagtttaccgtattaacaatactttagaacccttcccgaaagtcatagtctcctttgcttccatccaatgtctttgggtgcaacggctcaatttcggcccctacgtgttgctacgttctatgaggtatatatccatatgggtccaaggaggcacgtttgccaggacattatatattctcagtgcggacctcaggcccctgttctctctgagggtcctggctggtgatccggacctggacgattggcctctacagacccttggaggaccgcctggctgaacgcacgcatctgagaacctccgaccgctcatgagagtactcggcatggggcgtctggcttgcatctcaaggaccctcgagagttcactggtgctgaactcccgtctgctcctccgctcccgcagagactggggcatggatctggacatgagagcacccttggtgctcacagagggctgtgtcttactagaaatcaaccgcaaacctctccttcctcagaatagtgatgtgttcgacgttgttatcaaaggccccctttctatgttcatgttagtatagtcctggtgtcgtttttttc

SEQ ID NO: 586519 - DNA, 1087 bp, Homo sapiens
cacaaatgggatgatatatccaaatttctgaaccgaaccacgaacacaatatcggtcaaaacactacctatgcacacgcaaaccaactccatcacgaacattacggtacgaaactagccagccacaacgctggctcactgccatctaactcccgagtattttacggactgctgacggcacggcgacattaccttgcaggtcaggacgttcacagatcacgcctcggccacgcaccggtgacaatccctgtctctaccaaacacatacaaacaattcagcccgggccatgaatgcgcgggcttcctagtcaacccccaggttctccagagcaggctgcaggccaggcagcaactgcccctgaacctggagcagcatggcggcttgccagccgacgacaacaagctcgatgccaactgcacctccaggcccaggagagacactagacgatggcagaattcatgtcctcacacaacaaaccacccacaaccaccacgaacacaccccccccacacaccatggaccacacaccaagagctctacaaaccaccaacccaagacacccacacatccccacaagaggcaacaaaacagcccaccactgtagagcgagactcacgcaaaccaccccaaaaaacggaccaaagaatgcaccccaccacatgtcaaacgacacaaagcaccacagcaccccctaaggcgcagacaaagtagaaaaaggcaaatctgggcacccaaaactgaccgccgcaaaaatcaaaactccacacacaacgcacacaagacagacaaacacaacgcacagagtcaaccacaagccaaccgaccacccgcacagagcccccacaccacagcccacaccacagggcgacacccaccccagcaggagagcgaagacaaagcaaccccgccgagcaaacagacctacccacaacacgcgaccccttaccaaccgacccgaccactgagaccgaccaccacccaaccaacgacgcacaaccgagaacaccccgaccaccagaacgacacctctcacactaaactgaaaccaacctcaacacaaccacacaccaccccgaccacccaccaa

SEQ ID NO: 586520 - DNA, 607 bp, Homo sapiens
  misc_feature (145)..(145): n is a, c, g, or t
gagctgcagcggctccggcgcgaccccgaggcggcgccggcctccgccgctcggcccgggcccgcgcccccggtctcggtcccgccggctgcccctccagcaccgccgcggaaacccaaggccagcccccgcgtggcacagcggngggggccctgggtggctgggaagcatgcttgcttggtgtggccactgggtgaccccttcggtgggaggcgtgccgtggtgttgcagcccagcttgatgcggggtgttagggggcggctcccggtttgtcggctggtttggcgctgggcgccccccggggtgggcggccctttattctcaacccgggcgttctcccgtgacttggccagaagcgctgggacccaaagggggcgtacaacccgtttggaaccgccccaggtgggcttgtccaccaaaggacacgcgcatgtgtcgtgtgaccacatttctgttcaatgcccagcttggcacaataattctaacacgcccccttaagtaattcccctaggattgcgcgcgtgtacgtggggttcaccaacccttgcaacccacgggccgtgccatttagggcgcttcaaacacccacgcattaatcgcgacactt

SEQ ID NO: 586521 - DNA, 420 bp, Homo sapiens
cttgattggggtatcgattcttctgcatgcaaaggtcatgaaaatcgagatattgttgtcgatagcttgatgctgctgcaatttgatcgtccgcctggatgtcttacgagtggttcgcatttctcatacagcttcaacaattcatcgcttagagctaagaagaaaataataattaattggccactttaaaaaaggaaaaagtaaatttctcctttaattacctctaggaatgacttgatcgttatcgccgataatatgcaaagtaggcatactaattattttctgataggcaaagttatgaggactttggtgacttttaaagccagcaataaggatagcaaatttcaccgtaggttcaaaatctaaatcatgaaaaagaaagaagaaaagaatgaaaattagttaatgatccgtgtaatt

SEQ ID NO: 586522 - DNA, 368 bp, Homo sapiens
  misc_feature (279)..(279): n is a, c, g, or t
  misc_feature (334)..(334): n is a, c, g, or t
  misc_feature (343)..(343): n is a, c, g, or t
  misc_feature (363)..(363): n is a, c, g, or t
actacactttaagaggctgaggtgggaggattgcttatacctaggagtctgaaggcagcctgggcaacacaatgagactaaatataataatgatgaaaataattaaaagatcatactctcataatccagaaactcaagaaatacccaaactgatcaagaagaaacagaaaatctgaattgacttataagaagatgaatcaaaaccctcttcaacaaagaggaccaaaacaaaatagttttcactggattaaatttttacttaaacattttaaaaaaggntttaacattgggctggggcggcagtgggcttcacggcttgccaatttcccggcantttgggggngggcccagggccgggtgggntccac

SEQ ID NO: 586523 - DNA, 326 bp, Homo sapiens
tcgactctagaggatccagttccttaccagcctccctttctctgtcagtgggggacgttatcagccaagcgggaagccatttattgaactatttcgtttggaccacttttttaccaagcccctagtcttagagataccctctgagatagagagccaagctattgtggtagtgaaaattcgaggaagcaccttctcagcccctcagagattgatcaccctgaatttcattgtctcagtgaaggaagaccctgtagaagattacctcgttccggagctgggtatctcaaatctgctttcatccagccacggcccaaaggggtaccgag

SEQ ID NO: 586524 - DNA, 507 bp, Homo sapiens
tgatctagaggatccaaagtcgatcttcctgaggaaaaaaaatgaatggaaaggcaagtatgaaatgggaataaatatattcaaatcattcatttagataagaggtggaagaggagttgtaagaagagatttctcccaagagaaaaattggattgggccagagggattattgagaagatgttcaagatcacttattttacagggaatgcatatgaaggcagaatgaagtaccatcttttccacgtaggatgggcgctactgtgaaaacagagaaatataccggggttggccagggtgttaagaaattagaatacttgtgcactgtcataggggatacaaaatggtagaactggcaagggaaaacactatgaacattcctcaaaaattaaaactagaattaccataggattcagcaatcccatttctgggtatatatccataggaaatgcgatcagtatctcacataaatatttgtacccccacgttcaatgaagcattactcagtcg

SEQ ID NO: 586525 - DNA, 514 bp, Homo sapiens
tcgatagagctaggtgggaggtcatgcctattatcccagcaccttgggaggcaatgagagtggatcagttgaggccaggagctggagacggtctcacgggggcgtgtgaagaggccaccaaacaggcttggtatgagcaacatggctgtttatttcacctgagtgcaggcgggctgagtccaaaaaaggagtcagcaaagggtggtggattatcattagttcttacaggtttggggataggtggtggagtttggagcaatgttttgcgggcaggggtggatctcacaaagtacattctcaagggtggggagaattaaaaagaaccttcttaagggtgggaggattacaaagtacattgatcagttagggtggggcagtaacatatcacaatggtgcaatgtcatcagttaaggctattttcacttctgtggatcttcagtaacttcaggccatctggatgtatatgtgcaggtcactgggatatgatggcttaacttgagctcagtcgaacgga

SEQ ID NO: 586526 - DNA, 1103 bp, Homo sapiens
ggtctgggcacagcgccccaagtcccatgagtgtggacagaccaatcagcatagactgtgaggtacatgcagcgacccagaatcatggctacggtccgttacggaagcatgcgcctgaggaatattagtgaatgacacggtgtgatgcatgtaacagcgacgatgaagcataaataaataggacatgattgtggtctcctaggcttgacgaaggtggaaagtatctccagtctgacctccgttttccgggcaggagatggcaccatagtgtaaagtagggccatcatgccatggtgtactcggtaagggcatgcaggacattctcgactgctagtcgcgtaccgcgttgtgggacttggagattgttggatgttcgtgctatgatctgtaatgacctcttctgtcatacctaggaccgacctcaaagtactgctgtgtggctagagacacccatcgtgaatgggaagcacgctacaaaacgaggggcgccttgctaagtctcatgctctatgaaaccactatgtagaggaggcagccttcttggtatagaggcatcatgaagacctgctcgcctgactgagatgagagtgagtattacttgcctttcctgaggattcagggtgactgtttctcactgtgcggaccatgacctgcatggtcaattgggctgtgctggcttctggcacgtgtgatgagccagtccgcgaagtgtaaggatatccataacaatctgagatcaatccgcgtgatgataatggggcggcctcgttggtggcaattccatttgttgaaccgaagcttgctggatcaagtgcctgcaatctataccgttttggagattgactcgtgtgcgacatgactgatcgtcattgcttcaagccgataagcagatagcccagcagagagcgcctcaaagtgcagagtgcgctctgcgggtaagaatggcccgcctcacgatgcgatgaaaggggtcagcctgcccggaggtgtgggctcgactagggggttgttcctagcttaggtagcccggagtgggacctggagccattaggcgatcccacacacgagggctgagagagagccaagggcagttcaatccacag

SEQ ID NO: 586527 - DNA, 295 bp, Homo sapiens
atgcatgtggcacttaggtccaaggtctccagaggtgatgaaagcgtggagtctgtcaatgtcctactgagacagcacagactcacctggctagcaacattagtttcagtctgaacaatatatacttattgaattcagtcccagatacacaatctgaaacagcttcatgtgggtggactctaacatgtagttgcaatgtttcagaattgagacttacttctctgctatctagatctgaactccttggctacgtttacttaagttcaagcccccatgcctagggaaaggccaagtt

SEQ ID NO: 586528 - DNA, 150 bp, Homo sapiens
cattctctctgaaggtcgactggtcgatagccagggatatggtgttgctggcgtcaactactacaccaattcaggccgtgggtgacaggggaaaatggtgaattttcctttagctggggcgaaaccatctcctttggtatcgaaaccttt

SEQ ID NO: 586529 - DNA, 430 bp, Homo sapiens
cctagtcccagagtgttggcagtgtcccggacaaaaaccatgttttcctacccctttggccctcaaattcttgggtcctgtttcccccccccccccccccaggaggaagcctgggaagggccccgtgatttttggcccatgttttttgcttacccccccccatttttgtgaaagggttggcccgggccagcgtctctttaaattttgcctggccctttttgggaaatcccccctttcccccttgaaagcttttttccccccctttggaggagcctttggagtcctcctttttttggtcccggtcctttcccccctcagacttggccccccccctgattcccccccttggggaaaggcttggcccccccccggctttccaaaagtccccctttttccataaattaataaaccaccccttttttttttccca

SEQ ID NO: 586530 - DNA, 803 bp, Homo sapiens
  misc_feature (156)..(156): n is a, c, g, or t
  misc_feature (178)..(178): n is a, c, g, or t
  misc_feature (186)..(186): n is a, c, g, or t
  misc_feature (203)..(203): n is a, c, g, or t
  misc_feature (208)..(208): n is a, c, g, or t
  misc_feature (217)..(217): n is a, c, g, or t
  misc_feature (223)..(224): n is a, c, g, or t
  misc_feature (241)..(241): n is a, c, g, or t
  misc_feature (247)..(247): n is a, c, g, or t
  misc_feature (250)..(250): n is a, c, g, or t
  misc_feature (253)..(253): n is a, c, g, or t
  misc_feature (260)..(260): n is a, c, g, or t
  misc_feature (265)..(265): n is a, c, g, or t
  misc_feature (283)..(283): n is a, c, g, or t
  misc_feature (312)..(312): n is a, c, g, or t
  misc_feature (318)..(318): n is a, c, g, or t
  misc_feature (322)..(322): n is a, c, g, or t
  misc_feature (325)..(325): n is a, c, g, or t
  misc_feature (332)..(332): n is a, c, g, or t
  misc_feature (335)..(335): n is a, c, g, or t
  misc_feature (349)..(349): n is a, c, g, or t
  misc_feature (352)..(352): n is a, c, g, or t
  misc_feature (355)..(355): n is a, c, g, or t
  misc_feature (375)..(375): n is a, c, g, or t
  misc_feature (381)..(381): n is a, c, g, or t
  misc_feature (397)..(397): n is a, c, g, or t
  misc_feature (405)..(405): n is a, c, g, or t
  misc_feature (419)..(419): n is a, c, g, or t
  misc_feature (450)..(450): n is a, c, g, or t
  misc_feature (457)..(457): n is a, c, g, or t
  misc_feature (464)..(464): n is a, c, g, or t
  misc_feature (476)..(476): n is a, c, g, or t
  misc_feature (501)..(501): n is a, c, g, or t
  misc_feature (516)..(516): n is a, c, g, or t
  misc_feature (521)..(521): n is a, c, g, or t
  misc_feature (529)..(529): n is a, c, g, or t
  misc_feature (777)..(777): n is a, c, g, or t
  misc_feature (784)..(784): n is a, c, g, or t
gccatacctgcgaattttaaatttgtatagaaatgggttccccctgtgacccaggtggtctcggtgttcctgccctcatgatccacaagactgggtaatctgtaaagaaaagaggtttaattggctcatggctctgcaggctttacagaagcatgnactggcatctgcttggtttctngggagccncccgaagcttatagtcntgacngaaggtgangggggnnaggcacatcacatgacnaaagcnggnacnagactcngagcnagaagtcacttatcaccnaggggatggcccagccattcatgaggganccaccnttgngcnccaaacnccncccaccaggccccnccnccngtattggggattacatttcnacttgnggtttgggcgggaacnaatagtcnaattatattacccntctacatggttttctttttcttagtatgggngtgtccntgaatanattcatgggcancctcataactcttccatgaatggcnaggggtacttatggnaaacngttttccnaagatctgattgttttgaaatgtgttagattggacttgttccaatgttcatatttttgttctatgctaaatgcatcgttaggggagtagtggtaaatattcccgaatccatatgaaattcatgagtttatttatgtctaaaacactgaaaactgtgtcccatatcgttcagtttcctgggtctttttcttattagcacatttgagaaaaatattcctttcctttattgtagtaaatctattaaaggcnatagccnataaacatttttaatttta

SEQ ID NO: 586531 - DNA, 963 bp, Homo sapiens
  misc_feature (273)..(273): n is a, c, g, or t
aaggcacatggagcgcaagtaggtctacaagaagcgacttcccgctatcatcagaagagtctgatcgacctttcagtgatcacgcccgtctatagatcactgtgtcccttatcgtgcatgcccctacgtcctgctatgccgcgtgtttcctaaggatctcgaggagacaataactagactaagtactaaagcgatctctgacgcgttcaggaacgtagacaggaccgtactggagaactattagctgaccccggccgaatcgtatcgctcagntctctctatctgcctcatacgcacagttccgctagcggcagtcgcggtttaacggattaaccagagcgatggatcgaactgaatcgccgttaccgcgtgtagccatgtcaagagtcaaatgtggcgcgaccaaaagtgggtatctagagaggctatcgatgtacggcgcgagcgtagcggcgagagctacatgcttgcagactgcgctacagtaggctttcctacacgagtatagttccgtagcaacccagggcggaacttgcgaacgtccttggacgtttgagcacatctgagtcagtgtactccggcgatttggaagacctcccaattctggtactagatagattaacattcacgaagaacggtgcttgcacctcgatgaagcttgtgcgcccagcgatttaaggcgctagaaagaacaggattgcagattcccagcgaccgtcataagagcacaaccacttttcacgcggctaagacggaaccggggggatatacgtacgggtccaactggctcatgaaaattcttgtgagaagcaatagcgacagtttcattgcgccatcgtgcctacgacattaagtttccccttaaacaatgcttttgaacataggggccccgtaatttacgcctaatagcaacccccgtatagcgccgtactagaagaccaaaaaaacaaaagcaagaatcca

SEQ ID NO: 586532 - DNA, 191 bp, Homo sapiens
tgcgtatcaaaacaaccaaccaaccaaatggaagcaatgtgataatatagtattgacaaggaattgggttgtgtgtgtatatatatatacacatatatacgtatatatatacatatatatacacatatatacgtatatatatacgtatatatacacatatatatgtatatatacatatatatatatataaa

SEQ ID NO: 586533 - DNA, 439 bp, Homo sapiens
aaccaaaagggagaggtcagtggtcatgcagcaccccttggactgtggaaatgtgcagaaatgagggcaagtcataaagcagaagtgacttactcgcatcatcagagtctcttcggacgaacggtcgctctctaccgcacagaacgtattactcatgcccccgattacctggtaacaagttgctggatgggacgcaatgactgggactcccagccacaccgtacaacactttttctttacatcagtgaagatgtctacctcgtctagtggcccatctgaagaaagggtcacgtgacaacaggaaagacgttgttaagaagaaccaagtcccaaaatcctttactgcaagatgacactgtaacataactgccattccaaaatgttccctctgcctcaagaaaatgcttgatcggcttcctacaacctaaacaattacatt

SEQ ID NO: 586534 - DNA, 167 bp, Homo sapiens
cagccggaccgtcactcagccgggcacagagcaagagtcgtctcaaaaaaaaaaagaaattgaatactttgatatttggccaggaccctgccttccctcatctcccaactttctgcatgcccgtagctctctagtttacttcctggacacggggattaggtcatctg

SEQ ID NO: 586535 - DNA, 325 bp, Homo sapiens
  misc_feature (9)..(9): n is a, c, g, or t
  misc_feature (19)..(19): n is a, c, g, or t
  misc_feature (198)..(198): n is a, c, g, or t
  misc_feature (285)..(285): n is a, c, g, or t
  misc_feature (320)..(321): n is a, c, g, or t
tgttctagnggatcccgtnggtcgatcactgtactatgattggactgactgaagtatgggcctgtgaatatagattgaaaaataaaaaagaaatgctaaaaaaaaaaacttagctacattaatgtttaattatcaaaactcatccagatcaatccaatttttaaaggaaactggatggaaaaatgcttcccctaaacntgaactatggttagataagctttgtctggtcaggaaaattcaccaatttcagttagctgatctttatgtcggaaacaaacaataggngctttggtcctaattcataagttacagtgatcgannccaa

SEQ ID NO: 586536 - DNA, 438 bp, Homo sapiens
gccaccaggcgcacttctggctgtgcccatagtgctgtctcaccctgggcatacacctgttaccagcttggtcctgggcccccagtggtgggcggctgctctcagcttcacccgtggatgctgctatccgggtatgggatgtctcatcagagacctgtgtcccccttccctcctctcgaggaggtggggtgaccaacctgctctggtccccagcacggtcagcaaaatcctggtctatccactccttcagctgtctttcgagtctgggaggcccagatgtggacttgtgagaacgtgcgcctgggtgcgcaccccaggcgctcttctctgccatgggggatgatcaggctcgtgtctgactgctgaaacgggcacgagcctattactaccgtatcagcaagtacacttcgtttatcacctgccttttaccatgctctt

SEQ ID NO: 586537 - DNA, 955 bp, Homo sapiens
cagggttccatattgggactccacagggtgccgtggggaaatagtgtgacggcggcgttttgttcagctagacttttacatggggtagtgcccgcccaagcgggtttcaccgtgccttatatagaactagctgtgggaaccaccatgggggggcactatatagtcgcgctgtttgggcaacaccaccctgggaatatttgggtcccaacctgctgggggtgtccgccggtgcccgcgccttggggaacatttggtgaaaatgccttcgggcccccaccagactcaatacgccctgcctaaggacccgggggtgcggctcgtttgcaacccgcgccgcggtgatgttggttgccacgccccccgcggggtgtccgcggcgcccccttcccccccgcgctttgttggcgcggtctcactcgacgtgctcctggctgctttgccggaaattacggcgggcccccgacagggccccccgcggcggagcttcgctgggttgggacctcccccccttctgcgggcgagagcgaggaagccgttttcctcctcagaaaaaagatcatcatctatgttcccggagacttaatgagtttgggaaaaacgtcggccgccccattacagggccgccccccgggttgccccacgtcaacgctggagtgcgcgccttgaccaccccggtggccacccgcccttcggattactatgcttggttctctcccctcgctgcgttcctgtcggtgtcaagagccacgaatccatagggcgggtgtacaacaacccacttcgcccctgtcgtaactgtatgcgtggcccgacgcagagttgggtactggtttgggattctatgtgtggggtgcgtatgatgtatatgttttatggggagacaagatgcgttcaggaagatcaaacgaccagccaccaaaaaaaaattaaccccttttaaacaacaaacaaaaca

SEQ ID NO: 586538 - DNA, 158 bp, Homo sapiens
gtgcccacttattacatccatgttgattccttgggctgtgatgggcttatgttctctcctgagaagcccactgaggctggggaagcatagcaccgttccatgatggagtaaatggaacggggtggggaccgcagggttggaaccgctgtagaaggcac

SEQ ID NO: 586539 - DNA, 848 bp, Homo sapiens
  misc_feature (360)..(360): n is a, c, g, or t
ttccttgagacgatagcagcggtaatatggtactacgggaccgcccggtgccctgttctgtggtggcgccctgggcgacatgctcttgagaatatagtccccggcccctgtgtgaaccccgatgtccaaatatttgagacgcttcgaggaaaaatattatgtccacggtcaataatgggagacaacggggcgcctcccgcgtctttagcgtccccgttagccgcaccagagatacccgcgtgcggcgcccacttccgacttcttttaagaggaccccgcgttagtcgcagatagcgaagggcccgcagcccgcccaaagccccctggggacaaaaggcaccaagggggacaaccttctcnaactctccgcgagcacacgttcgcgcgagacaagtaacccaacggggtcaagtgtcggcaaagctcccggctgtgacgaccggaggcgacgccccccgtccgtaggggagacaaaaaaacagggaagacattattaaacaagggggaagcgaggacagctcggaacataacaaatgccgtacaactcccgggagaaacacgctggaggagaggctctccgaaaaaacccagaagcgccccttcagggcacaagttctccccggaagcggatcgccacaacaacttccccaccatagggtaaggggggaggtagaaactccccaagatagtgcgacaggtgtgacaaaccgagctgccgcccgccaacaagagcaccgacaaaggaaaagacaaccggctatagtctgcccgcccaaacggggaagtttaaaggataaaggttttttgagaaaaaatttttttacaaaaaagaggtaaaaaaacaaaac

SEQ ID NO: 586540 - DNA, 360 bp, Homo sapiens
  misc_feature (130)..(130): n is a, c, g, or t
  misc_feature (150)..(150): n is a, c, g, or t
  misc_feature (169)..(169): n is a, c, g, or t
  misc_feature (190)..(190): n is a, c, g, or t
  misc_feature (228)..(228): n is a, c, g, or t
  misc_feature (318)..(318): n is a, c, g, or t
  misc_feature (342)..(342): n is a, c, g, or t
  misc_feature (355)..(355): n is a, c, g, or t
tggagatcaaatgccttcatacatgtacagcacctagattactgactgacacctaaataatcaataattaccagttgttaatataccatcctattctttacacggatgcccgagtatccactttatagancgagaacaaaaaagaaatcncatactgtataaatgattncgtcccaaaccacaaggctcnacaaagtcagagatggacctcatgcctggtcaaggtgngtagggtgagtggaggagaggatggaactcagtttccaccaggtgagctccactaacactttacctgcaggagccagtttgggagagagngaaagtttatttggaccaagggancagtgggctatgnaaacc

SEQ ID NO: 586541 - DNA, 1060 bp, Homo sapiens
attcataagccacctgaactttgagtggggtccaaaccaacacagagggagatgctttggtaaaggacagaagccttactggcacaatatgtttacacataacctcttactttatcattacgccggtcacccaaaccctactacctgaccctaggacgtgacttctacgaaaagccaacgcttaaacacactaaaaacttgacggacacaaagtaaacaaaacagaaagaacaacctaaaccagagacatcagtggtcatacactattgcgcaagactcatagacaatagtccagcgcacagtctcgtcaaacaaacagcaaccacaataatctggcgcaggtgtcaggcagtcagcaatctcgcagtcgtccatattcatggcaccaatgtccgacatttccaacacacaagttttcgcagctcatgctacaagaaaccagcactgcaaaacaaaagcctcaggggcactcatcaacggagactaacaatgacacagacacataccaatgcaaaacataacttcctaccacactgattctgtatttaaacatacaaccagctatacacgacacactatgggagagtgcaagaaacttctacaatatacggctacactagctcacactccccagacatcgtccacacgcttaacatctactcgcacaagctgctaaactaccatcagatggcatcattctcgcgacaaatggcccttgtccattaaaggaacatgcattgcctcggaacctaacgacacggccacaccccgcacgacgcacctcacgaccacaaagcacgacagccagctggcagaccaccatgattgacacaaaggtaaaaccaccacggagcccctacaaggggcacacaacacggcaccctggctccacccaatcgaccgcactacaccggcacgtgcctggaactatccagaccaccacacacctcgcacccaacccccgccaacgcgggacacacgacacgcccgaagcacacactccaacacggacaacagaaacaacgaacacacaagcacgccgaccaccacacacacggcc

SEQ ID NO: 586542 - DNA, 82 bp, Homo sapiens
aaatccatggggagtgctgatgcttatccagtctgggcttgctcatatatctgtcatcagctgtcgaatcagcctggcaaag

SEQ ID NO: 586543 - DNA, 287 bp, Homo sapiens
gatgcgcagtgccttggcacgatgcgggtagactaccagcaggtgccgctcacggcgctgaagacctctaacaaccggctcctcaacaagaggagacccaagcaagcaggcagctcctctgcctcagaggactgcaataaccagtagctcatggggccatggcggagccctgtaaggcagagtccaggagggcccagggtcattcttttcacaaaaggcacttctgtggtgtcaacatttgtcactcggaccttcaggatggaggaccctgaccataagcctcctga

SEQ ID NO: 586544 - DNA, 80 bp, Homo sapiens
gacagcagcttctacatctgcagtgccggacagggtgatcagccccagcattttggtgatgggactcgactctccatcct

SEQ ID NO: 586545 - DNA, 501 bp, Homo sapiens
ggtctactggtgtgacaacgactgtctctttttagaaacaactgctgagagacttcgccactaccaagctaccacaacaagaactgctaaacgggctgtaaatctcggaaccactcctggacacacatcaaaacagaacctctttacagcataactctcacaggacctatagaacaaaaatacgatttcaaaagcacgaacaaaaaaccaaggtacacaggcgacaaatagcatgatgaatggaatggtacatcacatctcaatagtaacatggacagtaaatggcctaagtgctccacttactggatacagaattgcagaatggataagaactcaccaatgaattatcggctagcttcaggagactcacgtaacacataaggactcagataaagtgcaagtaaaggcgtggcacgcgtcatttcatgcaaatggataccaaaagcaagcagaggtagctattcttacatcagaccaaacaatctttaatgccaatagccg

SEQ ID NO: 586546 - DNA, 388 bp, Homo sapiens
ccccagctgtccagagtagccatgcatcatgcatgtattttgtcccattaattaattcaacagatatttattggtatacttaccatatgccagattgttctaggttctggaatatagcagtgaaaaaaaaaaacagtcctgggatcttatatacgggggggaaataaacatatatggtagaaaattagagggtaaggggtggtgagcacatatattaattatttctcatcatttctggagacaggagaggggtattcgggctgggggactcacatgaggtcacagttacatgtgggtatgggttgggtcatatgaaggctgggggggggcgggaggatccacggggagagggctcaatccctactcgggaaagggggggtaccgagct

SEQ ID NO: 586547 - DNA, 192 bp, Homo sapiens
acagatgagctcggtaccgcacttcctgcatcacccttacaccttaaaaaacagctccggcggctcaacacttcacacttgtagtcccagcactttgggaaggcgaggcagacggatcacctgagttcaggagtttgagaccagcctggccaacatagtgaaacgtcatctctactaaaaatacaaaattag

SEQ ID NO: 586548 - DNA, 190 bp, Homo sapiens
acatctaaagcaatcgactagaactgaattatcttctacatagataaaatcacaattgtaggaatatacaggaattctaggcgcatattaacggtgaacataacaacaacacaaacaggccctcattttaacagattgatagtgaccagtaagtatttaataagacacctagtaactatcatataaagga

SEQ ID NO: 586549 - DNA, 334 bp, Homo sapiens
ttatatggaacagtaagggagcagagtggttaaggacttcaggaacttaactattctaggaataaggaatgaatcaactagacctatgggccggcaggtaatttaacataaatagtaacttgcctttctcacccagttaatcagtctctgtacttgtatccctttttgaaacaagtgtacttggttaactaattctgtattatggttagtgctaaattcatagcaggtgccttatactttgcttataagtcaaaccattccatatcagaatttaccttggttatactatagatatttggctttaagttgttctttgtgttttttaatgtacaat

SEQ ID NO: 586550 - DNA, 237 bp, Homo sapiens
  misc_feature (13)..(13): n is a, c, g, or t
  misc_feature (59)..(59): n is a, c, g, or t
  misc_feature (79)..(79): n is a, c, g, or t
  misc_feature (90)..(90): n is a, c, g, or t
  misc_feature (169)..(169): n is a, c, g, or t
catcacactgaangaggcaaatgaaattctgcagcgcacaaggaagggaaagttgcccntgtaatgaagatgatgagcntgtggccatcntgcccggacagacctgaagaagaatcggactacccattagcctccaaagatgccaagcagctgctgtgtggggcagccntggcactcatgaggatgactataggctggacttgctcgcccagctggtgtggatgtagtggttttggc

SEQ ID NO: 586551 - DNA, 382 bp, Homo sapiens
ggcccgaccacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtgaact

SEQ ID NO: 586552 - DNA, 149 bp, Homo sapiens
gtcctctgcggatcctttgcatggctggcggagtgcatggctgtcggagtcatggctggccggagtgcatggctggcggagtgcatggctgggcggagtgcagtggctgggcttggctgggtctagagagctttgttatttttattttt

SEQ ID NO: 586553 - DNA, 176 bp, Homo sapiens
atataatggacttagcttcctgttccacagcttatgaaacctcacagtatctatgctacagctagactccaaaagatgtactttgagttagatctagacccagatccaggaccactaaacagcctgctccttttcacctgctggggcagatgtggcttgggttttagaattagttg

SEQ ID NO: 586554 - DNA, 593 bp, Homo sapiens
cccagtgacaatttgaaaaattaagaaagttatcccatttacaaaagctccaagaatataaacaccttataatgcaaatgataaaatatgaagaaagaaatcaaagaggacacaaccaaagggaaagatgtcccatgatcatgtattgggagaattaatattgttgaagtgttcatactgcccaaagtgatctacagattcaatgcaatccctctcaaaataccaatgacattctttacagaatagaagaaaaattctaaaatttgtatggacccacaaaagactctgaatagtcaaaagaattgtgagcaaaataacacagttgagggcatcacactttttgacttcaaaatatattacaaagtcataataaccagaacagcatggtactggcataaaaatggacacatagaccaatggaacagaatagagaactcagaaataaatccatacatttacagccaatttattttcaacaaagcctccagaaacatacactgtggaaaggacagcctctttaatacacgatactggggaaactgtatatccatatgcagaagaatgaaactagatccctatctctcaccatatac

SEQ ID NO: 586555 - DNA, 166 bp, Homo sapiens
accagaacttggcactctttgccagtgagttacttaattccaatcctgtgtatcaaatttctgaattaagctttctgaatatcacgggttactacaactggccttaagccaaaagtctgataacctaggctgggaaccatgtaacccaggccaagaaggtccgttg

SEQ ID NO: 586556 - DNA, 114 bp, Homo sapiens
gtcatgagcattctgtattccagttactcaggaggatgaggcagaacggatcactttagcctgggagacggaggttgcatgtgagctgagactgtgtcactggacgctagcctg

SEQ ID NO: 586557 - DNA, 524 bp, Homo sapiens
gcagatgtcctcagtgggggtgtatcgctctccagaacggacaaatcgcgaggtctgtagtagaacgctgtcagattatgaattcgcattgaatctacataagtcaaagtcgaacgaagcgaagtcagaacacaggatggcgattgtgaacatatgcctggttgaaggatacaaggggggattgtcaagagtcaagcgtaggatgcaagcttggagaggcgatggtaaaacatgggtgagatgggtcacaattgcttcaaagagaataaaatacctaggaatccaacttacaagggacgtgaaggacctcttcaaggagaactacaaaccactgctcaaggaaataaaagaggattcaaacaaatggaagaacattccatgctcctgggtgggaagaatcaatatcgtgaaaatggccatactgcccaaggtaatttatacattcaatgccatccccatcaagctaccaatgactttcttcacagaattggaaaaaaaactactttaaagttcatatggaacca

SEQ ID NO: 586558 - DNA, 833 bp, Homo sapiens
gggcttctttgctagagaatgatgagactaaggccctcagtccagcttccttgcagaaggaattaagagcaatgtagttgaaattgtaattcctgatttgtggctggaaggagcattgagtctcagctacttaagacaactctcgcgctgtccaacgatgtttatcaggttcaaacacacaggtactcctccatgaatgtatgagtcggtctgagttcttacacggagtccgacaagcaaagagtaactggaggagagagggcgtatggcgaggagacttgagactacgccgtctctgacatcttgaccggcctgacactagccgcttctggtcgactatcaacagagcagagcgtcgccgctgcagagaggcaattacggatatgcccagcgagtccagacgatgcacgtagtgtactccatgcacatgtttgcagctggcattatagtgtagctgagggcagaaagaagatccagatacgctatgttactgctggaagcattctagtgaagaaggcaggacatatgagagttaccgatacctcgactccctgggaatacagtccctaggtacaagagagagctagcagctgggaagacggcaaacaagctgatggatgccataaaggactccgagctcctgaacaggaaacacagcctgtcagagcacatcgatatcagcgatcgcacagaaaacggccatctggcaggctgcactggccgaaggaccatgggcactgcaacaggcccagatgaagctgagcacgaacagactggaggcgggaatgcggacagtaaacagaacaaaacagaaccctaagcagacaaccctg

SEQ ID NO: 586559 - DNA, 1090 bp, Homo sapiens
agcgggaggccgaagctagtgctcaggctgtcaacatcgaataggccgcgaaggtcccttcgccctattcttcactagtccgaatacccggataactcattataactaacacgaccgggtcagcatctataaatcattcgcataggaaacgaccattactagaatgacagctcgtcaccacggtacatgtactgagcagcaggactatatttgtaggtcagcctggtgagcacctacgttcataaccatcccgggtatctatatttgaaattcggagatagggcaataaccccgcgaaaattcggactgaccgtaaccagccgtctgtaatgacctcacgtatgcaaaaataacatttaccgtagacatgtcagcctagatcaatataccttaggatgagatactgtgcgtcgaataccacacttaacaggtactgcacagctactttcccttccttgaaaagactaaatgaagaaacaaaagaaaaagacgacaccagaatgaatatccaatgatttggcgaaacgcgagatggaaattttcccctggaccaacaggatatgggaggccacagtgtacaccatctataagggggagagcggtgccactgtgcgtgggacattggctataagtgtgacctctcatgtaacaattgcgagaaggggttttaaggccttttgcaaatgggttcttaggcgagtggcaaaaagaaacgttggtgtggcacacaaaagttgattggtattcccacagtggggtggggaaaaaaaacttgcgctttgaaagcggaggactataccgacagaaggaaaccatatacaatatatttacaagaagaaaaaattatgaacttttttacctgtggcaaaggaaaggaaggggacacggcccccaaagggtatacggcaaagatcgaacgaaacccaacgtggggtggttggacgacgcacgggaaacgttggacagaattggttttggttgggcctttggaaccaacttggttaaacacacttggttaaaaggcgagattgtggtgttcccaaaaattatcttaagttttggcaacttggcttcttggtttttaattaaa

SEQ ID NO: 586560 - DNA, 611 bp, Homo sapiens
agggagtgccagaacgccgaggaatccacagtgctctgtatctccacgtctccgcgcctccacccatctcaggaacccgcgaaccctctcttgagcactatgagcctcccgtccagccgctcggccgtgtccgggtccttcgggcgtccttgtgctgcgctgctcgggctgctgctcctgctgacgccgccggggcccctcgccagcggtgatgagctcctggacactaggggtgcactcccaggccgtctgcggggccgctgcgttccagtggagactctcccagtcaacctgccctagtaaaaatgtctttcttccccagctggtcctgtctctgctggtgctgacaagagcttggcgtttgccaccttttgctttatttaacccgggcgttttaccggccttgatggagggtaaaacccccaaaaaccgagttggtaacactgcatgtgtgttcccctgcaggcccagcagtgctccaaggtggaagtggtagcctcgcctgaaaggaaaaccgggggggaaaaggccaaaacgggtttatgctcttgggaccctggaaagccccttttctaacagaaagtcactccagaaaattttggacacggtaa

SEQ ID NO: 586561 - DNA, 169 bp, Homo sapiens
cgtcacacgcttctcttctaggagttcagatgtctatcccttggacccactctggagcccctcaagccctgcggcgtgctcccgctcgacctcgactgcacttagtgctacgtgccatccagtgtctgtgcaccctatgctactgtcgggacaatggtgggtgtgcagt

SEQ ID NO: 586562 - DNA, 901 bp, Homo sapiens
  misc_feature (828)..(828): n is a, c, g, or t
ggcagtggctcacacctgtaaccccagcacttgggaggccaaggcgggcggatcacttgagctcaggagttcaagaccagcctgccaacatggtgaaaccctgtctctactaaaaatacaaaaattagctgggcatggtagtagtcccagctgtagtcccagctattcaggaggctgaggcacaagaatcccttgaacctaggactggaggttgcagtgagctgagatcatgccactgcatttccagcctaggtgacagagctagattctgtttaaaaaatactgctttaatagtatgtatcggccaagaaaaaatgcaaaatattagggaaacagatctaacaaaaatataagacgcagttgatgtttggctcttagatttgtttatagcctaagtaaggatggcttgcttaaagggaaacgtgtgccgtttgataaggttattagaagatagccaaggtccttgtaatagtaagtggataataagagaaggtgaattcactgtatgtcatatactatagtaaataaactgtagggctctggtatgaatagatgtattaatgtattctagagatggaggagagtttgcgtgagccaagatgtgcacaaggcactcaagactgcgaaccagagtggactccatctaaaacaacaaactacagaagaaatcctggttggaaggtcgtggtattaacaacacagcacacacaacctcagtggtgctggcagcccgcaccatgtttaaaacggtacgggcggcagggcccaaggatccccacttggacacaggggcaccacagccgtacagagcgcacaggaacgttcaanacacaagggggagtgacacgagccgtgacgaaacccgcggaagcgtccccgactatgagtgaatgtcgggggc

SEQ ID NO: 586563 - DNA, 675 bp, Homo sapiens
cgaagtctagaaatagtgtatgtatataggtatattataattaacatattatacacgaggcactcatactatgacaccctgcaaatattagtacgccttaatccattattacatgtattttggaactggtagatcatcacaggaacaaacttgatatatttatagcattgtatcatagcattaacacttatggcagcaattttgaagaatgttaattaaagatacagactgcagttatttaccttctttagttgccttattatagcatataaatttccatgttgagtcttttgagattaagattatttccatattgaatatatgattatgctgcctattcacaaacatgtttgatttcttattacttcttaattcattcatatgacttgagctccaggtttcattattgtgtacccaactttgagataccaatagataaaacgtaataggatgaaagccaggggactggccttggtattcaacaagctcagtatttgtctgcagtatgtttctgacccttaatttctcagaagtacaaatattaggcaaacttcttagatttatactggattatcttgatgtctctacatatatgtttaaaaccatagtaacttagattttgtactagaaaatctctaactcttaaaagcagatatatttatagcttagtcacta

SEQ ID NO: 586564 - DNA, 865 bp, Homo sapiens
cacccttaaatttttagcggccttccctctaatccagattctccaccctgcccacttggcaccaccacccatacgctccgttctaggcacaggcttgacagacgtccccaacatctagcgtgtggagcgtgtttccattcttgagatcccattacatggcctgcccatcccttgcctccagaacacagtagggatccatctggagatgacagtcacccctgctcaagatttcctgtctgaccaatttgtttggtcttcagcttccacttacccagcttcccattcccctcgcatcaggtgtggtccccagcccaccaccgcagaacgaatgatcagcgctctgtctgcctcctgcgggcagagtacacccgcgtactacaaagacacccacttctgatgtggctctcagcgcttggacactctattgcacacacccagggtattccatagcttgatgcccctatctcgagatccagagacaatctacctgtttgtcagtatgtgtattatatggtgccacacctcacgcacactcccttggtatgtgcccactcctctcctcacctgttggtgcccgttttgagatccacagatgttcagggtcccatcccatgcgagcctgatgtagggccaacaacttgtgccattctgaggtagataaccaaccatcactaaccccccgggatgactcccagacacgctgaggaattccatagttggtaatcatccccttggtcagttgccacatgtatgatggtgcgttattctcgatagtcgtgtaagaggatcacgtttctgggaagggcggggtagtagccagataatgagaccaaccccaagcacaaatgtggaacgttatagatca

SEQ ID NO: 586565 - DNA, 595 bp, Homo sapiens
  misc_feature (309)..(309): n is a, c, g, or t
  misc_feature (336)..(336): n is a, c, g, or t
  misc_feature (343)..(343): n is a, c, g, or t
  misc_feature (351)..(351): n is a, c, g, or t
  misc_feature (353)..(353): n is a, c, g, or t
  misc_feature (360)..(360): n is a, c, g, or t
  misc_feature (367)..(367): n is a, c, g, or t
  misc_feature (369)..(369): n is a, c, g, or t
  misc_feature (371)..(371): n is a, c, g, or t
  misc_feature (373)..(373): n is a, c, g, or t
  misc_feature (384)..(384): n is a, c, g, or t
  misc_feature (386)..(387): n is a, c, g, or t
  misc_feature (392)..(392): n is a, c, g, or t
  misc_feature (396)..(396): n is a, c, g, or t
ccttacacagtacaccgcttctaatcctgtatctggtccatacaaagagtgtctgcatacaaagtaactcgaatagtattatagaagaatcccccccaagattgccccaacactgaactacagacaaacactattttatgttaaataacggagacagctttctaaaaagtatacattactcgtaataaaaagtagtttattatttctgaatagatttaataggttttctacacacatttacatacacaaacatgtaatattttaagcagtaagcatctagattctaagcagcacatcatagctattccntttcatagagccttcagagattcaatngctaaancaaatttncnttagttnggcatcnangncnctgatcacttnannaggcntttnaagaaattatttaaaagatgcaaatgcctctgagtgaagtgtactatcccatcactgaagcccacaggaacaagtcctacaattttaaaaaggctcgatggaaaaatttctcaatcctgaaatcccctagggaaggggtcaggagaaagtctggtgtttgaccacagctctcaaaaataagcactatccctacacagcg

SEQ ID NO: 586566 - DNA, 642 bp, Homo sapiens
  misc_feature (309)..(309): n is a, c, g, or t
  misc_feature (336)..(336): n is a, c, g, or t
  misc_feature (343)..(343): n is a, c, g, or t
  misc_feature (351)..(351): n is a, c, g, or t
  misc_feature (353)..(353): n is a, c, g, or t
  misc_feature (360)..(360): n is a, c, g, or t
  misc_feature (367)..(367): n is a, c, g, or t
  misc_feature (369)..(369): n is a, c, g, or t
  misc_feature (371)..(371): n is a, c, g, or t
  misc_feature (373)..(373): n is a, c, g, or t
  misc_feature (384)..(384): n is a, c, g, or t
  misc_feature (386)..(387): n is a, c, g, or t
  misc_feature (392)..(392): n is a, c, g, or t
  misc_feature (396)..(396): n is a, c, g, or t
ccttacacagtacaccgcttctaatcctgtatctggtccatacaaagagtgtctgcatacaaagtaactcgaatagtattatagaagaatcccccccaagattgccccaacactgaactacagacaaacactattttatgttaaataacggagacagctttctaaaaagtatacattactcgtaataaaaagtagtttattatttctgaatagatttaataggttttctacacacatttacatacacaaacatgtaatattttaagcagtaagcatctagattctaagcagcacatcatagctattccntttcatagagccttcagagattcaatngctaaancaaatttncnttagttnggcatcnangncnctgatcacttnannaggcntttnaagaaattatttaaaagatgcaaatgcctctgagtgaagtgtactatcccatcactgaagcccacaggaacaagtcctacaattttaaaaaggctcgatggaaaaatttctcaatcctgaaatcccctagggaaggggtcaggagaagagtgccatggttgatatttaatggagcgtgcagcagctgtgtgaaaagtaagcagctgatccctgaacatgcgatgactgcatgatgcaagtgtaaaa

SEQ ID NO: 586567 - DNA, 331 bp, Homo sapiens
ccagactgtcccatcagataccaacaagaagtcaattatagaaatccgctgatgggacgaagatgcgccagtcttctcccatcagcatagagaaataaaatgattaaaaatgttaaagtgagcatgggaactagtgtttgtggaatgagaaggtctaacatacatgtaataggagtttcagaagaacagaatagagggtggagaggtgcaatattcaaagcaggacactttgacaggtcatagtataactggagaataccaaaggcaaaaataaaaaaatcacagagcctgatgggagcaaggacgtgcggggggatccctctagacgtcg

SEQ ID NO: 586568 - DNA, 122 bp, Homo sapiens
ctcggtacttctctcctcccacctctcatactggacatgctagacaactctcccatttctcagattttatatccaattcaaaccaagactctgacagtttccctccaaaaaattattcagat

SEQ ID NO: 586569 - DNA, 358 bp, Homo sapiens
gtacaccgccataccccatacacaagaccccacagcaacaccacccatcaccgttcaccactcactgtcgtcaccaccatcatcaccatcaacttcaccactcactgtcgtcaccaccatcaccaccaccttcaccactcactgtcgtcaccaccatcatcaccaacaccttcaacacatcaatgacgacaccaacatcatcaccatcaccttcaccactcaatgtcgtcaccaccatcaccatcaccttcaccactcactgtcgtcacccaccatcatcaccaccaccttcaccactcactgtacgtcaccaccatcatcaccaccaccttcaacactcactgtcgtcaacacccat

SEQ ID NO: 586570 - DNA, 137 bp, Homo sapiens
  misc_feature (118)..(118): n is a, c, g, or t
  misc_feature (137)..(137): n is a, c, g, or t
atttggcagagggaaggttcagaaatgataaagactcgaaagacaagagatatctagcatgttgaaggaaacaaaagttccccaatactcttcttacgtatttttaccaatatattanaaagcttggggcgacttan

SEQ ID NO: 586571 - DNA, 831 bp, Homo sapiens
  misc_feature (521)..(521): n is a, c, g, or t
  misc_feature (528)..(528): n is a, c, g, or t
  misc_feature (534)..(534): n is a, c, g, or t
  misc_feature (538)..(538): n is a, c, g, or t
  misc_feature (830)..(830): n is a, c, g, or t
ctggcggggcggggcctgttgcggttctgtcttttttcttcttttcctcttccctcttcccctcccttggcttcctttcctctctgctgcccgtccgcctctggggttctgccttccctttcctccgcgggtctcccgtcccctgcccccgctctcccggcccttcggcccccgggcccctttctcccgtgccccttcccctccgcgccccccgcctgcttcctgcccgcctgtgcttgcggccgggcgccggggccgggccgcggtgcccttgccgttccggccttgcctctccccccggtggtgcgctggtggctctctggtgcgctcgtgtctcccccgcctgtctccccggcctcccctctgtccctttccgtgcgctccctttgctttttcctccccccccccgcccctcctccttttctttctgcttcccctgtgcctcgtgcctgcccctccctgtcctcgctggccggtccgccccggcttcccccccgcgccctggcccttcctggctgcgntccgcgntctggnctcntgattcgcctcccggcccctcctctggcctcccccccgcctcttctcccccccctgttgcctgcctccccgttctggccccccgcggcgggcgccgtcgggcgctgttcgtttccgccgcctccccctcccttgggggtttcccccttccgtcggcgcttgggggtggccgcgggcccgccggctgggccccctgcgccgccggtggtcctgcccccctccgctgggctcttgggcgcccttcggccggcggcgcggcccccctctggctcttgctggtgtggcccgttccnc

SEQ ID NO: 586572 - DNA, 337 bp, Homo sapiens
  misc_feature (215)..(215): n is a, c, g, or t
gatttgggggttttgtttggtccctgagagggttgtgtttagtttttgtttccttttgtttatggttgggcctttcctctttgtctttccaagtagaccagaaattgtcaagggcagccgagggctaaagggttaatggcccggcttgttaaacgggtattttgggaaacttaccttggatgggaaatcgaattgtggattcaccaggccggggntggcacactcaccctcgccctttccctccggttcaggacctattgtttctcctttcaaaaatgggattggactagctctttccaaatgaaagaattctccttatttaaataaaaaaagttta

SEQ ID NO: 586573 - DNA, 167 bp, Homo sapiens
  misc_feature (60)..(60): n is a, c, g, or t
ctcaggcagcgtttgaggcagaccagcaggtcctcctggggccttcctgccttttgaacntgcggtggcgcttggtgtgtcgggtggtgtcgggggtcgggttgtgggtggtctgggtggggcgcggtgtcggtgctgggtgtgggcgtcggtgggtgcttgggtgc

SEQ ID NO: 586574 - DNA, 920 bp, Homo sapiens
atgggcatgcagcgcaagtaggtctacaagacgctattcccctatcatagaagagcttatcacgctttcatgatcacgccctcataatcagtttccttatctgcttcctagtcctgtatgcccttttcctaacactcacaaaaaagtaactaatattaacatctcagacgctcaggaaatagaaagccgtgtgaacatatcctgcgccggcatcatcctaggtcctcataccgccgctcccatcccttaggcatcctttacataacagacgaggtcgaagatccctcccttagcatcaaatcaattggccaccaagtggttactgaacctacgagtacaccgagtaccggggaactaatcttcaagtcctacatagttcccccattatttcctagaaccaggcgaactgggagctccttgacgtgggacaatcgaggtagtactcccgatgaagccccattcgtataataattaccgtcacaagacgtcttgctctcatgagctgtccccacattaggcgtaaaaacagatgcatcccgcgacgttaaacaaaacactttcatctgcgacacgaccggggtatactacggcaatgctctgaatctgtggggcaagcccacagttttaatgccaatcggtccttgaattagttcccctacaaattttggaataggggcccggtgttatcctattaggaaccgttgtatctccttgagccataggaaagaccactacggattacaacacagagtcagattcacacacacaatttggtgcgcgggccgccacagaagatgcttaacaccattgggggcgcgccccagtgatagaaatgggataagggtccaccggaactggagcactacgggtgtgtctccacaacacacacggggcgcaggtcacaaccaacagatgcgtca

SEQ ID NO: 586575 - DNA, 146 bp, Homo sapiens
ttactacagctaaaagaagcgaaataagtaacaaaatatgtgaaagacggactctctggtgccaggatcttttaagtcgcccacactagcctttttctttcagaaatgtcaaactcagccctttggtaatagagcaaatgaacaga

SEQ ID NO: 586576 - DNA, 288 bp, Homo sapiens
  misc_feature (75)..(75): n is a, c, g, or t
  misc_feature (97)..(97): n is a, c, g, or t
  misc_feature (213)..(213): n is a, c, g, or t
  misc_feature (225)..(225): n is a, c, g, or t
  misc_feature (247)..(248): n is a, c, g, or t
  misc_feature (277)..(277): n is a, c, g, or t
gcccgcagaggaaagagcaggaggaatcccatcccccgggacaacccatgcttgcaagagacgaactccgcaccnaaccttcacgtgtctcccacgncctagttaatcaatttaaaatgaggtcactagggtgggccccaatccaatatgactgataactttataaaaaggagagatttggatacagaaagagacagagtgaaaaccatgtgnagaaacataggnaaagatggcagctacaagccannggagaagcttgcagtgtgtattcatctgntctcatgctgt

SEQ ID NO: 586577 - DNA, 651 bp, Homo sapiens
caggcagtgcgaactcagacgcctgaatgtagggacaatcgtttctagtgcctcgtactaacagtcagcctcgcatctgtcttctcaacgcttattcccatcagttgtctgacagttcatgcaggacttagcccccgtgtgccaccaatcgttcttcggtacttcacatgcagctctctcttctgccactggatacatgggttcaagtccatttgtgaagctgtcgatactgtaactggaaagctagtgtggtcaaagattccggctactgatttatgttgttaacagtgctgatctttacccggacaaatgaactgaagggtaatttactggaactctcgtgtacagcttcatcaactgtaaccatataaatataactggaatattccttaaacaaagaagaaagtaggggttttgatgtaagtgtaaagtgttatgactagccaacagagttgttactattttgattgtatggttggtattaacaaagagcctagctgactttccttctgtaaagtcctccttgtaggattttttaaagtactggacatatttgcaatcacattgtgatagattcgttaatggtagagatgatgtcatttgtcaggctacaacaatgaaatgcagattgccttgtttgtaatgtaaata

SEQ ID NO: 586578 - DNA, 763 bp, Homo sapiens
  misc_feature (19)..(19): n is a, c, g, or t
  misc_feature (88)..(88): n is a, c, g, or t
  misc_feature (150)..(150): n is a, c, g, or t
  misc_feature (163)..(163): n is a, c, g, or t
  misc_feature (215)..(215): n is a, c, g, or t
  misc_feature (260)..(260): n is a, c, g, or t
  misc_feature (262)..(262): n is a, c, g, or t
  misc_feature (265)..(265): n is a, c, g, or t
  misc_feature (269)..(269): n is a, c, g, or t
  misc_feature (314)..(314): n is a, c, g, or t
  misc_feature (329)..(329): n is a, c, g, or t
  misc_feature (333)..(333): n is a, c, g, or t
  misc_feature (344)..(345): n is a, c, g, or t
  misc_feature (351)..(351): n is a, c, g, or t
  misc_feature (380)..(380): n is a, c, g, or t
  misc_feature (387)..(387): n is a, c, g, or t
  misc_feature (397)..(397): n is a, c, g, or t
  misc_feature (401)..(401): n is a, c, g, or t
  misc_feature (404)..(404): n is a, c, g, or t
  misc_feature (410)..(410): n is a, c, g, or t
  misc_feature (412)..(412): n is a, c, g, or t
  misc_feature (431)..(431): n is a, c, g, or t
  misc_feature (438)..(438): n is a, c, g, or t
  misc_feature (442)..(442): n is a, c, g, or t
  misc_feature (446)..(446): n is a, c, g, or t
  misc_feature (454)..(455): n is a, c, g, or t
  misc_feature (462)..(462): n is a, c, g, or t
  misc_feature (464)..(464): n is a, c, g, or t
  misc_feature (468)..(468): n is a, c, g, or t
  misc_feature (479)..(479): n is a, c, g, or t
  misc_feature (503)..(503): n is a, c, g, or t
  misc_feature (508)..(508): n is a, c, g, or t
  misc_feature (748)..(748): n is a, c, g, or t
gggttttatttggtttggnttgtattaataaaagcctgttcaagcgcttttggggctcctgcaccgtggcctggagcttccgcatctnctcctccagccgggacacggcatccgagctgggagtgccactggcctctggtgctgccctcntgcgcccggtgtncaggccccggttgaccctcagctcccggctctttgggggtacgtagccatcnttgagggagatgaggaggggcccagcatcccgaccccccagccantnctnagcngtgagggcagggtcgggccctgcggtgggtgggtacaggtcctcntggaacaggtccgantttnggggcactgtnntggcantgggctcacacctccgctcgtgcagcttnttgaacntggcgttttnacanttnttcacntncaggccacgtttgggcttnttgcccntgcnccgntgggattnnttggaantnaacntggagagttanttctggaaaggggcctcggaagtnatctnaaagtaccggtttgagctgttacccttgctacagaggtagacgatgttggtgttagggttaagaagggcagcaggacaccgctgctggtgtccagctcctgcagggacagcggctcctccaggtgctttgtgtcccacagcgccacctgccgctcactcatgcggctgaagcccgtggtcaggatcttcccctccgacacgaacactgcacgcacgggccgggtcccctcgtggggacgngtccttctcagctac

SEQ ID NO: 586579 - DNA, 427 bp, Homo sapiens
  misc_feature (194)..(194): n is a, c, g, or t
  misc_feature (370)..(370): n is a, c, g, or t
aaaaggccgttggaaaaatttgattaccggaagctgttcctgcaaggttggcaaacggagaaggtggtgctgcgtggccctgtgcggcttcccgacccgcacgctgaaagtcaccacccgcaaaaacgccgtgcggtaacggcaccaacacgtgggacacttacgagctgaagatctacaagcgtcttgtagantccgcgcgccgacggagcttgtgaagaagattacatccttccctattgacgctggcgtggacgtcgccatcacaatcccacacgaccagtagcctgccccgcatgtgggagaggtgggaggccgcgccgcaactgtctcatgccatctggggggaagagtttattttccccccgangtcgtcacgccaattgcaatacatttgttcttttgttttgtttaatgcttccattta

SEQ ID NO: 586580 - DNA, 421 bp, Homo sapiens
  misc_feature (242)..(242): n is a, c, g, or t
aacccatggaattatcccttcctttgggaaacaccaactcaactccttaaagtctggtcaaaaacaaacctttctaaatatcagccaacgcttccaaaataagagcacgttcttccctatatgtaaaagaactctcactttgtatcccccccccgagagagatcgcttggtaaattgtgatatcccctcacgtctcatgatcattgtacgacatacacacacacgtgttgcaacattttgtnttatacatctatgtatataataaacacattggtttagatcttccccttctcttttgtccacaacattatctacatcccttgtcccactgtatcaactagttctgagacaccacaacggagttccacaacctcacaattcatgaaaaaatacaaagaaccttaatcttccacataacaca

SEQ ID NO: 586581 - DNA, 1094 bp, Homo sapiens
  misc_feature (295)..(295): n is a, c, g, or t
ggaacgagatctatactaataagcaagtgtaaaaaaaaaaaaaaaagaggaaaaaaatcttaaggtgaatgtgagtgcgtgtttctttttaaaaaaaaaaaaaaaattcattttctctttggggtaagaagcttaaaaaaaaaggccccaaagctttcctaagtggtttctttctaaaattctaattgggctataaagttattgagttattgttccactttacccggggctttctgtgtgtacaccgtgggtgtacttctacacaatgtgggggtaacgtactgtggtgtatacncttaactgtaccctctcatggggactttgtctgtttcacagcgcgatattttggaggtgtttaacatctctctccattataataaagtggtgtctcctcaaaactcttttgcgtgctacaaaacgctctccaaaaattttttggggggcgcccatatattgttggtaaatatgcgccacggtgtgtgggaccacttaaacgcatattttgtggtgcccacacacacaaagcgctttttggtataacactacaaacccgtggggcacacacaccaacgggggcgttcccaagtcacccatcttggtccctgggaattctggggcgcacagttccaaggcacactcctgttgtccaaagaactcccttcgcgtggtggcgcactcccaatattttcttataactgacacacaagtggggggcggggaaattgccccactaatttctccaccaggaggggctccccacacgaaactttgtgtcgtcttccccagacacattattttggcgggaaggaccaccgtggcgcctctgtgcgtccaaccaatcacctctacacgcggcgggcaatcaagaccaccactaatgaggttcagtgtggcacacctccacactgcaacagcacttctacagcggctggggacacacttcaacgaaaacgcttaaatctcttggtgggaacccaaaaagaagaatgtgcctcgtttttaaaacatttcctccacccacacgtgtggtttgaagaaccccccaacttttttacaacaaataaccctgccagggggcctaaaataaaacaggc

SEQ ID NO: 586582 - DNA, 101 bp, Homo sapiens
tgaaagggacacgtggataaatcaatctcatcaggatagcataacttgactgtagctgatgaaaatgacattcactgggatctagttacgctgagggtatg

SEQ ID NO: 586583 - DNA, 1068 bp, Homo sapiens
  misc_feature (8)..(8): n is a, c, g, or t
  misc_feature (101)..(101): n is a, c, g, or t
  misc_feature (158)..(158): n is a, c, g, or t
  misc_feature (161)..(161): n is a, c, g, or t
  misc_feature (163)..(163): n is a, c, g, or t
  misc_feature (189)..(189): n is a, c, g, or t
  misc_feature (443)..(443): n is a, c, g, or t
  misc_feature (492)..(492): n is a, c, g, or t
  misc_feature (507)..(507): n is a, c, g, or t
  misc_feature (635)..(635): n is a, c, g, or t
  misc_feature (668)..(668): n is a, c, g, or t
  misc_feature (961)..(961): n is a, c, g, or t
attacccncttcctagccaataaccgagagaagcgggcctcgccttggacggaagttaagcacgaagacacgaattggcttctagcaccctgttgagggangtgccaaccgtgagatcctggggatcattgtttcctacaaagtgaaagtgaagctgntgntntctcggggcggcgacgtggccgtggnactgcccttcaccctaatgcaccccaagcccaaagagaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacatggctccggctcnactctcgtgcactcggatgcttactctgtcttcttcctgttctggtttnttttcccctttgttnttccagtttctaccagggggccccgtgggcttccagatcacagtgatgaacctctggcctcaggattggccccacatcaccacgccaacaggaccacagcgcactggctccaccccatctctgccatntccactcccctccttttcatgctgtctcccagnaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcntccccacctgatgtccctctgtgtctgatagtgatgttggtgaaagttcgtagaccaccaggagtagagaaaagcaactggactataactactaggagcagttaacc

SEQ ID NO: 586584 - DNA, 6843 bp, Homo sapiens
gacaaatctcagcctgaccctaaagactacctccatcctcaaagtaaatggggttaagggggaagaagtcaaccagccaggtgccggggagttacggctttcaggtgcaggttttccaggcccctaggtgatgctaggtgctgcagtggaatgggtggatgagcagaggaggatgacacacacacggagtagaacacaccacacacacacacacacgcgcacgcacacacacacacacacacacacaggggagaaaggaggaatgctaaggaaatgccctgtgatcatgccctgagggagtgaggaagggcttgggcacaggagccagcctcagagacggcctgaataggatgagagggctgactctgctgagccaggaacgacacctacactccaccttcataggaatcagaaaagcacccactctcagtgttagaagcttgcaccaccccccacaccaaaaaatcccctcaaggccctgattcccttgggctctaaaacaaacaaaaaagctaatgggtttcccaggaagccatgtggtaggatggatatcacagaaaactatggttgcgagaacttcccttgggcccatgcgcagaacaggaagtcaggcagtgagtgggctcccaggaagttaatatacactatggacaggtagcaagttatggacagatagcaagatagccagttaatatactctatggatgacccagcaagtttgctgtttcagaatcctcctcttctgttttttgaactttcgaaaacaaaagatatgctgggagacgcggcccctagagtgtgcttactccaggtccttgattgtccagactgtggagggggaagggcagatctatgccaagaggggaacaggctgtagaggccacagctgattcatttttgtgaccttagcactctgcccagcacctggaatatagtaggtgctccataaacctgtgttcaaggagagaatctgtccatagcatatgtattaatgggacctttatagtcaatggacatccttagaaatcacatacccatcgttggctggtggttgagaaaaaaaggtaaaaaatgagatacacccttctacatgtttggcctccaatatggggccgggctgggcctcgagaaggagaccgcaggacctcaccagcaaggcatcgtgtcctctttgtgtcctgagatgccttctcactaagcctctttccagacctttggtcctggggatctgcagtgagcagagaggcagctccttgcgggtgaaacccagcaccggcctgcaaggccaagcctccccatgccaacacagcttatttcctctttcactacctcactccctagtggaaaaaacaagaaaacaaaattcccctgagcaatctgaaaccctgtgaccccctggccaagtggcagatccagctccaccttgatcccctccactttcctctggctcacctatacttaagcgcagaggccagcctcgaggttatttataactgtgtcagaggaggaggaggcaggaaataggaaattatgcaggagggggcgaggagtagctgcaggggccaagtgaccccgctggctggcttgaaatccactacctgcctggcccgtggcttcagagccccatgacagggaattcttacccagactggattcctcctggtctctgagccctacctgcgaatctcttgccagtcacttccccttctccagatccaggtggaagcagttttatcctgagactttccccctaggccggccacagtgacatcagcttttctgactgcagttaatggtgcaagagctggaggccaagcaggaggcccagcgccggaggggagacaaacacccagccctgggagcaaatggggtggcggcaaacacacggccttttaagtccaccagccctatccttctgtttcctttcctcctttaaatactctgaaagcgagagtctgaatagtgactacttgagaacccaagacttctccttaacttcatccagaggactcaaagggaaggccactcaaccagaatcacacagcagaaggagcagagccaggcctggggtcccattttctggaggcactggcccctttttctacactaccatgctgcccccagcccctgggctaactaagactcccccattctaaatgtgagtgcccctgatggaccgcataggctggatgtgcccgtccttgctttgcccagcagagccatgtccataaagatggcatcccacgtcaaatcctgtagactactgcaaaatatccatcagccaatttcttcaccaaaacgctctgagcagccactgaactggcagtgccattaattttcagacaatttcagactaagttaggttacctttttggggggattttgttgctgtttagtttcaacaccattattgactcagtgatactctagggcaagtgttctaatgatccaagatagcttttaggagaatttctgaagctcttgaaatttgtatgcatagctttaatcagaatcccaaaggtgctcctatcggtaaaatgattaggtaggacggtgatgtaagagaagtatagaacagagaggggagagatctggcccagacgaccaggggaccagggtggggttgcaccggtatgtcccctactgttcattacctgctcgcagggtgcctgccccatggaccttcaatcagaaacatctcaccttcacactcaccacaatgtccttcaatcatgtccttaacggtataaacaagatcctaggatttaaaaatctgatgtgtgcccagaactgagccaagcaagattataaaacaagtcatgaccacaggaaggaactttaaatctggcaaatgtgtgaccttgaaggtcagccttcccttcctcctttttcttctggtccctacaaagcacccactggcaccactacagccatttctgtttggcaaccctaggagagcagcttccctgtgtaatgcagatgatacttcctaatttcttcttccctactcagcaatcacaatggcaggcaagtgggcaaaaggggttttcagaatcctcatctgggcagtgtctcaccaactgcatttgtaggtgcttcttgggaaaattagttccttggctagatatgttcagagaacactggattaaacagagctaaacaggtcaccatgcagcaggacttctcagagcttttactatgctaatagccacatgtctctccaagaggggaatacaataaacagctctcccaaataacatttttttttttttgagatagggtcttgctctgtcaccctggctggagtgcagtggtacggtcgtggctcactgcagcctcaacctcgtggactcgggcgattctcccgcctaggcctcaggagtggctgggactgcaggcccaaccaccttttcttttttttttttttaaattagtggagacggggaatcttgctatgtggcccgggctggtcttcggttcctgggctcgggcgatcctctcgcctcggcctcccaaggtggggttgtatgcgtgagccgctgtgcccggctccaaagaacatttcttaagattggtggtgcaaggatcacaccttgagaaacactgatttaggccttcccacagtacaaagaaatgttgcctgccccatccttacagcacacctgatgacttacaagaggtgctgctgaattcctcccagggaagcaaccttaattcttctcagcaagacaaggaggcagccttcaggaaggacccaggagcttggtattagaggatgatccaagtctgatggcaaatttagagtgctccagggaacactgaagtcttgatgatagggcaaaagggagtgattccatctttctaacctggcaggatagcaggtaacaagacagaaataaggaaaaggcaagctgaacttgtctttccctgacatttgaactgcctgctgttctcctcaccaaaaataaaaaagctggtctcaagacaacaaaagtagagaagtaaaggtaacagaggtctccagcctgcaggaagactcatataacctcagtccaaagttctttttatacaaagcacagatttttactggctaagtgctcacccaatgacccattttcagtatttgtttattcctgtatttcacccatgtttatcgagcacctactgagtgtgtggcccgtagtcaggaatgcccatcaattaccaggcagcaaggctattcttagttttctgatgtctatttaaagagtgttaatcctctggcctcccccctacccccgcccctgcaattagacacataccactttccaacctggtacactgacctcgcccaactgggaaggcggaatggacaagtgttcttcccaccctgcttaacttggccaagaatctggcttcatgggttagggcagcctgggaaccagccaagccagaggagacgagcctgctttgcctgggcccttcaatcagtgctggggtcaaaaacctccctgttctgttccttactagtggcacagtaaggcagaaagtgttgagactcaagagcagaaaaatccaggctgtctagtggggcggtgaagaccacagaccacagaacagacacacctgctcaaatactagctctgccatcatgcagtggggtgaccgtgggcagaattggtgagattgctcggactctggagtcaggaggtccggctcaaatctggcttcactatgtaggtacatactaggtaagttacctagtctctctcagcttcagtattttcatctgcaaagtggaatgaggaggacaaggatgataacactaataatttctgacatgtatgtttatagtaaagaatagaatttattacatgtatatatgtatataaagatcttaaaatagctgtcaacaaatagtagctgctttcatatttaattcctcttaagtcccaatttttttcatctgcaaagtagaaataggagtgcctacctcaatgagtggttatgagagtttaaaggagataatgctttaaaaggtcttggcatataaaaacaaatcaataaatgttaaaatattatcaaatggttattatttttgttccagttccatctctatctcttaaaccaagctgctgtacctctttggacttcagtttccccatctgtcaagtgagagacctggatcagatggcttctccagtgtcaccgcacatgggttccctgcactgggacccacaaggcctagaggttacttgcagcaaagctgtcagtggcctctgagccttggtcagcccaaaagtacctcgaacagccccatatccctgtgcacagttcatgaaactagaaatggggaggggaagatgccttgcctttgcaaatgttatcttgacctgtgctgtagtattaacatggcggccactaaccacaggtagctgaaacgcaactagtccaaactgagatatgctatgagtgtaaaatacataatggatgtcaaaaacttaattttaaaaatattaagatcttattaataagtgtaaaattgattacatattgaaatggtcatattttatacatattgggtttagtattaaaattaatttcactttttcctcgtttttttaaacatgactatgggaaaattcaaaattgcatacatggctcacgtgtagccacaatcctgtttctcctgagcaatatcaatctagtttttttccctttctgtctccccgcttgtgagccacccagtaagaaactcttctcagagggataccagaaggaattcgaactatttgtaattaactttttgaaacaaaataaaatccagatgttaactatccaggtggagcattctattttagcagcctccaggaatctcctctggcttaaaggagccctgaataaataaaatctatccagctgccaaagcaccccatgatgttaccatatttatcagcacctgaagttctaaatctccactctggtcaagccatctcttgtctttctccgttagaaaaagatgggcagtggtttctgttttattttccaaggtacttgccactgtttaatacggtagcttagcagttaggaatggccttttctcattaagctcagctcccaatgtttcaaaccaatctctttctttctttctttctttctctctttctttctctttctttctttcttcctttcttcctttctttctttctttctttctttctttctttctttctgtctctctctctctctccttccttccttccctctctccctctctccctccctccctctttctttctttccttctttctttctttttttttctttctttcctttctttgttttctttctttctttctttcttttctttctttctctttctctctctctctctctctctctctctctcacacacacacacacacacacacacgagtattgcctggaaaggctggaatgctgtctttctcaaatgttcttattcattcatgatacttttattgaatgcctactaacatcaggcaatgagctggtgagcaagacttggctcccatctaaggggaggcagtaataccatgtagtaataatatgatggctgacatttatcaggtccttactacatgccaggcaatgagccaggccttttatttccattgtgtctgtgaattcttccacaacctatgaggttaagagtactattattgcatactccattttacagataggaaaaatgagaccagggaattaacttgtccagggacaggcaactagccatgaacgaggccaaggtttgagccaagtggtctaactccagaacctgtgctccagctcagaaagtgtgggaaatgcaggacacattttgcc

SEQ ID NO: 586585 - DNA, 550 bp, Homo sapiens
  misc_feature (325)..(325): n is a, c, g, or t
  misc_feature (387)..(387): n is a, c, g, or t
  misc_feature (414)..(414): n is a, c, g, or t
  misc_feature (522)..(522): n is a, c, g, or t
tattagtccgttttcacactgtcttcatacccaagactgagaagaaaaagaggtttaattggacttacagttccacatggctgggggaggcctcagaatcatggtgggagatgaaaggcacttcttacatggcagtggcaacagaaaatgaagaagaagcaaaagtggaagcccctgataaacccatcagatctcgtgagacttaatcacaatcgcaaaaatagcacatgaaagactggcccccatgattcaattacctctgcctgggtccctcccacaacgtgggaattctggaagatacaattcaaggtgagatttgggtggngacacagccaaaccatatcattctgccctgatacctccaaatctcatgtcctcacatttcanaaccaatcatgccttcctaaccatccncaaaagtcttaattcatttcagcattaacccaaaagtctgcagttcaacatctcatctgagacgaggcaagtcccttctgcctatgaacctgtaaaatcaaaagcaangtagttacttcctagatacaatgagggt

SEQ ID NO: 586586 - DNA, 319 bp, Homo sapiens
ggatgagaatgctgaacagttcttccgagaccaagggaggcagacttcctcgcttcaaccagccagtcctgactctgtgtataacctcatgctcagctggtgaataatagataccaaggtccgtccctcattccaagaaatccaccttgtgctccttcaacaaggcggcgagtgatcctgtcagtgcctgaccatgttcctacggctcaggtcctcccagcaagacgtaccgctcacccatgcctatgccactccaagtggtcacccacactccctacccgtgagtcatatatacgtgtttttacattaaaaatcaaac

SEQ ID NO: 586587 - DNA, 185 bp, Homo sapiens
cccgtcatgctcttctccaaagatcgatctggagctgctggaaaaaaggctttccgctaggctgattggactgtctagtgagaggtgatagcactgattctgtttttggataccacccaagcagatgtgctgggtgaggcagaatctcgtcttcctttagatgaaattaactggcgccgtaggag

SEQ ID NO: 586588 - DNA, 424 bp, Homo sapiens
  misc_feature (337)..(337): n is a, c, g, or t
  misc_feature (376)..(376): n is a, c, g, or t
  misc_feature (393)..(393): n is a, c, g, or t
catgggtttgtatttcctatttaggtgggaattttaagagggaaaagggttagcactgataggcctttttccaatgttttattggggaattaaatagggagaagtttggattgaaatcgtaaaatcctcaccccagacattggggtgggttgtgctttggttaatacctctttccctaaagaagattaacccaaaatcccttcccggtaggtcggcccccactaagaaaaaaagcccaaagttttcagagctttcgaggaaagtggttgtccccgtccccccatgccctgtaaatatccctcccctctttccctggtcccctcccccatcccccccnctgatatcatggggagtaataggaccagagcggtatttntggcccccccctagggnctatcaggtaataaaagctttgactccctga

SEQ ID NO: 586589 - DNA, 291 bp, Homo sapiens
gcccagcccatagagcaaaagggtggcttccggcagggaaaaacgcgcgtttttcagccggttgtcttcggcccggatcgtgtagtttttcgccccacgaagatccgctttctgcaggttcgtgcgcgaaaaacgagcaccggcgaaatcggtaccgcgcagatccgcaccgccgaggtcggtttcgctgaagtcggcctctcgggctgaacaatcccgcaaaacagtcttcttcagatcgaggcccgcgaaacacgccagagtgaccacgctcttctcgaactccgcgtg

SEQ ID NO: 586590 - DNA, 195 bp, Homo sapiens
aaaaaaaaaaaggaaaggaaaaaaatgaacctggggccccaatttcaaagtaagatctctctgcgtggagctcaaaaaaggtgtagttaaaaaaaaatccctcagatgatcctgaagcacagccatttggggtgccaccaaggggaaatcattcaaagagagtggcaaatgagtgtgggggaactcagaaaggcc

SEQ ID NO: 586591 - DNA, 529 bp, Homo sapiens
  misc_feature (359)..(359): n is a, c, g, or t
agtctcccggttctggggacgcagctacggcgcctgaaaaaaaaaaaaaaaaaaaaaaaaaaaaaatttttgggcgccttgggcccggaaaaatttttaaaacatttgtttgggggcggggccccaggttagtcgacctaggggccaatagcgtggtccactaaggaaaaaccccggggcaaagaagacatagggggctgggggttctcctcccaaataataaaaaaaacgccccggggagagcacccaggagcggttctcttgagaacaaaaccctccaggagtgggaggggttgtctaggaggcgctacaaacacgggggagctctctactctcaaaccacgggggagtttccaagngagagatcgcctcgaatatatctaataatagttaccgggccccgggcctggtgggataaccgacaaagcagacacataagcgagagcagagaacagagacagagcagaaacacatacaaaagaagctagtaacaacaaaaggagagagagagaaggaaacacagacaagt

SEQ ID NO: 586592 - DNA, 315 bp, Homo sapiens
  misc_feature (14)..(14): n is a, c, g, or t
  misc_feature (30)..(30): n is a, c, g, or t
  misc_feature (58)..(58): n is a, c, g, or t
  misc_feature (132)..(132): n is a, c, g, or t
cccattcatggatncattaaaattaagggngtgccacattatccttgggagtatgtgntaagaaaacccaggaggctctttaaacagcttgagccctctgagcctaaattttaaatgcggatgaatcaccangagtttactagtttctttgttcggaaaatcagttagccatataaaaaccaaccaaaggtgtttattgactggcaaaaactctgaaggaaattctgagaccatgaagaaatcattaatcatgcattaaatgacagcagtgagcaaattaagcctctgaaacattactaagcctagaatatgtat

SEQ ID NO: 586593 - DNA, 262 bp, Homo sapiens
cgttgtcttggaaaagtcatgtgggtgggcccctccagtgctggccccattggagtctgcatgggaggcctggggtgcgccgatagtacatgtccttgtagatctcctggagcagatgggtgcagcgatggtctcgtgtttctggtctatcttgatccggctgcatcatctgtgtgcgtgctctggttgaccatgttgcctgcaggtacagccactcttcttgcagcagctttgggggaagagtgtacttggtgcatcaggg

SEQ ID NO: 586594 - DNA, 583 bp, Homo sapiens
aaacgtgacggtgccgcctgcgcgagagatgccaaagtgcttgctaaacatataacataaaaatggcttccaaaagagctctgtgtcttcctggctaaaggatgcagaggaaatggagatggtcatccctgtagatgtcatgaggcgagctgggattaaggtcaccgttgctggccttggctgtgaaaagacctcagtacaggttgtagcctgtgatgttggtcatttgtcctgatgtccaggccttgaagattggctaactaaaatgaggcgaccatatagatgtggtggttctaccaggaggtaatctggggccgacaacatgacactttactgctgaagtatccttgcattggcgttgttaacagggacgactacctgcatagggacgaccttggacaataccccgtgataaggggggcacttgaacttagttcgcggacgcactacttggtgcgcatgagattcacataaacttgagcttcttgagttggggtctgcactgcacatattacgcgtttgtagtgagacacgcttatagacgctttaccaaaacagacaactcctccttgtcttaacacga

SEQ ID NO: 586595 - DNA, 431 bp, Homo sapiens
  misc_feature (406)..(406): n is a, c, g, or t
  misc_feature (413)..(413): n is a, c, g, or t
tcaatcgtagctcactgtagccttgacctcctgggctcaggtgatcctcctacctcagtctcccaagtagctgggaccacaagcatgcatagccacacccagccaatttttgtttgtttactttttgtagcagagaggtctcgatctcctggcttcacatgatcctcccgcctcagcctcccaaagcactagtattacaggcatgagccaccgtgtgtgggcaccactgactttctgaaccccaagtgtattagccaccataacaaacaccttttgtctgatacattctgtgggatcatattccttttttatatataattttaccttttattttaggatttgagtgggtacagggtacaggtttgtttcagggggtatattcatgtggacactgagggtttgggantgcaggnggattcccttcacccggg

SEQ ID NO: 586596 - DNA, 580 bp, Homo sapiens
  misc_feature (183)..(183): n is a, c, g, or t
  misc_feature (260)..(260): n is a, c, g, or t
ctagaggatcccgtggggtctcttccggacctcaaggatccccgcttcagactctcaaattcgggaatacaggtgtgagccacggtccagtacccgggtctttaaataatatggtatgtggtgtcttctggagtgttccagggagatcacggttatagatggtatggaggacacatgaaaagngggatggaaaagcagagaggcaagggaggaagtgggtggcaaagatgcagatatgagaagctgaggactgtgagccnggacagtaacatgtcagggaagagaagaccggcatgaaagtggtttcaaaatcaggctggacggggcatggtgtctggtggcatatgaaggatgcaagaagagaggggtcatagatggactgcagaaatctgaacctgggatctgaggttgaggataccagggaacgcttggaggagtaaccgggaagaaaagccctgagtttttagtgacgctggatgtgcccgtaggttacttgagcaggaaaggtcaaagctggggatggagagatacaggctgtagagttggacgatagtgaagccgatctgacttccagcctggt

SEQ ID NO: 586597 - DNA, 346 bp, Homo sapiens
aacgccatagtcgtatctaatcggagctggagccaccagcctacgccagagccacagcaacccgggatccaagccacgtcggcgacctacaccacagctcacggcaatgccagatcgttaacccactgagcaagggcagggatcgaacctgcaacctcatggttcctagtcagattcattaaccactgcgccacagatgggaacacccatctaaaccattttagagtgtgcagttcaggggcattaagtgcacagtatggtgcaaccatcaccactgacctctccagagctgttttcatcttgcaagcactgaaactctaattcccatgaaacattaactcccctc

SEQ ID NO: 586598 - DNA, 468 bp, Homo sapiens
  misc_feature (148)..(148): n is a, c, g, or t
tgacgggtctcttcctggacggtaggagaggcacctgtgtgtgagtgatggttaaagaagaggcacgcttcctgatggaaaagcagagaggcaagggaggaagtgggtggcaaagatgcagatatgagaagctgaggactgtgagccnggacagtaacatgtcagggaagagaagaccggcatgaaagtggtttcaaaatcaggctggacggggcatggtgtctggtggcatatgaaggatgcaagaagagaggggtcatagatggactgcagaaatctgaacctgggatctgaggttgaggataccagggaacgcttggaggagtaaccgggaagaaaagccctgagtttttagtgacgctggatgtgcccgtaggttacttgagcaggaaaggtcaaagctggggatggagagatacaggctgtagagttggacgatagtgaagccgatctgacttccagcctggt

SEQ ID NO: 586599 - DNA, 563 bp, Homo sapiens
agcggagttacaacctgcagtaggcccggagaacacaacctcccgagaagcccaggtccagagccagacccgtcactgagcccccagccaggcgcccaggcatccccaccgtaccatggccgaatgacgcaggacatgcgcaatgagctggaggagatgctaggaagggctgaccagttggctgatgagtcgatggaaagcacccgtcgtatgctgcaactggttgaagagagtaaagatgctggtatcaggactatggttatgttggatgaacaaggagaacaattggaacgcattgaggaacgggatggaccaaatcaataaggacatgaaagaagcagaaaacgaatttgacggacctaggagaaattctgcgggctttgtgtgtgtccctgtagacaagcttataatcaagtgatgcttacataaaaagcctggaggccactaatcaggacggagtggtgtggcagtcgagactgctcgtgtagtggacgaacgggagcacgatgagcatcagtggcggcttcatccggagggtaccgaatgatgcccgggacaatgaa

SEQ ID NO: 586600 - DNA, 98 bp, Homo sapiens
caaaacccagaagtccaagcaggtgtgtttccttccttttattccccccccgggtggttttcttataagtaaattaattaattccttaattacctgga

SEQ ID NO: 586601 - DNA, 426 bp, Homo sapiens
  misc_feature (382)..(382): n is a, c, g, or t
ctgaattgctgggactacagtcacacgctacaatgctgagctaattttcgtggttataggagagaccgggttttgtcatgttgatcatgctgttctggacctgctgaccttaggtgatccccctgccttagtctgccaaagtgtagcgattacaggcatgagtcactgcacctagactacaggcaaatttgtacagagaataattcctatccagatgtagcctgatatatcagaaagcatgagactggatgtgagacagacttagctctacatctactatgtgagacttaacccgtgatagctatggacacatgacctgaactcactgatcagtttctgcattctgtaacgttgggatgctagcatctactctgatgagatnttgcgtatttatctgaagcatatttaagtcatgtcatatggtgt

SEQ ID NO: 586602 - DNA, 116 bp, Homo sapiens
aacggaggttccttggtgggctttcccggggggggggggactcgaggggtacccttaatatggatttttggaacgccccccctccgttttttgggttgtgggttggggaaaccccg

SEQ ID NO: 586603 - DNA, 265 bp, Homo sapiens
ccacgccgacgaggggccaagtgtttgtaccatttcagaaacccacttgttgtatatgagagttgtagttgctctagcgtggtcattttttctaattttagccatttccttttagtaggagtatactggtagcttcttttaatttgcatttctctaattaataaaaatgccaagcaaatttacatgtgcttatttgccatctatagatcttttttggtgaagtgtctaagcaaatcttctgcccattttaaattggcttatcgag

SEQ ID NO: 586604 - DNA, 431 bp, Homo sapiens
gggggggggggtaaaaaaaaaccggaaggtttttttgcccccccaatgtgggggggggggcaaaacttgtttttttttttggggggggaaaaaaaaccccttttttttttttccggttttttttaaaaggaaaaaaaaaaacccccccccccccccgggggggtttggggttttaaaatggggggaaaaccccccccccccccaaaaaaaaacaaagtttttttccccttttttgggggggggggttcgggaaaaaaaaaaagggggtaaaaaatttcctttttcccaaagggattttaaaaaaagggggggtttgggggttatttttgggaaaatgggtttcccccttttcccccgggggggggggggcccaaaaggggggcttccccccccctaaagggtgggtttaaaggggaaaaacttttttttta

SEQ ID NO: 586605 - DNA, 110 bp, Homo sapiens
gccaattactgtcccaagccctccaggcgggcacatgtgtgggtcaacatgctataatgtgtttggagcccagtcaccctttggtggctacaagatgccgaggtggagcg

SEQ ID NO: 586606 - DNA, 167 bp, Homo sapiens
  misc_feature (3)..(3): n is a, c, g, or t
cantctagatgatccccgttcatccatgttgttgcatgtgccagaattcccttcctttttaaagctataataatattcattctgtgtatgtataccacattttgcatgtgcgttcttttatcaaggaatatttgggttgcttctaccttttggctattgagaataat

SEQ ID NO: 586607 - DNA, 100 bp, Homo sapiens
gattcatgggatcaggtatcactatgtgcagtgtgcgaaaactacaatcatagagatttcacctaagtttacaatctccatcattagtaataatgcctgc

SEQ ID NO: 586608 - DNA, 195 bp, Homo sapiens
tagccattggacatctagtgaaaaaaccttgtagagatgagtaaaaatttaagcacctcattgtaggcctaaaagcagccaccaattaagaaagcgttcaagctcaacacccacgaccgtaaatatcccacacatattactgaactcctcacaccctattggaccagtctatcaccctatagaagaacgacccga

SEQ ID NO: 586609 - DNA, 135 bp, Homo sapiens
ttgacctctctgggctcagggatccacccgcctcgacttcatgtatggtcggaggatcacacgagcctccctcttgtgagggacaaacgggtacgttgattcctttaaatcatctcaggtatttattgcagaatg

SEQ ID NO: 586610 - DNA, 123 bp, Homo sapiens
gttcgggtgtgagatgtggcgggacggatatggtatggggtcgataggtcgctcggggttggaggatagggaggaggtggcggccatcacccacgactccctgaacatacacaagccgcttca

SEQ ID NO: 586611 - DNA, 162 bp, Homo sapiens
ctctctagcctgggaccgagaacaagtcgggttctctcagacattcagcagtcttattgccggggggccttttatcccataatatattacttcaaatttaaataatctctccttcaaccacgcgtcctcaagatagcgttcatttgaggggtaccgacgctc

SEQ ID NO: 586612 - DNA, 708 bp, Homo sapiens
gactcggccaggccggagacctgaggggagagggaacgcagctgaaagcgtgaactgtacctgtcatttactccatcctttatatgatgctacaggacgaaaggaatggataaaacatgggacaatcaataaagcgtatgaagccttccggcaggcatgctggatagagatctgcagtaaagaatacgcaaaagactgagaactatgagcagagaatacgtgaacacaggaacagtgtcacttcaacagactatatgcagctaatctcagtactcttgtgatccactcaagatacaatatggtgtgtcctctgttgaagacgtgaccaaagataatgcctgatcagcaagataaggattcggaatgcagaaaaactacaagtagagacagagttctctcctaaaagaactccgaagagctggcgccttgtccatgaagggtatataacgagattcggatctgcaaaattcataattgctgtacaagacgaagacattagcaattacttacaaaacgcactgacaaggtctgtgctatcaggtcggtaacaataccaaagcctgctagctcagctagatattaatgagtggcaccataattgtcccgagatgtgcgagacagaacctcttgatcaccaatcagcccgtcaccatgcacagatcacttactagcactcaggagccggtcttgctgcagttagctgtccca

SEQ ID NO: 586613 - DNA, 1193 bp, Homo sapiens
gctcgtgctgggtgagctccgtgtcgcaccggtgttcttgggactggcctgtgtccttctccctcgtgtctgccactggcccatgatgtccccattggcagactgtgcatgtggtgccatgtgcccagtggtgctgtgtgcatgtcctgacgtgtggtgcttgcgtgctgctcctgtgtggtgcatcctgctgtgctgtgcgttggcctggttgttacgccagcactgtgtgcctgcaaggtgttccaccgtttcagcactcttgacccccctatctgagtacctgtgtgtgggacgacctccctgtgtggaaccgttgattcaccaggcctgacacacaattgagcgctttgtggagtgttgccccatccctcccttggctaagtccttattgttacacctcttgcgttgtgctacgaactttgagcagactttagccacgctgtattacccgtttctgcgttgggtgtcgagagttttgccctaaccctgcgaggtccaaagtccattacatacattggtgagcgcctttaaccttttgggacgggcaaggtaagagcttgcagttcagtttaacgatatgtgttagatacaacgcagggattctattcaagtggggcgtttatacctatgtggcttccaattcctttggcttgtggagcggggaaagtccgcgttttggcagttgcctgtgctgggaggttcgattactccactattttatcgttcggtccataaacgcaatttgtggcaaatgtttgggttcgcccaattgtggccgagggccaaggaaagggcagatataatcaatcaaacgggccgtttttagaacgaacagaagattccttcttttagtgggctgcgctggtggccttggcatttttaagttgggcggttccattttacaccgttgggttaagcgagagttttattttggacatgggtggagacaatggcacacaggaccaaaagtcttgggcattaagatgtcggagcggaacatggaatgttcaaaacagaggggggttaaggggctgttaagaagcaaagagattttggggggtgttggcgcttatttcctgttggcctatagatttgggggcgcctttaataaggggatatatatgaacgtttggttaaaaagagcacgccagggggcaaggacgagcgagaaggtgagagagataaaggtg

SEQ ID NO: 586614 - DNA, 692 bp, Homo sapiens
tagcagacacatagatcaatggaacatgaatagagggcccagcaatataaagctacacacctacaaccatctaatcttggacaaagttgactaaaatacgcaatggggataacgaacttccccattcagtaagtggtactgggagtaactagctagccatatgcagaggattcgagaactgaaccacttccttacaccatatgcaacaaatcaactcaagatggattaaagacttaaatgtaaaccccaaactataaaaactctggaagataacctaggctataccattctggacataggaacggagaaaagatttcatgacaaagatcccaaaaataattgtaacgaaagcgaaaattgacgagatgggacatgattaaacagaattaccatttgactcagcaatcccattattggttatatacccagaggaatctaaatcattctgtcataaagacatatatacacaaatgttcacggcagcactatacacaatcgcaaagtcagggaatcaaactaaatgtccatcagtggtagaaaggtttcagagaacatgtggtggccgggagtggtggctcatgtctgtgatcccagcactttgggaggctgaggcgggtggttcacctgaggtccggagttgtgacccgctggccacatggggaactccggctccgtgaaattcgaaaattgcg

SEQ ID NO: 586615 - DNA, 893 bp, Homo sapiens
gctgcagatgtctgacgtaatgagaatgcgtgagccaccacgcccggacttaactttctaaattaactgacaccatctcagatattcagggttcacaaaggcttggaggggcctgcaaatatatacaattatagaattaaatagtgatggatagagtcccttattcaaaaatactgttataaattaagttaaaatattaaagtcaaagaaacttcacacccataatcgcaatgctttcagaagatggaggattattttgagctcaggactttgagagcagcttgggcaacacagcaagatgccatttctacaaaaatttttcaaaaatagctgggcatggtggtgtgtgcatgtggtcccagctactggggaggttgaggcgggaggatcacttgagcccaggagtttgaggctgcagtgagatgtgctcaaatcactgcactccagcctggctgagagaccaagaccttatctcttaaagaaagaaaataggcggctgggtccggtgactcacgcctgtaatcccagccagggcacgcgaatcacctgaggtcaggagttcgagaccagtctggcgaacatggcgaaactccgtctctactaaaaataccaatattagccaggcatggtggcgggtgcctagaattctcagcctcctcaatagctgggattacaggtgcccgcaccatgtccagctaaagtttttttgcatttttagtagagacggagttcaccatgtggccagactggtcttgaagctcctgacctcagacaatccggccgcctgtaatcccagcattctgggaagggtgaggcgggcggatatgaaggccggagatcgagacagtctgggcaaagggtgaaaccccggtctgtaaaatccaaaaaaattg

SEQ ID NO: 586616 - DNA, 367 bp, Homo sapiens
  misc_feature (347)..(347): n is a, c, g, or t
atgcaatgcctgcttccgtatcagtccacggagccctcgtgtgtgtcacctttacctttgaacctgcccctgcctccctgcctgtgtccggttttgcagcttaatgcagccatgacaaggaatggcagtggaggtgtcctgagcaggcagaaggacactcaagcgccctatgttgcatgacattcatgacgtggacttggagcttctgactaggtcagactgtcacgccaaccccaggctatacctgacatgccagactagtgaattcctaggagattccatctatgctgcaatctgaccatataccaagcctcgcgattcagacacatcgcaacgctgacaggctntagacgcagatctggtctgc

SEQ ID NO: 586617 - DNA, 506 bp, Homo sapiens
acgtttgcatcaggatgagtctgcacaggactgcgtagccaccttcctctagtgcgtggcaggtctttgtagtgttgcttctctgacattcccttcattatctcctaacaagatggtagaagattttcacgtcccggctgatggagttgttattgtcctatgcgcaacaccttctttgtggttctcattgtcatccttgtcctgttcgtcatcgatgcctgttctcgaaatacggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctg

SEQ ID NO: 586618 - DNA, 226 bp, Homo sapiens
ccggttctgcttcttctttaactcttatcaagtttttctggaagctctgttctgcttcttcgtttgacttccattgaattggggaactttcttcttcctcttcccgattgtacaaaaatgacttaaaggatatcaatatcactatattctctataacacacaaatatactagcataaatacgtgcaattagacagtatagtctaaatacaagtccctgtcccattt

SEQ ID NO: 586619 - DNA, 324 bp, Homo sapiens
gaatccttcatcgttcgtccccggtggtgtcagcaacgatgtgatgtcaccgagtgtcaggcataagccccttgtgatggaaatcgatgggcccttcccaattaagttttgggtagtggtcgaccgccctccgggaaggtctcccagacaccgacctcgtgaacgtttgccttactggcagccttctggagggccttggtgacgtcgtcgctagtttggccgttgacgagaagaatggaagctttcttctgggtcagcaggtcggtggtctcgtgaacgaccttggtcgacgcggccgcgaatttagtagtagtaggcggccgc

SEQ ID NO: 586620 - DNA, 214 bp, Homo sapiens
tcacgtagctgtgtgttgaatgctctcagtctaatgacgcatggggtacatcgggagggcaaggggcagcagcgcatgcatctgctcattgctgcttgttaatcatcttatacttggtgcgtagggcctctggaacatgctcttggtcctctggatgttgaggaggatgttggcggaagacccgggatggcatccgtggtaacgacgcatcgat

SEQ ID NO: 586621 - DNA, 1029 bp, Homo sapiens
tgcagcacggtgagagtagaagggtggaaacggggaggtgcccagtgaaatggagcctgtcccgtgcacattaacgggcatttcgagcatcttgtgggctctcccaagtccgcggccctcctctgagaagccacagtcaggtctttgtcctccagttgtgtctgatgtgctggcttgcgcttggagtgccgtctgtgacctgtgggatctgatgtgctgtgttgtggcactgtgcttttaccagtattatcccgtgcgtccccatctgcatgaatgccttacatagtgtgcccaggtgctgctggctggtgcgtcaacatgcctgtcattccacacgactggcattaatggtgcgggatatgggtagtgcagtgatatagcttgatggccacgtgatgttcaatgaccatggcatgggccaacatatgtggatgaaccacagccaacccacaagccagtgctctaatttgagaaagaagaaacaaacaaaagtgttttccaaaatacacagagagagaaaagaacgacattaattacacaaaaaagggagaaaaagcaatgacacaggaacataaccttgggaacacactgcggagagcatatccggaatgtgtgcgagagtaccaccacgtgggccccttcgagacaacccagtgaaccaaacaacggtgacgggtcgaccccagaaagaaaatggtgataacgagcaatggggtcgcaataggataccacaagaatgagcataaagtgccggatgttttggaaagggatttgtcatggatcaaatttaatgatcaaaggaagtgttatattgtatgcaagtggagtcagaaatattgaaagaggcacaggaatgcgtgagtgtgtatggtgtgaaaattatctattcaagaaatttgtgtaccgagtggagatataggagttgtgataaaccgaggacgagtggactatagtggaaaaaaggaaaattaatgagaatatagttggaacatataaataattgataagtaagaataaaaaagtgatata

SEQ ID NO: 586622 - DNA, 427 bp, Homo sapiens
ctgcgctgaaagaactacccagtcatacctgccacatatcaccatgattatctgggaatacctttcatacaataactcaggtaaaaaaaacctcagattgaaacagcaacctagatatactatacgctctctaatcagcattgcaatgtaatataataaataaatgttctcaaaaagtaactaaaaaatagtgtcggaccctacttttgagaaatctacgtttcccaagtattatagggaactggctaattccttgtcccggcacaccttctcattccttcctttcagagcctaaaacctcatttgataagcactcctagtctctggcctgtggatccagagctattctgtcaccaacctaagaatcccaattgcaccttctgtatctgacagtcacaggtgacagctgtgattctataatacagac

SEQ ID NO: 586623 - DNA, 492 bp, Homo sapiens
  misc_feature (399)..(399): n is a, c, g, or t
tcactgcctggtatgcgccaggtgggcagcaccttttttgctttaaagggtttttcagtgctggtcttacaagaacctttattagtcattgtatcggcttctggccttgggggtgtcaacccttgggacagtgtggacttaattctggcggagataccaagggctggctgcggacatcgataagattgttattattcttaaactaacaaaaaaccgtctaaacctctttataagccaaaacgtgcagcccgcattccgggaacatcacaaaatttaatatgggcaactactccattgagcgaaattatatgcgcctatgggatggccaaatccccattgatggcggccgctgctactaagagccttgggatttccaataaacaagtgtcccgcggagtntaagggaagtgactcaaccttctgggaagctcttacacacctacatggtagtttgtcagatctgactgaaactggctacatttgtaaacagaa

SEQ ID NO: 586624 - DNA, 451 bp, Homo sapiens
acgctcgcgggtgtggatttacagcctatcggggaagagacctcgatagtatagaaaaacttaacgttcacggtgagttacagaggaataagggtgaaaagatctttgaaaaattgggggaacgagtaaggtgtagtgaccttgcatagaagtacgtcaaagtggtctggtgtccatacagatgatgagttgctgcctttcagtggtcaagcgtgggcatacaggaacacgatgctgtgcccttcatttccagcgactgcgatattctctctaccctgaatatgtaaaagggtaatggagagattctcctcactcttacgggtaaagagctatgtcctccctgctgggtaaagttggtcaccatgattattaggctgtgtatgaagagaatgaatgtctgattgataggtttattataatctggaagtgataggaagaaatgctggtactg

SEQ ID NO: 586625 - DNA, 245 bp, Homo sapiens
atactctaggtgaattagttgtgggatcattaagttcatggagatggggagagctgacgtgatttgacaggccaaacaactaagcaataaagttgctcacttatttgtaaagtgttagcagaagaagtttgattactcataccatatcaaggatctgggcaaggaatgtatcctactgtatgtcagcaagtgattattttattgagttcctagtagatagatgcaagggaagtgtacagtaatga

SEQ ID NO: 586626 - DNA, 289 bp, Homo sapiens
tattaaggataggccaggactcgttacacagcaggaggaggggctgggccagtctgatgcaggttgtgtcccggccaaggactgggatcagctgcagaacaaggtgccagggggtccagatgacctggaaggtcaggatgcaactccccccaaacaaggtgcagcgtgcggggctgcgtaagcagctggtccaagaaggcaagttgggaacactagttcctgctggacttgacgagacgctgagcctgtctcgcccataggggcggttagccccagtcttgcctttttt

SEQ ID NO: 586627 - DNA, 255 bp, Homo sapiens
tgcagaggcgttagagggttctgtgggcaattaaagttgaactaagatttatcttggacaccagctatcaccaggctcggaggtttgtcgcctccacctataaaatcttcccactattttgctacatagacgggtgtgctcttttatgctgttctataggtagctcgtcttggtttacggggggtccttagctattgtcctctccctttgcaaagaatattttctaagttaaattccatttattgcagaaaggta

SEQ ID NO: 586628 - DNA, 979 bp, Homo sapiens
  misc_feature (424)..(424): n is a, c, g, or t
  misc_feature (462)..(462): n is a, c, g, or t
tggccctgttgggcggcgagacaggtgagcggctccactccggcgctctgcgtatgactgcagcgatcgccaaggctccgctggagtgcagtggcatggtggcatgatcttggctcactgcaactgctgcttcctggtctcaactgatatcttctgcctcagctctcctgagtagctggtggactacaggcacacactaccacgtccagctctatgatcagaagatgcgcataatgtggggctgtggcacagtggctcagtgcccagctgggattacgcctgtaataccagcactttgggaggccaaggtcctaactcctcacccttgtcacactcctggtaatgctgtaaaactttaccatggaccacagttccaaggacccccgaatgcagtcatggagttaagcctgtgaacaacccacanctcctgtcaatgctggcaatgttcagagcataacaaangaaaccagaaagctgacatacttcctaccccaaaatattttgtcctgttgggggaagaggctcatatccacctggatgagcactttcatgtgcatgagtcgctaggacaggatggtgagaccggagtccaggagcatctgactggcaggcaacatctgccgtgacagcacctgtattatctggttcatgctgctgattaaagacataccaagactgcgaagtaaagaggttaaattgacttacgtccacatggctggggagcctcggatcatggtggaggtgaaagccctcttcatagggtgaggaccgacaatgagacaagcaagcggaaccctgaaaccaaacatctgagactacttgggaagaccgtgctgatactacccctggtctccacaatggactgcgatcacacatgaaaaagaggccacataccggtcaacccaagacaaatttaggaaggcgccgtgagaacacgagaccgaggccaaagtatacattatgagtagactccgtacca

SEQ ID NO: 586629 - DNA, 452 bp, Homo sapiens
ctctagggtacatgtgctcatcaatcagagggaataggtagggatatgttgcccaggctggccttaaactcctggcctcaaggtgatccttctgtcttggcctcccgagtagctgggactagaggcgtgcaccgtcacacccagcttcgagtctcttattataaagttctggccacgctcagtggctcgcaactgtaatctcagcactttcgaaggccaaggcggtcagatcaccttaggtcaggagttcgagaccagtgtggccaacatggagaaactccgtctctactaaaaatacaagaattagctgggcatggtggcacacgcctttagtcccagctactcgggaggctgaggcaagagaattgcttgaacctgggaggcagaggttgcagtgaaccaagatcaaaccatttgcactccagcctgggcaacacagtgagaatcagtcc

SEQ ID NO: 586630 - DNA, 416 bp, Homo sapiens
gtcgacatacaggccaccaaacccagacactattgtagatgccaagaagtgcattctgataggagcctgatacggctgtctcttgagaagccctgacagagccttaaaagtgcatagggagaagctcacagccatccattggactgagtgcagggtccccaatagaggagttagagaaaggactgaaagagttgaaggggtttgcaacctcataggaagaacaacaatatcaaccaaccagacccccccaccagagctcccaaagatcaaaaggaaggaagaccaaagagtggatgcttcagtcctacttagaaaggggaacagtataatcaagggaagtagagggtggatttctaagggtgggattgggaagaaaggagagagaaggggttatgattagaataaaaggtcgacgc

SEQ ID NO: 586631 - DNA, 215 bp, Homo sapiens
cgggcttggtaggactggtgggccccgccaagagggttgatgcccggcacaggctatgtctgatccccgcggctggtattgtgagttcacgcggagcgtgcagtatttcctccagtgaaggactgcagtgtactcgaatggtacgcctctcctcctgggtacagacgcccatgtctgttccactggcctcctatcagcgcgatgcttgagcagac

SEQ ID NO: 586632 - DNA, 384 bp, Homo sapiens
gaaccactggtaactcttaactgctgactgcttttctgtggagactgctggttgcatacaccaccatccccctattgctgcacgttaggcgatcttcacctcattactgaggacatcttgggccggatagccctgttgcgcggtcatcctgtgcgtcgcaggagatgcacctgcatccatgaccgcaacccatcagagtgctctaagaacggaagcatctgggctggatggaatttaccatcaagcacagtccccttgctgttcagagtgtgcgcaggtgcataaagatgaagcaggcaccagaaatcctcagcagtgccatcgggaagactccgagctgcgaggagaaccgcgagtgtgctgcgttcctcagcaaagcccatc

SEQ ID NO: 586633 - DNA, 448 bp, Homo sapiens
ctgttccctgcaaatgtatactcaatgtctctgctgtggacaagagtacgaggaaaatataacaaaattactatcactaatgacgagggccgtatgatcaaggaagacattgaacgtatggtccatggaagctgagatgtacagcgctgaagatgagaagcagagcggacaaggtgtcatccaagcaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcccgggggtaggaggt

SEQ ID NO: 586634 - DNA, 127 bp, Homo sapiens
ccccgtggcgacttgctccttcatcgccttggggtcggcgatgacgaggcggtggccttcatcatgagcgagggcttgaccttgaccgcggccatcgagaagccggtgatctgctggaccgtgttcg

SEQ ID NO: 586635 - DNA, 1382 bp, Homo sapiens
tatggctcatgtgcatcaatataatgcgtagaatataccattctgcaggtgcctggggaagtactgagtatgatcgcatcacacctcatatcactccctactagtgccataaaaggcacatactactatcgacggtatcatgatagcgtaatctcataagccatcaagagccaacatcactcatatagcgcagatatcgatgcctataggccatgagctagctcattaggccagaactgaggaaagaacagacggatggggccaaacgccacgtagataggtcgtcaacacttccaagaagagatatggccatagacctacgatacatagagccgtcaaaagcctacataccaagagcataagagactaactcgatcaccaggacacatatatgattaagtagacactgaagcatgcactataccaaaaaagaacaaccataaatttggaactcaaaagagaaaccgcacaccaacagcaactaagtcacataaagaccatacaataccacgtactaacctaatatgcaggagaagaccagagaatcagagagaagaaacacgataagtcggagcgatggaatcgcaacaaaagcctaataaccagaacagaacccaccaataacaagaaccaacaccgtacaccaaagaggacagaaacgaacacaggaggaccacagaaacacacacaccacgaaccaaccactaggacaacgcaccaataacaacgagcataaaaaatacaagaagacaaaccacacaaaagcgacgaaacaaaaaaaacacaaaaaacaccaagcaaataccataagcagacacacataacaacatctaccacagaaaaagataacaaatacaaccacaccaacaaaacacgacacacagaaagtagaaacactcaacacacaagagaaaaacaaacgaataaaaacacaccaccaaatagcagaaaaaagataaaaaccagaacagaagacaaaccaaacaaagaaacgcgagagaaaacggacgagaaaaaaaaaaaccgaacaaacacaaaagaccaatagaaagagacaccaccacaacacaaaaagcaaaagacaaacagaggacaaaagaacaaaagaacaaagagcaactaaaagagaatcgaacatcgcagcaacagaaggcactaaacagacgtaaagtcaaggaaaagaaactaaaaagcagaaagccaacaacaaaacaaaaacacaaagaaccaattaggaacgacagtagaaacaaaaccacgagagcacacaaaggcaaagtaacgcgatagaaaagcacaacaaaagagaaaaaaaagaaaaaaagaactaaaagagaaacaacaaagaaaagacagaaaaagacaacaaaccaaacaacaaa

SEQ ID NO: 586636 - DNA, 167 bp, Homo sapiens
cctcagctcccaaaagagctgggattacatgtgtgatccatcacgcccgatctatttttatttttctttagagatgagctcttgctctgttgcccatcctggtctcgaactcctatgctcatatgatccttctgcctctgcctcccatagtgatgggatctttagtc

SEQ ID NO: 586637 - DNA, 362 bp, Homo sapiens
ggcttcctcgagctctgccctgtcccctccacatgtccggagttcggcccgggagcaccccaccccgcagagggcgccactcccggcttcctggagacgcaggaagccctggggcgcagcaatcccacagcgcggccgaggtaggactgggggtcccgcagcgacagcttttctatggtgggtctgcacgcacatatccggacaggcggagaaagaggccgaggcggccacctatctcctgaggcccgcaaagacagcccgatctcataaaggtctgaccagctactaagaagatcctacgcccgaagataacagaagtgatcgccgaaaacaaaccatgctatcctcaacagaaaacgtga

SEQ ID NO: 586638 - DNA, 595 bp, Homo sapiens
  misc_feature (65)..(65): n is a, c, g, or t
  misc_feature (76)..(78): n is a, c, g, or t
  misc_feature (81)..(81): n is a, c, g, or t
  misc_feature (83)..(83): n is a, c, g, or t
  misc_feature (108)..(109): n is a, c, g, or t
  misc_feature (114)..(114): n is a, c, g, or t
  misc_feature (126)..(126): n is a, c, g, or t
  misc_feature (129)..(129): n is a, c, g, or t
  misc_feature (149)..(149): n is a, c, g, or t
  misc_feature (163)..(163): n is a, c, g, or t
  misc_feature (220)..(220): n is a, c, g, or t
  misc_feature (291)..(292): n is a, c, g, or t
  misc_feature (389)..(389): n is a, c, g, or t
tgagcactttttaatcagaactaatctttactatgttccgtcctttcaagtcctgaactttgctntcaatcaatannncangntaatatgtggttatttttgagtggnnattantatattaagagnganagtcattaatttggtgcagnaaactctaattatnatataataaacgtatacaacatctatgcacccaatattatattgtattatttgatanaagacttccagaaacaatgaccaactcaaaaggcataatcctagtggtgacaattatggggaccagggatnngtgaaagaaaaaaatattcccaagtagtagaactctttttcttttcttttcttttttttttttggagatggagtttcgctcttgttgcccaggcggnagtgcaatgacgtgatctcggatcaccacaacctcggcctcccgagttcaagagattctccggcctcagccgcccgagtagctgggattacaggcacccgccaccatgccaggctaatttagtattttcagtagaggcggggtaaccccgtgtaggacaggcgggtcttaaaagccggacctcaggtgatcccgctgctcggcccc

SEQ ID NO: 586639 - DNA, 618 bp, Homo sapiens
  misc_feature (13)..(13): n is a, c, g, or t
  misc_feature (88)..(88): n is a, c, g, or t
  misc_feature (99)..(101): n is a, c, g, or t
  misc_feature (104)..(104): n is a, c, g, or t
  misc_feature (106)..(106): n is a, c, g, or t
  misc_feature (131)..(132): n is a, c, g, or t
  misc_feature (137)..(137): n is a, c, g, or t
  misc_feature (149)..(149): n is a, c, g, or t
  misc_feature (152)..(152): n is a, c, g, or t
  misc_feature (172)..(172): n is a, c, g, or t
  misc_feature (186)..(186): n is a, c, g, or t
  misc_feature (243)..(243): n is a, c, g, or t
  misc_feature (314)..(315): n is a, c, g, or t
  misc_feature (412)..(412): n is a, c, g, or t
agaggaaaaacgngcctagggaggaaagttttttaatcacaactaaactttactatgaaacgccgtgttgtgttaataaattttgctntcaatcaatannncangntaatatgtggttatttttgagtggnnattantatattaagagnganagtcattaatttggtgcagnaaactctaattatnatataataaacgtatacaacatctatgcacccaatattatattgtattatttgatanaagacttccagaaacaatgaccaactcaaaaggcataatcctagtggtgacaattatggggaccagggatnngtgaaagaaaaaaatattcccaagtagtagaactctttttcttttcttttcttttttttttttggagatggagtttcgctcttgttgcccaggcggnagtgcaatgacgtgatctcggatcaccacaacctcggcctcccgagttcaagagattctccggcctcagccgcccgagtagctgggattacaggcacccgccaccatgccaggctaatttagtattttcagtagaggcggggtaaccccgtgtaggacaggcgggtcttaaaagccggacctcaggtgatcccgctgctcggcccc

SEQ ID NO: 586640 - DNA, 633 bp, Homo sapiens
gggaagtaatggcccttgtcttgagtaacgtcaagtgttagtggtaggccagctaatggcaaatcctcaggctgagaggaaggctgggcctgtagtactggttgtgactgcgattaagactgaagctgtgactgagactaaggctgaggttgagccacaggctcaggttgatgctcagactctgattcttctaactcctcagactcctggtccaagtctatagcacatacattgtctatagcaggagacagcgatctacattctagatctggctcaatatctcattccatgtctggttccaattctctgctagcttcatgttctgaaggttctacactctcaactagatcagttgccattacctagtggtcagcaattacatgtttgacactctcaaccatctgtagcacatcgataacttcttctgtctgactatcatgctgcttctcaccataccttacctcagtttcctcatccatcataacctccatttcctgtatgtgttcttcctcgtcctgttctttctgtgcatcactatgaacaatcgctatttcctcatcctcgtcctctcgtgcttcctctatctctacatcattgtgataattacctgtctcctccaactcttcctctcgc

SEQ ID NO: 586641 - DNA, 1092 bp, Homo sapiens
ggtggttattatgtgcctaactctcggagggccggtggtctagatgtgccgacgtcgactcactcgtatccgagaacgaagagcgctactaatgttgcctcatgcactaggatcgtgcaaaggtgccaggcgctgtgaattggaagagactacattgctggacgcgcaggaagagagtcactgctgggtcgtagcagagttctgcagttccgtgcgtgcatggtagactgcatgttgacgacaccgtgggtcacaggagatctctggaccatcataaaggggtactgaggaaccgtcatgaaatagatactcgcatcaacgacgttgttcggccccagtacacctcaagaaccgggcctgtctcaacttacgcgttgcccaacctggactgtggtgcgccgtgtacgactagctgaacgagaggcagagcgccgcgaggttcctatacggggcctcctgacgcctatggtcgtatcgcatcggcggccctcggaaggtagcgacgttccaccacctttgttcgtgccctccttcgagccttttcctgtggggcatcggttgtcccctcgatgtcgcctcgctttcgttgcgtcctagccatcgatcgttcggagcgttcctggagtatacgtgccaggagaaaggtcgataggaacgtccgttggacctggcttgggatccatgcccaggggttcttgaaacctcgcttgaataggaggcatacatagtggtagtgacaacctattagatgttcgaacatgggccccggaaccggttaccccgcccaagaagaggaaacgtgctcacccgtgaactgcttgcagtgtgggccccaggaaccgtactggttacccgcttgagttgcccgtggttattaggggcctggcgccgatccgcggtgctttgcgtcccgcgggccgcgtttgcccttctatgtccccctttttttcctctagactttctcaataagagaaactccaaggcccggtatttaattttcgcaatctaggatcgggcttcccgtgtccttttggtgaccctccgaggttggcggtttgggctccccttttagggaatttcgtgcttcctcag

SEQ ID NO: 586642 - DNA, 159 bp, Homo sapiens
cgatcgtgtaggcaggacactggcagatcactgagtccaggagtcaagacagcctgggaaacatagaaaaagcccatctccacaaagaatacaaaaatgagctgggcatggtggcatgcacctgtggccccagccagtcactcctcgacacctccacgc

SEQ ID NO: 586643 - DNA, 941 bp, Homo sapiens
cagaagtctcctaagaggtggcgcgaccaccaagaagggaaagggccccccaaataaagtgtctacaagggtcccagaccacgaaaaagtggcgctgacgttgtgacagagacagccaaccgtggtatcctgtcaagagacggccccccccccaccaatggctttgagacagccctcaccagcaggatgcgtctagacaaagtgtgccgagcgggaacaactaccgccaagaagcggttcgcggtccacctctcgggcccgggcggggcgaaacccccgcgtgaaacgcaacatgggggcgggaggccacaccaccgctccgccgtcatagcccgtgctcttggcgccagcggctcatatgtctatagtgaggttccccccagtatggcgataggctggtatatggttgtaggccccccccgtgagagaagtaagggatgaccaccctgtcccgccggcctgcttgaacggcgaccggagatccctcaaccgccagcgaggagtcgatttctcttcgccctccgaggccagtcgctgccttctacaagtgccgacgttgccgcaggttttcccgcgtagttcgcgcgcgcacgccacggggtataccacgctgtcggcgcccgtgggagaacgcctccactcgtttaccgccgctttgaatcatgttctcagcaccgcagttctcccccccacgtcgtggtcatctcccgcaatgcatgctgtgatgcgagctcttgtgctgcgggacgcacagttttttgggggcgctctggcgcaggccccccccgatgggggaccccccgcctcgcccgcgaaatcccgcgtgtttgcctggcattcctgcgttcctcttagtggggtgggtgcagcccgcccgcggttttatccccgggcccccgtctgggcagttaaaaaaattcggatttccccttccacatgac

SEQ ID NO: 586644 - DNA, 322 bp, Homo sapiens
  misc_feature (298)..(299): n is a, c, g, or t
actgtcaaaaatttttttacattgtgttagtgaagactgtgttttcaggttaaatgatggtatcaatgtatatagagtaaaattatgcaaatttaaaaatgattttctggcatcttttaaatactctgaaacatatatgcaatgagaaaccttaatcatactaaagccagttatgttaagaattttccttggattttataattaagagtgcttataaatacttatgacatgagccctacggtttagtgtcttaaaagatgggacagtcatgacgggttctttttatcccgagggtccnngtaccggccaggatatccgaggc

SEQ ID NO: 586645 - DNA, 366 bp, Homo sapiens
tgatggaagcaaatataatagtacatgctatttggccacatctcaaatgggtgatagtgaacattcactgaagtgtcatacatggctcttatctgccaggtcaaatcttctttccgagaacgtctccgccaactgttgtcaagcatttctggtggttcctagatacatgaacaaaacctcactcgactggtttactgagagcagaattcaacaacacccgggtgccaggttattaaaaacactcttttacattctttacatctatggaacacaacaatgtgatcgtcgtgtctggcttggtttgaatacatcttcaccgagctaagtagctgattgaacttacctaacctgacaggaaaaaaaaaa

SEQ ID NO: 586646 - DNA, 445 bp, Homo sapiens
gatcgccttttctgttctcattgcgctagctgtcccagtggagaaggaacaagcgcctcactgcatctgatgctagaacgggctggcaaactgtgtcctgggcagtatccccaaagtcgttactagatgtgactttgacgtgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggcttctgaagaattatccctgaaactgccaccaaatgtggtagaagaatctgcccgagcttctgtctcagttttgggagacatattaggctctgccatgcaaaacacacaaaatcttctccagatgccctatggctgtg

SEQ ID NO: 586647 - DNA, 104 bp, Homo sapiens
aatggctgtctcgcggcctgttcgcatgagcctgcgggagcgcccgatgcccgataatttgccctcccttcaaacccgtgcgacaagctctgccagcgaatctg

SEQ ID NO: 586648 - DNA, 1519 bp, Homo sapiens
ccggggcacaaggtgagccgagaaaagtttggctgtgacacagggggagcgaaaatcgcgctgggggccaatgcggtggaagccaagtggcccaaggagtgccggacgaatgttaagggcggtttttaaccgtatgcttgatgggcttcaagaagacggcgacaattggacaaaagagggaaggggaggggaagtgagtgttggcgtctaggagcacagcacgtgccggtcagataggaagacccgtcatgccggggggccctctctaaagtgctgggggcttcccgcgcccacatgaacgggggaagtttccgtgatagccaagtgtctgggaaaaagaggacgggcacacctgtctgggcgcacaggcctttggccaggtgttagagaggccgctcaggacgctgatcgggcttgctacagccaacgtttgtaagctgtggggggtgcattgcaaatctggcgggggacagaagacccaagtgaccaaccggcgcggttgtgaccacggaggccctcccacggttgctcggggggaagcaccgcccatgttggctctataggcttgggggccacggtgttgaggtagcactggaattgcggatgttaaccggaggaagcagaagcgcgtaagggttgccaccggtttgggaagttatggcgttgaagttggaacaaaggatgaaggtgaagctgttgccatggttgccgccaagaagagtggtgctaaggtaggaatgccacggtcgtatgagaacaaagggcgtggtgaaaggtggaaggtgtaaaaaggaggagtggagagtttgtgggggcaagaggaaaggaactgtgcggtggaaagttgtaagcggaggtgcaagccgagagatgggtgttggcgtagaagggagggaggtgtgtgtgtggcccgcagcaagggttgtgcacgagacgccaagtcaagagaaagaggttggtgggagaggtagagaggcgggcagaaggggagaggcgcggagagggagagggagagagaggcgtcgggtagacgaaagagggagaggtagtagacggcgcagtgtgcgcgcagcgcagcgcagcagagcccaggagaacgtgcaggagtcggagtagagaggataggtttgggggtaggtgagtgagagtagcgtgtgtgttggagagggcagaagtgcaggaaggagaggcgggccaggaagatagtggaaggcaagtagaagggcgtagaagcaaggcaggaaggcgcagtcaggtaaggaggagcaaggagggaagagagaagcaaaggcatgttattgccagcgctaagggaagagaacgcaagttgtgaaacctaagggaaggcttgctacgtgaaagcgtaagaagttgagtgtggccagcatgcaaggaaaaggttaagaaagcaaagaataagaatactgggagctgcttagcagctgatagaaagttgcacttaagatggaggtcagatgaaatagaaaaagaagataaccacgtaggcatagcccttaag

SEQ ID NO: 586649 - DNA, 1147 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtatttgttcatgccttccctttgtgacttcaagaaccctgacttctctttgtgcagagaccagcc

SEQ ID NO: 586650 - DNA, 871 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtatttgttcatgccttccctttgtgacttcaagaaccctgacttctctttgtgcagagaccagcc

SEQ ID NO: 586651 - DNA, 129 bp, Homo sapiens
agcctgtgcaggaggacaagcggcgggaaaaggcggagcggcgtgcagactagcaaggaagcaagtcagagacctcaggcccagatcaggagctaactgatgaagaggcagagaggctgagctagagat

SEQ ID NO: 586652 - DNA, 897 bp, Homo sapiens
gagacagagtcttgtggtgtcacccaggctggagtgcaatggcgcgatcttggctcactgcaacctccacttcccgggttcaagtgattctcctgcctcagcctcccgagtagctgggattacaggagtgtgccacgacgcctgcctaatttttttttttggagacagagtctggtgtcacccaggctgggagtacagtgggtgcaatctcggctcactggcaacttccaccttctgggttcaagcagttctccggcctcagcctcccaagtagctggcaggtgcctgtagtcccagctactcaggaggctgagacaggagaatggctgtgaacctggggaggcagaggtttctgagctaaaatcgaccacggactcctgtgcctgagcgagggagcaaggactccaatgtcaaaaaaaaagaaaaaacaaatttatgcagctgtttttttaataattaaatggtgacttattattatttttggaggaacagggtctgtgcttggtcgcccaggcagtggcatgatcatggttactgcaacctctggtctaggtcgaagcaatccttcccaccttcagcttcccaaggtagcaagccgaatcaccggggcaaatggccaaccaataattcgggtaagtacgtagtgcggacaaggaccgggtttcccccatagtatggcccaagggctggcctgaactccccgggtcaacgtgggtccacccgggttaggctcacgaaggcccgcaaattcaggtgtcgaccccgggccaagtcaggcagcgataacactcggcgggggtcacggctcgcactgagacacacgcttcgcacaacggcgccacctgtcaaacaagctagaccaacggctgggacagccaagggagcacgctatagtca

SEQ ID NO: 586653 - DNA, 155 bp, Homo sapiens
cgaatctagagtatgcccgtacagagttgaatgttttcacatgtgtaaccagcttagcagttcccagattttatatacgtttaatcccttcagggcatacactatattatctccattgggcttcatgcgctactgcaagaaacattgtgatcatg

SEQ ID NO: 586654 - DNA, 131 bp, Homo sapiens
  misc_feature (25)..(25): n is a, c, g, or t
  misc_feature (49)..(49): n is a, c, g, or t
  misc_feature (108)..(108): n is a, c, g, or t
ttccctgcacaagctctcttttgtngcctgctgcatccacgtaagatgngacttgctcctctttaccttccaccatgattttgaggcctccccagcctgtggaactgnaagttcaataaacctctttcttt

SEQ ID NO: 586655 - DNA, 415 bp, Homo sapiens
  misc_feature (415)..(415): n is a, c, g, or t
cctagactacctctatggcacagcctacgcagaggagagggcatcggtgagtctagcctggggatatgacggaacatggctctgaaacaccctaacagaaataacactagctcagtagaaatgtatgcacaacccgaagacctgactgagaggcctgacagtgaatacaggcgtgtactactaagctcaatggctggggaccaagataggaatgagtcagggcatggagaacgaacctacattgatgcactaaggatgtggacacatttcaacgaagcagacaggagtaagaggaaggaatcagcactacaggaggcattggtcacgctaacagaacgcatgatggtctgagcgtatcagtggtacacttgagcatggtacgatatttagtgctcacagacgaggtatatggagn

SEQ ID NO: 586656 - DNA, 574 bp, Homo sapiens
cagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgttgggccacctggcagcctgcctgcgccagttgggaccctcccgccgcccggcctcgctgtccccggctgccccctcacatgccccagcgcggaaggtctacgggggccgcccattgctgccatcgctcgcagggccctttccatagtgctcggtgccacatgttcatgcagagtgtctccacaccgggcctctcgccaaccgcccccaggggggggcggaaggtgcccggagtggcgccctggagtcagtggctgctttgatgttgtggccttaagaatgcattggagggggtgcccagttaaaggtccgtggcctttgcctagaatgtagcgtagaaatggtatttattattccaa

SEQ ID NO: 586657 - DNA, 286 bp, Homo sapiens
  misc_feature (96)..(96): n is a, c, g, or t
  misc_feature (214)..(214): n is a, c, g, or t
  misc_feature (225)..(225): n is a, c, g, or t
agcctgaggaggagacaggacagagcgtctggaactgcaggaggacaccgagttccccgtgttggcctccaggtcctgtgcttgcggagcgtccgngcatcgggatcgagccccgacaatgggcaactcgcaggagcgccgtcagagactatcgaccgcgagcgataaccctcggtcgagacgctgcaggcgacatcgggactgctgttggacncactgctggcngtgccgtgctcaccgggccagagtacgaggcattggatgcactgcctgatgccgagcgcag

SEQ ID NO: 586658 - DNA, 358 bp, Homo sapiens
gatcatgtcaggatctgtgatagccagcacagcctgttgcccttcataaaagccccacacttttccacactttttatgcacattccatgtcaaccatccaaaagccctaatggtaggccaaaatatttcccaaaaagccaaagtgtgtggcccttggaattccaagcttcttaaaaagtccatgtgaatgggttccatatagatagagaagccacaggttcacagccagaagaagccaggtttccatggccaagtctggtatgagagccctcactactctcctcacatctctctctcctctgagtcctcctcacagctgtgtggcgctctgcgctggtctatgcgcatagagctttcc

SEQ ID NO: 586659 - DNA, 157 bp, Homo sapiens
tctcacccatctgcaggtgtcaccacgccagagatgggagaggtatggggatcgtgtcactgctccccatgaacagcccatctgtgtagtatcacatgtgttggggaaaaaagggggtccacacataagtcataataaggagtctccctctacttta

SEQ ID NO: 586660 - DNA, 532 bp, Homo sapiens
ctgtgatcccaacacttgggaagtgaggcaggggatgctgagcccaggagtttgagactagcctgggcaatacagtgagacctcatctttaaaaataattaaaaaggtcaggtgcggtggctcacgcctgtaatcccagcattttgggaggacagtggatcacaaggttaggagtttgagaccagcttggccaatatggtgaagccctgtctctactaaaaatataaaaaattagctgggcacatgcctgttgtcccagttatttgagaggctgaggcaggagaattgcttgaacctgggaggcggaggttgcagtgagccgagatcgcgccactgtactccagcctgggcgacagagcaagaatctgtcttaaaaaaaaaaaaaatgggccaggtggtgggggcacatgcctgtagtcccagctgctcgggaggctgaggcgggaggatcgcttgagcctgggagtttgaggctgcagcaagccgtgatggcactactgcattccagcctgggtgacagagtgacggtctc

SEQ ID NO: 586661 - DNA, 752 bp, Homo sapiens
  misc_feature (750)..(750): n is a, c, g, or t
tgctctcctccctccctggcttctccccatcttgctgccctaggttctgtctgcccatcccctggatgatctcatccactcattctcaaggctttataaaccatctataggttgacagcttctcaattaacatctccagtctaggcctcgcttctgagctccagatatgtcaagaagccgtgacaccatccaaaacagatctcccctctcaacttgctcctcccaccgtcctcatctctgtaaatggcaactccacctttgcagttgctaagctcaaaaaccttgaagtcattttgatctctttttcttcacacctcatatctaatctcttattaaatctattgtctcacactgcaaatagatccagaagccaatcacttctcaccacctccaccatccaccgtccacttctgtcacctgggtatgagccactatcttctcttgccaggtggctgtagtggcctcctcactgggcttctgcttctgctctctccaactccttcatttggttttcaaccccagtagcctgaggggagcctttttaaatgtgtaggatatggtcacttccctgctcaaagccctctgacatctcctcttacaggtccctgtctcctttataataaaagccagagccaggcacagtggtatgtgcctgtaactccagctactcagaaggctgagtcaggagggactgcttgagccaggaggttcgggaccaagcctgggccacggcaagaccctgtctctttnta

SEQ ID NO: 586662 - DNA, 191 bp, Homo sapiens
catggtgaattacagggaccgccaccaaccgttagcatgccgtctgtagcatgggaggggcctggacgcatagcagggccgtctcacgggctatgtgtttcacggttgcacatttaaaacggtgggccccggcacgagtggctcactgcctgtaatccccaacactttggggacggccaagggcacaaggg

SEQ ID NO: 586663 - DNA, 192 bp, Homo sapiens
tcttgaggtcacaggacggatagtattaaatgtcttctgcgagataccatgcattatcgccgcagttagggtatcatcactcgatgaggcatccagccagaacgcctgaacgcaggcacatacttcctatgctagaccctagtaggctcccttcccctactcatcgctctaatttagcctcacaacacccta

SEQ ID NO: 586664 - DNA, 188 bp, Homo sapiens
caggtgagtagagacagtaatgggtacgacgactttaggaaactgtttgggggtggtggaatactctatatactgacaagagtttatatacttgaccaagacgtttactatactttgtcaaacacctcctcaaactagtactgttaaacgaccgtacacggcgtttccctactgtactaacactttta

SEQ ID NO: 586665 - DNA, 320 bp, Homo sapiens
  misc_feature (23)..(23): n is a, c, g, or t
caaaggggaaaggtccattaaantaactttaaaggggcttagggtgtgctgaccaggtcatggggaaatcaattagggtataaaacttccactttctaaggtaatgccccatagtgcttgctacatctcaggcattgcagtccattaagctcagttatttgtagatttcatcattaattgagcacctcctgacttttatctattattctcaaagggttattttaatgtagttagagagattttattctattctttttaagatacttaagtttctttttaagatactttaagttttgagcttactgtaattaactacaagg

SEQ ID NO: 586666 - DNA, 116 bp, Homo sapiens
agacttgctccaagactaaatctctcaaggataacctatttgccatcagttgataattagtaaaaattagaaattttagaaagtcaatgggaagccctgtcctgccagtttcttaa

SEQ ID NO: 586667 - DNA, 270 bp, Homo sapiens
cagccgcctcacgcacctgagccccgaggagaaggcgccttagggagggaaacctgaaaaaccagagtagccagccttcaggaccttcccaagaggatccggaaaggaaggcctcttgaatttagttgtagcccttggaaccaaccaagaatgggtaggaattttagggaggaggaggaaccccaaaaaactctttttttctctagaaaaaaatcagcgcttttttctgggggaggaaaaacccttcatgccccttttgtagtgttttag

SEQ ID NO: 586668 - DNA, 535 bp, Homo sapiens
  misc_feature (41)..(41): n is a, c, g, or t
  misc_feature (118)..(118): n is a, c, g, or t
  misc_feature (405)..(405): n is a, c, g, or t
  misc_feature (450)..(450): n is a, c, g, or t
  misc_feature (481)..(481): n is a, c, g, or t
ccgctcgtgccgctttcctggctcccctgggacagggaggnagggtgaagatggagggaatctggctggctgggccttgtgtactggggggtggagggcccatttgactgcaggaatngtcaagcacataagcaccttgaagtgtgttactaagatacaagaaacaggtttgcttttgcctattccagcatggtgtacctctcttaggataccttttagcacaggtagcagaataccagccagcctcctgtggctcacagcattaagatatttaatcatctgacattacatgaagtccagtgttaggcaggcaggagctgctcccgtgactcagtgacatcaggttggtccacatcctagcagttctcttggtgttcctgcgtgatcaaaggatgactgccacancccagcctgctgacctcagccctggcgtgggcataggagggtctncgtggctgagcatccagtgtccttcgtactnccactgacagcctgggcgacagagcgagactccatctcaaaaaaaaaaagaatc

SEQ ID NO: 586669 - DNA, 170 bp, Homo sapiens
  misc_feature (139)..(139): n is a, c, g, or t
cgagtgtgctgggtcgatctaagcgatccctagcggtcgcagtcgtattgaaaaaataggtaagtaaacataaggaaataaaaaacattaaaaagtactaatatatcacttttttcatggtcaactttagtctcagaanaccattaattgatatttccttggtaaaacat

SEQ ID NO: 586670 - DNA, 286 bp, Homo sapiens
tatactagcgtgggtctggtggacgcggactccacgactccaatgagtgtagcgttacgggaacaggattgttcaaagatcagcgagaataatcagaaacataacagctgcttctattaagatggtagagatatgctaaacgttaatagaaactgcacgtgccagcggggcaaaatccagtttagatagctggagaaatcccgacccacgctgcttgcggacgcccgggattgaatgagcaaaccctaggcgagcaattaaatctgagtctaagagcagtacatca

SEQ ID NO: 586671 - DNA, 138 bp, Homo sapiens
acgctgaccgcgtgttcaaataattctcctgcctcagcctcccaagtagctgggactacaggtgcgcgcaccacgccatgtaatttaggtatatttttttccttattttcgagtcggagcccgagtatacacgccctt

SEQ ID NO: 586672 - DNA, 187 bp, Homo sapiens
agagagagagagtcaaagagaaggaccaaatgattagagtcctagcgaagatcactatctctgcttagcaaaaccactcttaacaaagtccagtgaggtctcagagattttctcgaagcaaggagggaattaagcattgagagcagccaggcttcctacttcgcactgcaccacgctcatgcgcatt

SEQ ID NO: 586673 - DNA, 202 bp, Homo sapiens
tgttcagtttctgcattatcactattttccccaatagtcttctcatgtaaattacttcctttttcaattaaattctcctgtatagtttgttcatcaatcattttttgtttatgtaacacatcatcttttatatgcaatggacttttttgaagaggtttttcttcttccttacttctttcctttttttgatgacttttttcct

SEQ ID NO: 586674 - DNA, 131 bp, Homo sapiens
gactgagccctgatgattatatgtaagcttgatccgcatcgcagctgttgcttctgagggtcagaactttaatgacttgtgtgatggtccccgtgttacatgctgggacaatgctgctgctaggagacaag

SEQ ID NO: 586675 - DNA, 123 bp, Homo sapiens
atagatgcgcactggagctcatctatcgggctggagggatacagcagttcgaaagcgcgtcatttctctccttcagtagtgcagaaatgagtcgattcacagtacacacagaactgtaccagt

SEQ ID NO: 586676 - DNA, 234 bp, Homo sapiens
tagcacgctggagtaagtgggtgcatcttggctcacctaacctctgtctcccagaatcaagtgattctcctgcctcagccgcctgagtagcttggattacaggcgcatgccaccatgatgcccagctaatttttgtatttttagtacagacagggtctcaccatgttggccaggttggtctcgaactcctgacctcgtgatctgcccacctcggactccagcgtgctgatacaa

SEQ ID NO: 586677 - DNA, 396 bp, Homo sapiens
  misc_feature (328)..(328): n is a, c, g, or t
  misc_feature (336)..(336): n is a, c, g, or t
  misc_feature (355)..(355): n is a, c, g, or t
cccaggtgaggcaaaccatggttgctgggctgtagggtgagtggcttgcttggtgggacctcacaagttggtggcatgggaaggatgtgggtctttagtcccttgccctggcttagctgcaggaaaaaatggctgctttcccttccccccattgagctttgctccctttaagccgggtcttttgtccctttttattttggtctccaaaatgaatgctcatctttggagggggccaggtaaaaactagggaggggagtgttttctctctccaggtttccccttccagtgtgcaaaagttaaaagggtttggcgggggcagtgccttacncatgcttnattccccccctcccccctnccttgggaggggtgtggaataaattatttttgttaaggcca

SEQ ID NO: 586678 - DNA, 368 bp, Homo sapiens
actttcttgacgaaaaaaaagcatgtacttcctgctcacaatcttcaaatattccatctctctctcttctgaccattcacatcagactacaatttttcatcatactgccaagtcaaaccctctgggtccactgtgctctgactcctagtctctgagcatctctacactgaactatgacagccaaggagaactcatctatcctatccatttcggtccactttcggatgggccctccgaactgctgaccaatcctattaattcatcacttgcttaactttcaaacttctcccagatattattttagagtctaagctacatactactctcaaatcctcattttctcttcccagcttctttttcatttttgg

SEQ ID NO: 586679 - DNA, 250 bp, Homo sapiens
cggtctccacttggtgctcaggacttaaattattatgccaaatgagtcattaataagcattgaatgtatatagtatattatccaagatagaaataacagtatgaactgaaactgacttcatcttgccactctgtcatccacatctggagatggaccagcctccagcagtgaccccatcactatcgtggtcacagaaaaggaagtaagcagaggtcttatctggtcttatcttgcgaactggatagatatt

SEQ ID NO: 586680 - DNA, 1157 bp, Homo sapiens
ggcgcgctctgagctgaccccagtgatccctcccccgccgaccagcagcccatttggagggacggaagtaagtggaagaggagagtgaagtgggagcctggacctgactacccagacagagccggtgaatgggttttgtggtgaccgaaggagacgagacagaaggagagacgaggcaacgagagcccagaagagagccacacacgatgtaaccgccagacagagagagcagggagaagagaaagagagaacaggaagagaggagaacagacaaaagcgaacacaagcagggcacaaagagacagacaggcagagagagagcaggaggacgagcgaacacgcgagcggaagggaggagaaagatagaggaagagaacagaggagggagcaaaaagagggaagaagataagaaagaaagaaaagagaaggaaagaaaggagaaaaaaaggagcaacaaagaacagagtagaggaagaacgagaaaagaatggggaaagaagcggaaagagaggagagcaagaggaggaagagcaggagaaggcaggcgaggagagagcagcaggagacaacggaggagaagagagacgaaagagaagagaaaaggagggagggagagagggcggaacagggagagagaagaagggaggaagagaccacgccaggcgccagacgcaggagagaacgagacgaagagaaagagaaaggaaaagaagcgacacacagcaccgcgaaaacgaggacggacagaagacaacgaacaaagacagaagcgcacaaagacagacgaagcgagcgcccagcaacggcagacagagagccagacacggaagaaacaagagccgccggaagaaactcgcggagaagcgagaggacagacgagagcccagaagcaagagcagcagagccggcgccgcggggcgaagagaacgcaccaggcacgaaggaaacaccaggccgaacggagccaagcacaaaagagagaggaagaaacagcaacacgagaagagacgaaagcgcggaacgaggaccgaaggcgacaagaccgtaccgagaccgaaagaagaagcacgagaagaaagaacaggaacagatacagcagacggagagacgccgagcagacgcggccgcagccacggagacacgagacacagggaaga

SEQ ID NO: 586681 - DNA, 184 bp, Homo sapiens
ggacctaggatgagtcagtgctgtgcaagacaactggcaggagttgcataacatctatccagtgagtcctgcaagaatacaggctctactacctccagcagctccctgctgagcctggggcatgagatgggcctatggacttcttcctcttacttggtcctatttaaattctagtccacgtcac

SEQ ID NO: 586682 - DNA, 1278 bp, Homo sapiens
gcggcaggggggcaacaggcattcgcctctcctcagagcaacattctgcacattccatttcacagttctcaagccattagcatttcatagttcatttcatcaccagtctgggcatctcaattcaggcaacacatgtagtttatgtcagttcgtgcgataaactcatttcatcacgcatgatttcctccccacaaacacacacacagagcaaaactccactttcataaaagccctcatatccactggacagatccccgtacgacatcatggtctccaattgtgtacaccgcccaacagtccaatctcatgtcagcaacagcccatatagcgctggcatgtccattggggccacacagctatcatgcattaccacaccagcacagcaactgcccaaaatctagtaggtgcacacaactatcttccccagtgcacaataattggtaataaacacccccacttaaggcacactaactcgcaacaacgcaccagatggctattcactaaccagtaacctctctcgcttcattggcaaccaatcaggcggcactccaccgcgtcgcaaacacttacagcccttcacgaccatttacattgacacaagacaggaaatatcggtgactatatacacatttcaggctacttcaaaaaatactggaagacttaggaggtaagcccactagccataaaatacacaacaccaacaaataaatgcaacctaacacctactcattgaggaattacacaacaaattcagggccgacgccaaaccgccaggtagcggaaaataacacagcacgacaacctacgccaagcatcaacaaagccatccgagcaaaacgcaccagaccggcgcaccaccaaccacagacaaaaacggaccgaggacaccccagtaccagccataaacatgaccaacaactgcacaacggcaacacaccacagacgcaggcacacccgcgcaaccaaaatacaaacgaccccacacaccatccgtgcacccaaaactacttcacaaagaacaaaagcaaaaggacccctacacccaaggagccccaacaaacggccaaaaccggaacaaaaaagggacgcaaacacacgacctaaccgacggcacaacaggcacccaacaccggaagcacccaacaaacagacaaaaaggaccacacaccacgaccgcgacaaacaacaacaggacacaaggagacaaacaacggaaacaacaacggccccacaacagccgcaccacgcaaaacaacacgccaaccccctcacccaaag

SEQ ID NO: 586683 - DNA, 354 bp, Homo sapiens
  misc_feature (320)..(320): n is a, c, g, or t
  misc_feature (327)..(327): n is a, c, g, or t
tgccatttggtctggttcttcagaagcagagaaggcaacaaggactgaagtggcagtgagttcttaagcaaatgctcccaggagaagcctggaaaggaggaggggaaggacaaaaagagagaggagccaaggaggctaggatttcaggcaaagtctcagcctcagcctgaccttacaggggtcttgagagctagactgcttagcatggtagccactagccagatgtggctacttaaagtaattaaatttaagtgaaattaacaattcagatcctcaccctccttagccatatttccaagggtccaattagccacctgtcntaggttngacttaccattttcgaaccggcacaga

SEQ ID NO: 586684 - DNA, 275 bp, Homo sapiens
atctctagagatccccggcgccacagcttctcttatcaaacttattactatacatcgtactacacgacatcgttctacgtttggttgctcacttccacttattcctatctatagtgagctgttttttccatctataggtaggcttcattcactgtatttcccctaatcctcaggtctacacctctaggaccaatacctacgcacttaatccatttcactatctagtattcatcgtgtttatatcttatccttcttcccacaagatcgttttctcg

SEQ ID NO: 586685 - DNA, 439 bp, Homo sapiens
  misc_feature (1)..(1): n is a, c, g, or t
  misc_feature (55)..(55): n is a, c, g, or t
ngtttaaaataggcaaataagttggctgagggcttgtttgtttgtttttctgtcnatttgattgtttctaatgtactgatgtatttctaaggaactgtaattgttacccagggttctcctttgcacgttgtttttccatcctgcagtcaagtgcactctctgcctctgtcacctacctcttgaatttgacttcagaatcgctgcctagctctaatcaatgaaagactatctccttctcattaaaatgagcaacaagaatagttgactattcttgtttatatcatactagaaaaaatttaaatacttggaagtcagagattagactttgtaatttatactagagagtaaattattcagttactactaaaataatataatgtttatccaaatatatgttcagatatatatgatgggcaaataaaagattgttttaaaaata

SEQ ID NO: 586686 - DNA, 144 bp, Homo sapiens
tacctgtatattagaagagatagggttgcagggttgccaggctgtctcagactcctaggctcaagtgatctgcccacctcggcttccaaagtactgggattacaggcatgagccactgtgcccgggctagtcctgattatgttg

SEQ ID NO: 586687 - DNA, 1495 bp, Homo sapiens
gcctgttcctgagacctgcggactcccgtagggtccccgtggccccgagttgtagtctgtggacacccctggcctgctgggtgatctgtcgtggtctccactgcgccctgggtctgcttgactgctggatcctgtgcctctgtgctgcctatctcatgtggctgcccatgcaattgcctgcatgtgcatgtgattgaacattcttggcaccctgtgctgtgatgtggatctgctgtccttgtgctgtgagctgccccaagttgccgtgatgtgaatggatgtgccagcatattgcactgtgtgcagcaagatgaccttaccacaccccctgctgtacacactgctgcgctgccatgttgatgcaaccgtgacaaggtgcacctgatgaggaatttaaatgactctccaatgtgtcaatttgttgtgttgtggtgtgaccttgatctggtagtggggagagactttgacactacatataagtatgtgttacttgcaaagagacaaccattatgcataagtgagattagcaatgtgcccaacccaatttgtgatgttgggagctttctggagtgattgtgaaaacagaagtatttggagggttggcttgtggtgacatttccccttacatgtatttgcaaggcatttattgtgagaataacgctgctttgtgtgcatgcggagatgtgattcaaagtagcagtttgcaatacaagcctacatataagagtgatgctacaatgcgcatacactcaatatgtctatcaaacgctgaaattgagtgtgtgcatactcttgtgaacgatacgcaaggcaggtgtgcttgtgccggatgcccctagaaggggagagatgaccctatccaggtgtgccttctctaaccattgtaggttaccaaggaagggatactgaggtacccccatgactcaggtatgccgctgagtggtgtgagaggacgcgctacccagggttgcccaaggagaatgaacgggctgaggtacctgggaggagtctcaatcatctcactggggtgaggaatgttccgagctagttcttatcttccgtgtgtgcgagattgacctatgtgactggccccaagttgactgtgcttgaagctgtgagcagatgcgggggactgcacgcaatgtgtggattatttgccgcactatacgaggtaagtaccaaggaacctatttacagtaagattgagatgagaaagaaggagtgaattggtaggcccttagaggcgtagggaaattttatagaagtaggccaggagtagtaggggtttgtacagcagaatattagaaagagaggacctagagtatgagctaggaatacgagacagagagcgtagtttgatagagtacacgaagagggaacgagaaagagtagtatgagcaaagagaagaaagagtaacagactagagaaggaggcgagtgagggtatatagcgtaagcagagtcgagaacagctacttatgcaagatgggggttg

SEQ ID NO: 586688 - DNA, 362 bp, Homo sapiens
ctgcagtatatgagttccaaggcattattttctgatgatatctatcatggtttttactaattagaaatggaactgtaaacactttgtactcactatataggccactgcataatcaccaggttggcgcacgtgtgagggtcagtgtaagaacccccaagaactggttatgtgccgaagatccatattcaggaacatatgatatactgggaagatgtcactcaatccagtttgccagaatgcttgactacacttttccatggtacacattagaagctccttataagacatgatcactccacttatctccatgaaccagtcactcatggtctgctacgacctaatgtaatgacggatagtctttt

SEQ ID NO: 586689 - DNA, 211 bp, Homo sapiens
gcggtggctcagcctgtatcctaatgcttatgggaaggccgagacgggaggatagcctgaggccaggagttggagaccagcctgggcaacatagcaagaccccatctctacaaaaagtgataatttttaaaaaatgggctggctgggcccctggcgcatcgtggctcacgcgctattatcccagcactttgggagacctgagcaagccagg

SEQ ID NO: 586690 - DNA, 215 bp, Homo sapiens
taggcgactctagcggaccccggtccccgacgtgagcgcagcggctcaggtccaaaccccccgcgtgcacccacttaccgagcccatggcggcactaattttgactgtggggcaccacaaactggcagattgccatcgtctaacgggccacagcctcccgctgttcacccacctcctattgccaagcaccgagatagcagtcgcaatcatggaca

SEQ ID NO: 586691 - DNA, 145 bp, Homo sapiens
  misc_feature (101)..(101): n is a, c, g, or t
  misc_feature (103)..(103): n is a, c, g, or t
atcgtgcagaagatcaccttatcgtgcagaagatcacctccacgctcaaagttcaggtctcggcggttgttgtagctgttccagtacaattcaatgttatncnggttgggtgcatgtgtaatgatatttctgtacttgagcgtga

SEQ ID NO: 586692 - DNA, 180 bp, Homo sapiens
ccactcgttctttgttgcctgggctgggtggggctaaccgtgctgcataagtgtcataaaaacgtttttgcccacagataaattgttccgtgtaggcgttccccagagtacgttgccgtgatagccgcgtcaaatgcgtctagaagggctgtatagcggtgaagcggctgtgagcttatc

SEQ ID NO: 586693 - DNA, 116 bp, Homo sapiens
acaatcagctcggccccgttttacttacaagttgtggtcatcgcaggctgtgttcgctactgtgatgtgtaggaggaatagctcaggtggaataggatgggagctagctctcacgt

SEQ ID NO: 586694 - DNA, 348 bp, Homo sapiens
agtgtcttcaagacaaactaacgcagaccatctgctcttgggtggggaaagagattcccatatttggagttattctccccaaagcaccaggcacctgcttctcttgtgaaaatctatgagctaacacaatgatttttacttaacatagtataaaaccaacgtctcctacaaggagaggtgaaaagctgaacacaaacatgccgactaacagggagctatggaagccttccggcggggaaacaggaggtccgcacttgtgctctccatattaaatgcttagcgacaaggcctaacagaggagaacaaatgctcccagagatgtctgcctgatggcaatggagaaaaact

SEQ ID NO: 586695 - DNA, 395 bp, Homo sapiens
tattaattgcagacagctacctaacaaacccacaggtcctaaactaccatacctggctttaaaatttttcggccggaacgaactcgtgagcagaacccaacctccgagcagtacatgctaagacttcaccagtcaaagcgaactactatactcaattgatccattaacttgaccaacggaacaagttaccctagggattacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaagggga

SEQ ID NO: 586696 - DNA, 347 bp, Homo sapiens
aaaaaaggttttttttggggggaaaaaaaccccccccccccttttcccccccgggggggggggttggggcccaaaggggggtttttccccgggggaaaggggggattttttttttttttttttaaaaaaaaaaatggggggggggttttttttttctttttttttgggggggggccttccccccgggggggaaaaaggggggggtttttccaagggggttttttttaaaattggggggggggggggccccctttgggccccttttttttaaaccaagggggcccccccctttttgggggggggggggttttgggggggtttttttttaaaatttttttttcctttta

SEQ ID NO: 586697 - DNA, 231 bp, Homo sapiens
gttctagagtatcccagttcgccgaaagtccccatagtctgatttacccattggtgggagggcgagctcatagagggcgacagggggaggctgtctggtcagcagctgtgtatttccaaagaacaaggactacccaaaactacaagccttggaaggaccaaaggaaaagagaaaaaaccaggctctaaccaggccatgcgctagaaatgattgagtataaaaaagaaaatt

SEQ ID NO: 586698 - DNA, 111 bp, Homo sapiens
ttaactatcttacagcttgagtgcagagatgaagagtcaaatctgaccaagatgttgatgttggataagagaattctctgctccccacctctaagttgcccgccaatcgaa

SEQ ID NO: 586699 - DNA, 546 bp, Homo sapiens
  misc_feature (546)..(546): n is a, c, g, or t
cctggatgccctagatcaggtgccaggccatttggttcctggtgggtatgggctgtcttcctggccgtccctgcgatggcggggttaggtggttctggtgtctctctttttataagagcaccagacccattggattaggacccccattttaacctcatttaacctttattatctcctccaggccctgtctccaaatacagacacactggggggttaggggttcaacacaggactttgaggaaacacaaatgtttatttagtgcataacaaaaaaggctattaggaatgtttgctttatgcgctactggcagatactacaagatctcctaagcatcccagactactgagaaacaagaaattgtttgaccctgatatccatatcagtgataagaaatcaaggttcacttttggatttgagtctaggactgattctcatcttcttaataataataatgcaattttcacatggaacttactaagtgcttttcatactgggatctcagaagtatgttaaataattttggaatttatctctcttcctgtctn

SEQ ID NO: 586700 - DNA, 632 bp, Homo sapiens
atttacaaaatcttgacatcattaccttttgatgttgagttactgtgctgagaattcagttgatttatttttgagttattaattgagctgtagaattgttacctatctttgtgtaatatcctattctgaaagtcaagtctctggctttaggatgcctttataagaattattttgtaaaaaataataataataataatgacttttaatgaaatagagtagtgttactccaagagggccagtaaccagaaagtcacctctcaacaacacttcctacttagaagtgcatggtatttctcaagacaagtttgcatgcagccaggtgactcttcattggtacagcagtcatgtggcagataattataatgtaagaaaatagagtgatttgttccaggtcttatagctgaagggtagtagaaacaagcttcaagcctgtgtgtttacaaattcctacactgtaaatatgaattataagctaacatgaagtttgcacattccttcttcaagtttccatgtatttatatataagatattactattattataatctatctgtctacccagaataatataactgttaataattgctaaaaatttttaattaaaataattactaaactcttaaaaaaaaaaaa

SEQ ID NO: 586701 - DNA, 394 bp, Homo sapiens
caggcaggcctcgtcggttagagcacagtgaatggactcttcccggactcctatcattggctcctgtggtcactcaggagccggcactgttaatagatcttacaagccaccgttgtcgaaggacccggagtggcgttggatggaagcgagtcctgcgttccctctgtcattcacggacccgagtgccccttctagcagccatctactttctaatgattcatgtcctgctcattctgggttttacgggccatctatagacttagttgttactctttggaccactcccctcaaaaattggaattctctcacctctaacatcagaaaatccattcccgtggaacagtcttcccatttacaggttctcttctccaactcttcacggaaagtgcctgcg

SEQ ID NO: 586702 - DNA, 291 bp, Homo sapiens
ctcttctccttcccatttctctaactaaggggtatgttccctctgtccctttccctacctttatatgtggggtcctttttcatacaggaaaaacaaaacaaagaaataatggtctttttttttttttttttttttgtttttttttggggggggtttttaagttgaaggggagaagggtttacatgacgacccaagtgtaaagcggggccccaagggggttcactttaacaagcgggggggggtttaaaaccgcgggtgaacgaggggaaaccgagcggggaacattcacac

SEQ ID NO: 586703 - DNA, 139 bp, Homo sapiens
ccatcttagccaggcgggtcttgaactcctgacctcatgatctacccacctcggcctcccaaagtgctggaattacgggtgtgagccatcgcgccctgccggagatacatttttgaattcccctgggtgtatacctagg

SEQ ID NO: 586704 - DNA, 188 bp, Homo sapiens
acatgctaacgtgcagacgttgatgtctggtggagatgcaaatgtgttttgtctgagagaaaagctccaagagtcactcagaagcagaagatggcttccctccgtgggaattccctcgtgaatccagtttgttttcagtcagctgaaacgtctctatcatggtagactttttttttaaaccgctgtta

SEQ ID NO: 586705 - DNA, 1060 bp, Homo sapiens
  misc_feature (385)..(385): n is a, c, g, or t
  misc_feature (583)..(583): n is a, c, g, or t
  misc_feature (591)..(591): n is a, c, g, or t
gcccgccaacatgggccgcgttcgcagccaaataccgtgaagaaggcggcccgggtcatctatagaagagacgtactacacgcgcctggagcaagctggatcttccagcacgaacaaagcgcgtgtgtcgagggagattcgccattattccccacgcaacaaagctccgtgaagcaatgcatagcaaggttactgtcatcgtcactcgtgactgaaggcgatacttcaggacgaaggcccaggctatagacggtattcttcctatcaatgctgctatggacggaggacgcagagaaatgcgaggacgatcaacttactgattcgctggaaggtctcagaccttgtgattcagcgatgattgagttggactagtagactccctgancacctacaggatatatggctgagacgtgctttataggaacgttctcgtagctagagtcttgtcactagatccgtctccaagggttcacatcaagcgccttgactatcgtgtgcgcgtgagtttgagagttgtacaaaaagacaggcgctctgtgtgtgaccgatgttgtcgatactttttttctggacttagctgtcntggtcatntctatgtctctccaccattcaacatccgtggggataccaatacttaaaaaaacatggaaaattccacaaggacattagacacttcagagatggcctgttctatttaatgtatcagtgagttgtgtccagtgatagataccatgaagggtcgcatcccctgatgtaacacatgtggtggccccacatggtgggcctcaattaaaggcgtgttgtgatgtgtccctgtgacaactcccaaaggcctgtgtgtctgttgtgtggcccccaacacagagcgtggggtgttacaggatctccagtggccccgggggaatcatctcccgcgctattatattgcgcgggggaaggtttcccggcacatgttttcaacactttgtactccgaaaatataaaaaggcgccccaagggggtgttatagacgccctgttggcacttttttaatgtgaggagcacctcgggcgcgcaaaat

SEQ ID NO: 586706 - DNA, 124 bp, Homo sapiens
  misc_feature (121)..(121): n is a, c, g, or t
ggaattcgggtggtagacttgtgagagggatgggctagttggcaggatacacgtttctgctatctatctgacacttataggagttctgtttttccttgtactgctaaccaattccccaggngag

SEQ ID NO: 586707 - DNA, 268 bp, Homo sapiens
ctggactgaatcccttaatgatctcatctgctctcatggcttttcatgtcatctacatgcagatgatgactcataaaattatgtcaaccttgacctcatgcctaaactccagactcacatgtctaactgcctgctcagcatctctacttggaaacctactaggaatctcaaaatttaacaggttcaaaatcagctcctaatcttgcccctaaaaccctgcttctaccaaagtattcccatcacaattagtggtaactccatgtctcca

SEQ ID NO: 586708 - DNA, 510 bp, Homo sapiens
ctgtgaacgagacgactccaaaaaaaaaagtggccaatgagaggggattttcccctcactggtattttctagaagaaattaccggcggagattagaaatctaatacacagtgtcgtaatcatcttatgttctcctcttgggggtagactaaaagagcctcattatatttgaagaaacccagattgcatggtcctgggcttggcagtttttaacacagtgcagttgggaacatgtcccagttctgggggatcacatttatggaaactcttaaaggactttaatgcccctccctaatcctttttctactgtaaaacctcattaatatatcctccaaggtataatttatcagtcaataaggataggggtcattcgagatttaaacctttgagataagtgggatatcgggaataaggtaatgattggtaatataaggtcttaaacttttaaataagcttaactcatggtttaagcctagccatcagctatatttgagtacatattccccacagt

SEQ ID NO: 586709 - DNA, 1086 bp, Homo sapiens
gtacagcaacgagaacctggacctggcgcgggcacatggcagtgctggcatggaagaccactacggtcgatggaggacgtacaagaaacgcatcctggatggttcattgccgattagtccagctccgtggtgtccacccaggggcaagatcctctgcgttctatgggccccctggctgtggcgtaataccagcattgctcgctccatcgccgcgtgccctgaaccgagagtacttcctgcttcagcgtcgggggcatgagctgacgtgtgctgagatcaagggccacatggcggagcctacgtgggcgccatgcccgggaagatcatccagtgtttgaagaagaccaagacggagaaccgccctgatcctcatcgacggaggtggacaaggatctggcctgaggctaccaggggtgacccggtcgatcggcgactgctggagctgcgtgtgacccagagcagaatgccaacttcctggaccacgtaccgtggacgtgcccgtggacttgtccaaggttgctgtacagtctgcacggtgcaagcgtcacggacacgtatccccgtagccgactgcggagaccgtatggacgatgatctaacgtgtcgggctacgtggcccaggagaagctggccatttgctgagctgctacctgtctgtcccaggctcgcgccctgtgtggctttggatgagagcaaggccgagctgtcatcgcacgttgctgacgctgctcatcacgccgtactgccgcgagagcgggtgttccggaactggggaagcacgtgggcacggtgttccgctcctccgcctgccctgactggtcagcggtcaaggcgcattccgtgcgctggtgcgccccgggagcctgtcgggaccttccggggcgacaccctgcttctaccctgcccctcctctttttcgtgtcaccgcccgtcgggttccctaggcgtgcgcacgtatcgccctggtggcgcccccccgtgtgccgggcacccccgacgggccccgcgcatagttgctcgtactgttgtcctccgtgctcgcagcccatcggtatgctctgcttgtcgcgctctcatcctctcgcg

SEQ ID NO: 586710 - DNA, 1047 bp, Homo sapiens
taaaaaaaaaagatgaaaaatgaaaaaaaaaatggttaggaggctgaaaaaaaaaccccactgttttttgggggcattggggcaacacaggccccgtggacctgtccttgccttggccccctaaggccatatttaccccccgagaaaggcgggccatggggtacactggaagctgggggccagcagtttgcacaggaggcctgtctgagccccaacccgccagaacctgtgtttgttgcagcagcttccgtgttcacgtgaaggcgtggcgtgaggtgtgtctccggggtgtggggccccaaaagttagcccccttgtgggctctcgacgtgccttgtggcggcgcacgagctgtgccacacactttgtggcaacgtagtgggtccccccgagctctctctctgtgaggctgtgacccactcttgtgtgtcgcgtgggcccgagttttacccacgggcgagagggtgggccccaaagccggtgtgtcgcaacaccctctctctctgtgggctgtgtgccagggttttgggggcccaagccagagggaaacctctgtggggcctccgtgagcgtgagaagcggggcgacggttcttctcccccacagtgtgtgtgtgcgccctattgtgtgcggcggggacacccacccccctgtggtggttttttgtgagacaccccggtgataagagtagcgcccccagagagcctctctctgttgcgacttgtgggcccccgcgtgtgagagaggtgtgtcactcttctctgtggtggggagccccacaaaaataaggccccccccgcggcgcactattctatagacccgccctgttggccctcgtagaaaatgactgtggacgtctattccaaacaccacccctgttggtgttaataagctcaggtgactgagatgaggactattggcaaacattgataacttgtaggccgctccccacaaagagaaagaggctcgttgaccgacagtaatagaaaggcaacaagggggctattatgaaagagcgcaggttggtatatatacttatacaccaag

SEQ ID NO: 586711 - DNA, 1014 bp, Homo sapiens
tcgcgttaacccctggtgtggtcaagtcatttttactttgctctgttttcacttgcgtccaactgcagattcacttgggacttgtttttcccctctagccacgagggctctatgcgggatataagtataaaactttcaactggcggtgaatctgcttgccgattattcatgggaacgatgtcaactaccgctagcccctaagacaactcgcctgtcggggacgtaatttcccaagggttacctttgtcattatagtgaccctttatactgagaggtcacctatacacacaatataggcagagagagaaggtattaaatggtgtttcatgtaagtatctgtacaagggtagacagaattctagtctgaaaggagcgcaggcagattctggcattttgcttggggagttcaagtctttggacgaagaatacagagaccaaaagaccattttgactggtatgtgagcgatgatccctctgcccagtgtatctaacgtggagtctaaatatattcagcaatggttttaaagggcagatattaggcccgattcaaggtatggaatatagattcgaaagggttagtgataggtgagtgcctttcaggtagctttgcatcacagaccaagcccatctattgaggactgtacgtatggagcaggcccgtgagcttgtgacgtgagtttcccaacgtgccaggctcccatttgcttaggatgaatagtttattctgccctcctggtagagccagctgtgggcgactcggcactccttacacacgttccctgttaatacctcgcttggcttacttgcaaaatccagcaggcatcctcggctggatcctgcacagaagatggtatgaaaagtcatggccactgaaaagggcacggaactcaaagttgaattaattgtgctattgtccacagcgcttgtattctgtctgtcgggtacttgtccgttataagcctgccatctgctgttgaaagtgagcacgcacagtgataatccatgtttcttcag

SEQ ID NO: 586712 - DNA, 211 bp, Homo sapiens
tttaaacttggcatttgctcatgggccataaacagacctgtattttaattaattttttcaaaggaggccagcacattccatgtacaccttagcagtaggatgtattatcgcagttcttattttaagtcaggcttgggatcaccccagatgggcagatgttagtaaggtttaattgtgcccggttggaggatacgttctttgggtacttttt

SEQ ID NO: 586713 - DNA, 1267 bp, Homo sapiens
ccccctccggctgccgctcgtcggtgtggtgcgtgcgtatatacacgaggacttccggttttttaagtggacacccgtgtctccaagtattctcgcgcctttggtggaaaacgcccccacttgccatcaaccccggttgtgttgtttgtgcaacccctctccccgtatgtaggagaagaaccagctcccggggggggcccggggagtcccccagccgtcttctcccggggaatcttccttatcgccgcctttaagggccgcccgcctggctggaccggggagagatacaccccaaaattgtttctgcacccaaccagggtgatcaaccagcgctttgtggtggaccccaccttttaggcgcccctaatttttaaggggtggaaacccaccctcattaagggagaaaccacagagtgtgtgtgtaaccccaaaaatacgtccacgcgtctggtggtgaaccccggtggtccccggggaaatatttcccccccgcgggagtaaatccgtcgtgcggaacccccccacgcggccggtttccccgcgggtctcgggagaagccagaacaccgtgcccacagaaatagtggcgcaccccctccgcagaaatagtgggggaaaacagcgagtaacaagagatgtgaaatagaaacacacagggtcacatccacagcccctccgcgaccccttccacagtgttgggctctcgagaagggagagatagaaatcgttatatcttttggtgtgttctcccacacataattctctgtggcactccctcttcacatggaacacactcttgtggtgcacacacgtgcacctggagttctcttttctcgcgccacaaagagaaccccacttcttgccgcttgtggacactcgggtgggagaatagaaagtgtgaaaaaggccacggacccgcagagatgaaatccctcacccactaatggctgcatatattttggctgtcccacgagaatttggcccaagaaggtccaaaggaagctgggtattcaccccccctaacaacactcacaaactccgggccacacacaggaaggaaaataggacccagaacccctggaacctggggcccacgtccgccctcagagcccttgcccgctcgggtatgaagatcgggcggattgaggaatgtcaccccccactcccctctgacacgcacactcccaggaaggggggtccccgctggtccccgtctgtgaacaagattcctcccaaatattttttgttaaccacattgccttcaagta

SEQ ID NO: 586714 - DNA, 309 bp, Homo sapiens
aattgatgatagatttaaatcactatggtatttagaaaccactgaatacatttagaggagtgatggaatacattttaaaatgccataattgacaatataccagaaatcacattttttacaactgtttaaactcactaagaagaacagttaagatgtcaacttaaaaatgtatatatggagaattacagtttcaacaggatatgcttttaaaatttgaagaccactgctctaaagcagttgttacatgtgatgagcttcaaggagtcaatcttgctaattgtgtgacattgggcaagtgacataaaatca

SEQ ID NO: 586715 - DNA, 126 bp, Homo sapiens
tctaatctataagcaactgctgcagtctatattccactgcgatacgcagattcagttgccacagaggatttataaaggagaagagagacagcataggacagagatacatcaaacccacctctcacc

SEQ ID NO: 586716 - DNA, 168 bp, Homo sapiens
ctctataagggccatatagggttgtagaggatcagcttatatgtttgggattttttaggtagtgtgtgttgatgcttgaacgctttcttaattggtggctgcttttagtgcctactatggtgtgttaaatttttttactctctctacaaggtttttggccttatcgag

SEQ ID NO: 586717 - DNA, 81 bp, Homo sapiens
tactactgcctcgtgggtgacatcgatgacatgcgctttggagcagggaccagactgacagtaaaaccaaatatccagaac

SEQ ID NO: 586718 - DNA, 188 bp, Homo sapiens
gacaggctgctgttgtcataacttcaggaggagaagctggcaggggtgcagacagtgattgtattggatccaggcaaggcagcaaagggaacagactgcaaagatcatcatgcgatttggtgaccagcgggtgggacagtgcaggggcccgtcttcctgaggcagctcgagttgctccctggtgattc

SEQ ID NO: 586719 - DNA, 168 bp, Homo sapiens
tcgaccgaaaggtactcaacaaaaaataaaatcccacaaataaaaatccacacttagataaattactgactatttttactactcaattttatacaggattaatccaacaatcctttaaaatagcaaaatcctggccggctgtggtggctcatgcttgtaatcccagca

SEQ ID NO: 586720 - DNA, 1664 bp, Homo sapiens
aaaaaaaaaaaaaagaaatacaccatccaatcagaacaagtctgaaataaacatgttttaaaagcctgtaatgacagagaggtggcaaaaatgaagaggatgctcaaatgaaaaggaaaaagaagtttaggaagaactacctgaagccaagagacctcttactttgtccaggtgggaaactgaggcccagagagggaagaaagctggtcaaaggtcacacacccattggaagctgagtgagtgacactcaggaggtgaggattccatgggaagagcacctagaggtgattctcccacctgcagctcctgcatgggctctagaagctggtttaacacatgactcttctgagcctttgcctcatctgtgaaatggacacaatgacaactactacggggtggtggtgagcagaaggcaggttatcctctggcgtgtgagatactcagcccagtagagtgttagggactcataaaggcttgctattagaaattagggccccagtctcctaggacagggttttgttttgtttttgtttttgacacaaggccattgctctcctttaaaggtttgggttgtttgtggcagggatggggaaaggatctgcccttcccaggccctgccgtgcccagcacacctgccatgctgaatctcccctcaccctcgcagggaccctctgaggagggtattcccccattttgcaggggagggaattcaggctcagaagtgaacactccagaacttgcacctgcccgtgcctgccgagctgtgcctcttctgttgtgcatgcgttctccatcccaggtttccttagcctctgcatcttgaatcttcacggagtgccctcgggcttagcttctgacaggcctcatttcaggggttgtcctggcatcatgggatggcgatgccctcatttccccaagatgcagtggctcagacacattggtggatgtggccaaggtcactgtccacttggttcgatgctggctgtgcccctgctggccaagggaccttgaaccagctgcctcagttcaccaagctcccatttccttctccacaaatgggtgctggagtgatacccgcctcagggctgctgtggggttcatgtgagatcctgcctggcccagagggagcacatgggaagtggattactccatagtgttgtcggcgttatttgacaggagcgaacctcgggtcttccagcaggatctggtcatgttcccattgagcagaactagtctgaggctcagttctcccactctgtacctgggtggtcttggtcatcttaattggccctgcaggactacagtgtcttttttcataagatagtcataataaaggctcttttcttgggagatttttgtgaggaatagtaagatcaggcctgtaaaattttcatcgcagtgccctggcacatagacgacatccaataaatggaaactattatgttttgattgatgatacattcattccgatactttacaaagacgtactgaggcctgctatgtatcaggcacctttctaggcactttggatacatcagtgaacaaatgagatccaaatccctgaccttgaggaccttggccttgataaggggagacaggcagtcagtaggaaataagcatattaaatatatagtaggataggtggtaagtgccacagggttaaa

SEQ ID NO: 586721 - DNA, 111 bp, Homo sapiens
gtgactctgacggatccctcataggttcgcaggagtaggggaattttttaaaaaaaatggcaattgtccagcacatgcaaatgtttaaaaaggaaacttgaggaaccatga

SEQ ID NO: 586722 - DNA, 314 bp, Homo sapiens
cccaggttttcccctcaggggttaaaagctcaaagttcaaacaggtccaagttcaagcccaggccccccccttatagggtacaggtgggatcgcctgtaaatgaggacttttggaccattccaaaaattctggggttgagggaaattgctcctgtctacaaaatcccaaggggggacaaggcgctgtggctcacgcctgtaatcccagccctttgggaggctgaggtaggaggattgattgaggccaaaagttaaagcccagcctggtcaatatagcaagcccccgtttttaaataaaaaataataggccggca

SEQ ID NO: 586723 - DNA, 718 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgctttctcctggggcaagcctgaaatcccaggggattgatgtcctgagagcatccctcagagcagccctcagccaatcatggatggcagttggtggttgaacacccaagcttcttaacccgttagtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaa

SEQ ID NO: 586724 - DNA, 165 bp, Homo sapiens
caccaccatgccaggtaataaatttttttttaagggatggggtctcctatgttccaagctgggctcaaactcctggcctaaagcaatcctccagcctcagcctccaaagttctgggatgaaagggtagccgacacaccatcccaaaggcgcaacttttttttttt

SEQ ID NO: 586725 - DNA, 438 bp, Homo sapiens
tggctctttccttgcctaacgtacacatggctcgtgatcccaagtagcatctgaagcgtttggcagctacaaagcatgggatgctgtataaatagaccgttgcgtttgctcctcggccattcaccgtaccgcacaagctgagagagcgacagcccttcatgatttacctgaggtacagacttacgtatgctctgacagaagatgaagtaaggatgatttgcatgcagcgtttcattaaaatcgatggcacggtccgaactgatataacctaccctgctgtattcatggatggcataagcattgacaagacggcagagaattgccgaatgacctatgacaccaagagtcgctttgctggacatcgtattacacctgatgagtgcacggacaggttgtgcacagtgaggatctttgtgggcccgggtccttcattcgccc

SEQ ID NO: 586726 - DNA, 163 bp, Homo sapiens
caggttaagagacccatctctttaaaaaataaaaaagtagccaggcatggtggtgtgtacctatggtcccagctacatgggaagctgaggtgggaggatgacttgagccctggagattgagtctatagtgagctggaatgcagtgacatgatcacagctcact

SEQ ID NO: 586727 - DNA, 4287 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 586728 - DNA, 145 bp, Homo sapiens
ctccataatgtgtgccacttctatctcgctgtagccaccaccgctgcttctgtctccaccatagccacccccacttctgtctccaccatagcctgcctcggtctccacctctgcccccacgacctctgggcacacattataggag

SEQ ID NO: 586729 - DNA, 486 bp, Homo sapiens
ctctacaggatccttattacgccccaaactcggtgctccgtctcaaccagagaagttacaggctccagtgctacagcaggcaccatcattcacaacagtcccaatacaacaagcccaaaagagcagtcctggtgtgtaccaacaagtcagagaaatgggggcagggcatatactgtacatgcacaaaccatatggagggttagaagggggagggggtgtcctcattcaacttcaccacataactctttgccctgcagggagcgaacatcaccgatcatacagaccgtgaaaacacacgggagggtaggcccctttaatgtatctccggcatcaagcatttctggaaagggattaacgagtggaggaacaattcttagacgggaagaggggaaagccgaaagaagggaagaggagaagccggaaggaggaggaatgttctaaatgttcaaagaaaagggaccgcgatttgaaaccgaactttaagct

SEQ ID NO: 586730 - DNA, 853 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaaggcctcggggcccctaatccttgggagcgcctcaagggccgcgaacagggggggccacagtccgggcgacgcgccaaaggcgggccaaaaaacggcgcgaacacccggggggcggaccccacgaggggaccccccacgtgaggaacgcgcccccctattcacaagaggcggcgccccagaagcggcccaccgccacagaacagggccagtgcaccgtacctccacacggg

SEQ ID NO: 586731 - DNA, 554 bp, Homo sapiens
aaaaacaaaccagttaagccagccatgtccctactgggctgtttgacttaaggaaaatgactgcttctctctgaacctcagtttcctcttttatcaaatagatataatgatacagtttgcagggtggtcatgaaaattaaatgagataatatgtatcaaatgtttgacacatagcaagctttcctgttaacaattactattccattctttcccccttaatccaaagtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaa

SEQ ID NO: 586732 - DNA, 337 bp, Homo sapiens
aagcacactgttgccctattgaatatgggaccaaaggaagcaaatgtgaaaagtaaatattacaaatccataactgaatatttactaaatacgtactgagagtcactgagcagcatggagggaaggagaataggtgattgagaactgtgaagtgtatacacaggatgaaaaatacttgctttcgaccctccaaggagttcactgttatttggagaacgactcttctctgaagctcatcctgaatgtgctcatgagatttcctcctgctctaacctagactgtcctcggaaacctgaatttgtagaatagcctctactccatttttgttttttctttt

SEQ ID NO: 586733 - DNA, 546 bp, Homo sapiens
atcttataacttgattgagtctttaggagcatatagctcaacatcttcatctacaaaattaggaaaccaagaccagagagttaagtcattttcccacaattacacaactagagaggatcttacccactagaattgccttgtctccttggttctggagacccagttcttgtctataagtgtcctgggcctccctttgtctccctgtggcttatcatagagtcagaggctgtcccagaaacccagcttacaataaatttgttcatacccttcattctctttgtttctcttctctgcccttttcagcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaa

SEQ ID NO: 586734 - DNA, 560 bp, Homo sapiens
  misc_feature (35)..(35): n is a, c, g, or t
  misc_feature (280)..(280): n is a, c, g, or t
  misc_feature (482)..(482): n is a, c, g, or t
  misc_feature (544)..(544): n is a, c, g, or t
  misc_feature (557)..(557): n is a, c, g, or t
tcgagatctggtggtcgttaggggtcacatttggntggtgccatgaccatgtattacagaatctcaacttcttcggagttgcctgggagtctttgagtaaacctaagctcccactgacatacacctgtaaagagaaatccccagtgttgctggaggccctttggaagattccctacttggtctggaacttgtggcccagggtggattaacagagtatttatattgtcagtcattcccaagcaagtttcctgtgcccaggtggctgcacacctgcggacangagggagggtttccttatcctgtcgattaaaaagtgggcttgcttgttatatatctgtgactagattaagaagaaactttgtcataagcgtccatagcaaagggaaagcaagactgtgattgtgatcatagattggctcttaatttctgccctaggtaagacacaaaaagggtccatagccatctctctttgctaggatggnttgagcagctactcaggtgacagcttgacttttatactgagaggaaagatgagtgaactctnttagctctttagntgg

SEQ ID NO: 586735 - DNA, 362 bp, Homo sapiens
tatccagatgctcacacaaacaggctgaaccacactccctctgagcaatatgatccctttgctatttgtggaaaagaaaaaggagcagaggggctctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgcca

SEQ ID NO: 586736 - DNA, 141 bp, Homo sapiens
ggcacgaggcggcggcgatgggcaagtcgtccggtttgtttgtggtggtggtggtggtttttgggagatgggagtctcgccctgggtggcccagtacggaatgggcaaaggcgccgatctcaactgcaccggcaacgctcg

SEQ ID NO: 586737 - DNA, 299 bp, Homo sapiens
  misc_feature (9)..(9): n is a, c, g, or t
  misc_feature (291)..(291): n is a, c, g, or t
tggaattcncatggtaatgctgatagggcctgccaaatataatctgcttcatgatccaccccattttcagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggtaaggacaagactccaaggctcaggtccttcccatagtgtacagggcttacgaacttccccttggttattggngtgtcttg

SEQ ID NO: 586738 - DNA, 4411 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgctttctcctggggcaagcctgaaatcccaggggattgatgtcctgagagcatccctcagagcagccctcagccaatcatggatggcagttggtggttgaacacccaagcttcttaacccgttagtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 586739 - DNA, 844 bp, Homo sapiens
tccttcgtcgtctctcctcttaaattctttctatccatcatctgcccttttatcactttaagcctcttttttaaattttcaaacttaagagatatgcatactgaaaagtatataacatgtacgtacaatttaaacgaatacttttaacatgtgaatactacgtaactccatccaagtcaagaaatggccagcttctcggaagccccatgtgtctccttcccctacctgcaactcttccaggctcccttttccagccttcccctttttcccttttattttcatgcctgtgatttgacctgtgtgtggtgggacatgtgaaactatgaaaattaaacctgtggcccacccagagcagttggtgaccaagggtctgcctcaaaggggtttgtccacggcaggttggctcctctctgctgctgacccaagattctgaaccttccaggcacacggcagtcttctaaagaagggctccctgtgtgtgagcaaagaccacagttctccttctatttacagatggcatgagggttgcaacgagtctgcgctgtttaagaccttctggtcaggtgtattgtgtacactttgtgtataatagaaaagccccaaaaaaaaaaaaaaaacaaaacaaatgttggggccctgccctgaaatattaaaccaactcggtgggggcccgtgtaataacctgcaagggtcccaagaagcctggcagcagcgtgtttccaaaaaaccgggcggctcaaaccaggctgggcctggctcaggccactatcccctccgggagaaaaacgacagacaaggtgaacgctgtactacgacacagcgcacgacacacagcaacgaacag

SEQ ID NO: 586740 - DNA, 3698 bp, Homo sapiens
gggccttcctctctctatcaccaataattgtcttatgatttggtagttgctcaactagcatttattgaattgaaatgaatgggctctgagcaattcaagacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 586741 - DNA, 156 bp, Homo sapiens
agctcgactctgaggatcccttcgattggcgggcacttatgcacgcttactatctaacaagtttgagtgcaagattgaagagttcaatctacccagatgttgatgttggataagagaattctctgctccccacctcttagttggccgccaatcgaa

SEQ ID NO: 586742 - DNA, 3656 bp, Homo sapiens
gccatccatggagctgaacgaattgtacgtgggtctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 586743 - DNA, 128 bp, Homo sapiens
  misc_feature (86)..(86): n is a, c, g, or t
atggttgctgagatgagtgagtgatgtgctcgatggagccacagggcagtgtgtgtagtcgtaggtgggatagatgcacctgtggngcataggcagcgggccctaccatccagccctactctgcccta

SEQ ID NO: 586744 - DNA, 192 bp, Homo sapiens
tctgtcgcaagtcacctcgtcgctgttggagcgacggagtacacgtgtggtttcgcacttccctaaataattcttcggggttataggtccgtctgagcaccgaaggttggatgggctccttcttggcgctgagaacgccaaactcgatgggtttaatatcgatggaagaggtcagcgtagtggtcctcctcg

SEQ ID NO: 586745 - DNA, 564 bp, Homo sapiens
agcggctgaagcaggagaatcgcttgaacccgggaaagggagattgcagtaaaccaagatcgtaccaccacactccatgcttggatgacagagcgagactctgtctcaaaaaaaaaaaaaaatccattgtgacaatggtattgatcccacttatatgaggtacttagaatagttaaatttcacagagacagaaagtagaacagtggttatcagaggccaaggggaatggaggagctgctcacggcgaagtaatggcttcaagaagttacagagtttccagttggggaatgatacaaaaattctggaagcctggtgtgggaagtgactgattgcacaacagttgtgaatgtacttaattgccacttgaactttacacctaaaatgggttaaacagtaaaattctatgtcaaatatacttataccataataacatttttaaaaattggatggggaacatatacattttggcaagtgggaatacgttgcaacgtggtatggtaaattggtccaaaccaccttgggtacttggctcatttgggttgagggagattagagggaagaatc

SEQ ID NO: 586746 - DNA, 1159 bp, Homo sapiens
  misc_feature (897)..(897): n is a, c, g, or t
ttcccctcaccaactaaaggtcttaagggccctgtctaagaggcacgatcgccaacttccagagccgaggtataggctacttctatgtgtcccatggtatctgccacagataacgagtctcgagctctctccaggtattcagttctgaagcgtcagtgcctgaagcatgaaacagagtggcagtgtaactccaaaattacctcttcgaaatctaagcgaaggtgccctagtcgaagtaccaactatcttgcaggtcccgatggtactccattgtcttgccccatgatgcggaacacactgtactagcttctgcgctctagaagatagcccacggtgcatacgtgacttggcgtccctgccagttgtacgagtgcttcgttggcttggatgccgacaataactctagcttggatttgctgcgcgtgctagctttattcaaccgccagccgattgttcacgcgccgaagcacagactccaactctccctgcgtgcgcacggcccttggcggcgaggaagctcgcatggcgcatgtcgcccggcgaggggcttgccaccgctccactgacgacgcctccgtcgaccgccgtggtagactcactgcgccgcccgcggtcccccttgcgctctgtctccctgaccttgcgctccaccttggtgaacgcttgcgccccgcggcacgcagcggcgcccccaagctcgccgaccactggggccctcccaactatcccagcacgggtcgggacctacggcgggtatgcgcgcgcccggcactcagtgcgacctggaacatcaagttgccgcttatcctctttgccaaaggcacctccacacatgttacccccactaatggcctgtttctctaaacacggcccgcgaaaacacacttcgcctgcctngtgttaccttcaaacgttgacgcccaacaagcgttcccaactgtggcatcaacccccccgaagcaccataccccccttgggctatcattccccctcctcttaccaggctcggaggaatgcttggattacacttattgcctctaggctcgtccccttaaatggctgtctgcgctcgcatatcggcgcgtagaggcgtacccttctgggttcaaacggtcggttccccggtcttcgagggagggccagcggcggggacgacgcc

SEQ ID NO: 586747 - DNA, 153 bp, Homo sapiens
  misc_feature (63)..(63): n is a, c, g, or t
agcagcaatgtaaaaacaaacacacacagtttttttttctttgagatggagttgcactctcgntggcccaagctggagtgcagtagtatgatcatagctagctgtaacctcaaacaatttttctgcctcagcctcctgagtagctgggactac

SEQ ID NO: 586748 - DNA, 204 bp, Homo sapiens
ctgttccccctaaaaatcatcaggaattagattctcataaggaatatgcaacctggatccctcgtgtgtgcaattcacaacagggttcatgctcctgtaataatctaatgatgctgcattaactgacaggaggcagagctcatgctggattatgccatacttttattttagggattattttctatgctatatttttactttaag

SEQ ID NO: 586749 - DNA, 285 bp, Homo sapiens
  misc_feature (41)..(41): n is a, c, g, or t
ggatttttttgggggggccccccccagggcgccccccgganattttttggaggccccgttttttcccccccccctgggggggcctctcctttgggagggccaggttttccatttggcccctggggggggggtttttgtggttgaacttttttttttccgtttgcccccgcccccccgggggggcctaggccccttgggcctcccctccccccccagagtcctttttccccctgggttttttttttttaaaacagttctgggaattttcccataaactgacaatta

SEQ ID NO: 586750 - DNA, 400 bp, Homo sapiens
gtcgacttcaaattgatgttatgtccggcatcgatgcgactacctaacacattcaaagtgctgtccttgcctgcacccgaagcggtgacgttgacatcaccacctgccgccacgtactgtgacactacgttctggccggattgactgctttcagtgtggctttcgctgttgctcaagttgacgctgaccttgaacccgcccatgccgccattcatcagcgtctggccggcttcataggcctgcttgccactcatggcggcgttggcagccggagcccctgcatccgaggatcgatgttttctcgctggactgaacagcctgctgaactccacgaaccgcatcgaccaacggaatatcaatgctgccgccaaccgctgtacggttggagctcgccgtgtga

SEQ ID NO: 586751 - DNA, 785 bp, Homo sapiens
taaaaagaaacccatggtttgtgtaagtgtttaatttaccttttggtctatgggtctcttggccagccctcccttttcccaatggaaagccatgtcaaattaaattcacgggatggacggctctcatcttttaattttacaatgaagggtgtccccagggttgtaaagcaataagattggagatgaacactatggaaactctcgcttttggctaaacaaatagcaggtgcgattagtatctcaacacccacatagaaggattttagttcaaaatgatggctccttctctaccggggactctttaaaaacactcaactggtcatctaatatgagtcaatttggctctatagacccacgtttcatggtctaacaaaaatctcatgactttaaacttccaccgatgaggcgggtaggacgatacagatgagtctgaccggtgcctaacaagtcctcattttttaaccttgtcgggcgggggggcagtggggtccctgacctattggagggtatgggctcccttcacattgccaccccgtggttctccccaagagaccggggagccaaggaaaccttatatcgtgggacaggcttggggagccacaaacagaagatacaacaacaacattggggcgccgcgggccacaaaagcttcgacacacggtgggcggcggaccaaagggaggtacgactgcccagggcccaagactggccgacatgtcgccccccaagaaccgggcaccgcttgaccccaacgccgggcaaggctaacagcaggctataacggg

SEQ ID NO: 586752 - DNA, 152 bp, Homo sapiens
gtgggaacaccatgtaaataatcaagaatgatgagaggagggaaggggccagtgaaggaatgcatgagaggtaacgctcgctgagggaggaggtgagtcatgagtgaagtggcgcagcgaggacctccagcaaccatgcatgtctaggaggc

SEQ ID NO: 586753 - DNA, 766 bp, Homo sapiens
ttaatgcgccgtatattggagttgagaagtttcagatgactctcgctctgtgaaagaacaaagtccatgatgatgatgacatagacggtcagaggtacatgctatatgtagatgtagtcatatattagtgtcagaccatttcaatataggtcaaacagtattgcagtcatctatcaagagctggaaaaagtcaaatatgtattatcctgtagagctctttgagagagtacagtggagtcaacaatgtgatgtcagtcttctggtatctcaggctagatgaagatactcgtttatcacattcaacgctgtgttaaatccttgcaagtcatcatcctgcatgtggtgttattcgcacagaggtgcacatacaatgtgttatccaaggtatctacaaatacctacttagcagggactgggagatggaaggtgtgttcagtgtggtgggtgtggcactacttgagtctcgccagtacagagagtcagttatccagtatttgtcgagccaattttattatcaattgagcaggagaggagttcatgtgtgcttatctcttttatggtgttgggtttttttacataataaagaacggttatctaagtgttctctcttcacatgtgggcagcttcacatttttcggtctttttttaaaatcctttctttgtgaaaaaagtagcgccatggcatttccgatgggatagagctgctgtgttctactttctgagatgcactatgaacaatgatcttgtaacccatctctgttattac

SEQ ID NO: 586754 - DNA, 197 bp, Homo sapiens
agcttacggcaggctattggttgaatagagtaggctgatggtttcgataataactagtattggggataacggggtgtaggtgttgcccttgtggttaggaaagttgggcttaagggccattttttaatccttaatgagctgaaatgccttataaattcacttgcggcccccggttccataaaatggtgggggcaatt

SEQ ID NO: 586755 - DNA, 160 bp, Homo sapiens
attacaagcgtgagccaaccacgtgtgcccagtccctgagttcaatttgccgtgtaacgttcgaatatgctgcttgttacttattaccctttaagtgcttgcttacttatcatctgataattacgtttcattctactctgtgatttctttaacaaaatca

SEQ ID NO: 586756 - DNA, 192 bp, Homo sapiens
gccatataaacgataataggagtgcagcacgttgctcacgtgccgacggaacttgtacagggaggcatgcaccgcagtggtgaatacacgtcgaccaggctgcatgtaaacgatatttggaggtgagcacggatctcacgtagcgacggtacttgtatagggaggcatgcaccgcagtggtgaatacacgtg

SEQ ID NO: 586757 - DNA, 719 bp, Homo sapiens
gggagagcctggccctgtcctttgctacccagggctgccccaggcccatgaagccaataggagagcgtgtggcactggcccacaaactgtccctgtcctgtcttcctcccgagccaagtggcctcgtgctagctccaccttgaaggagccccccaatcctccccctacatcccagagatgcccaccaattgtgtctccacaatgtgctcttgcccaaccggggttccgcactgttccgacccctgcacaccactcatgtcaaccactgggtgcatcaatgttcaatccccatctatttatttaaggcctttctttgcttgtagggcatttggtatgtagagcagttgaaaaccagaacctcagaacttaaccatcttgtcctgatgtcaaaagtgcttttcatgaccaccccggtatctatgtactatgtacagtcaagggatgagatcttaagtttaccaattaaaaactcagtactcaatatttactattctactcgagccttcaggggaagcccaaatcatgtgtgcatgtgtggtgtgtgccgtgtggtgccagctttggaacctccttccaacagccggatcttctcattgacacaagagctttggataagtacattcctggtgggtcgctcagagccttcatagactctcattcattggaagaatagaggcagacagggggcatgctgagtcccagtactggaagtgaggcga

SEQ ID NO: 586758 - DNA, 106 bp, Homo sapiens
agcaggtgggcgcccctagacgtcttctactctactatctccatcagttcggtcattttacttttgagctcccccacagtgatagagcatgtgaagtttgtctttc

SEQ ID NO: 586759 - DNA, 283 bp, Homo sapiens
ctgatatccgtgaggagggaaagaaagaaaagaaagagaacacaaatcaaatgggatcgtggcaaacttttgccaaggtttgagttgaaggtgggtagtggagcatggaaagaaaaacccacaggcagcactatgacagagtagtcctgcacaacgatgggtgcccttggcagatcatgtttgcttcctgctagtttgctagtctcgccaccatcttcccattcacaggatcagcaaaagtgattcagacatgggatccaccatttccctccccgggatacag

SEQ ID NO: 586760 - DNA, 1028 bp, Homo sapiens
ttctgttgtctttctgtctctctttcgcgtgctactttctcggtgtcgctgcttccgtgtgcttgtttttctgtgtaatgtggtcgcgtcttgatctgtctcctccttgtgtcgtatcctttcgtatgttccatggttctttccaatgtttcggtttgatacccagtgtcggtccgttcgttgggtggtaccaagtacgctctttactatcaccttatgcctatgcttgctgtctacctttgtctagcttcttgtatctcatgctctttgtgtgtccctgcgggctcaattgtagtcttaggatgattggctctcatcatgtgcactgtctctgtttctctctcagtccatcccctgattgtgctgccctctctgcctcttgggacatcgccgacttcatctaatgatggcttggatggctgcagatagtggactcccaggtgtgccgccttacgacacaagcccctcatctatgactacgagggtgacaggctcggtggtcggggacgctgagctccatcctgtccagccagggcgatgaggtatccaggacttacgactacctcagagactgtggtgccccgcttcgcctcggctggcagacatgtatgggcacccgtgcgggttggagtacggggccagatgggaccaccaggccagggagggtctttcacactggggcactgctacccagacacagaggccggacagcctgaccctggggcgcaactggacatgccactccccggcctcgtggcagtgatggccccatgcagaggcagcactgaggtcacacgggcccgaccccacctgggcactggggcagcctccgttcctgtaggcgagggccacaagtctgggggcagaacactgagtgtggatggggcggcacaggaagaggccaccattcctgcacggggtgggaagagtttctctcaatcggcccaatgcaggtcacactccactagtcccacacgttgcctcactagccagtgacctatcattacacggggcacacttcttgtagt

SEQ ID NO: 586761 - DNA, 240 bp, Homo sapiens
ccctggccaggctctctaagctaatggtcgggagcctctctcctctgcccgggcttcctccatggagccacctacagccatttcccaagtgaggggcacggtccggcctcggcgggggttctacgaagggccttcctaaaatccagaaatatacattctctcccagcaccacatcacacttatcccaaaacggaccacatagtgggaagtaaagcactcctcagcaaaggtaaaagtaca

SEQ ID NO: 586762 - DNA, 798 bp, Homo sapiens
aaccatttgctgccgatagtgccattgatagggaagaacttcagaaatctgtggtactcttgggctgtcttggtcttccctgaacgtgtctccactctgtgaagccagcatctaggggctaaagatgcaaaggaaagcagcatgcttggtctgtacaaatgtgcaggaaataccccaaagcttttcctactgtacagatctctcgagtctgcttaaagtgattctttcttctgtgatatttcttatattctatatgtataggtgtaatagcctttggttaactaatttctttttcctttaagtaattaagcacgatcatgtcccttttaaagccttacctgagagggaacaatgccttaaaataaaacaacgcataatgagatgaaagtatgcccagaataatttcctctacttattctgtacttgtgccctcatgagttccaatgttgtgtgaacgacaggcagatgctgcaccagttgaatggcagcatgatatacagacgtgatgtctgtaggtcacattaaatactgctttgagcaggtgggtgacacaaccacaagtgttggtcttccacaggggaagtttaacacacaagatatttttaacccacttggcagaacaacaaggttaagctcatctgttgatgtcccaagaaacttgacacgcggttgtattggaaagtaccggttccaaaacacgcacagagagtactacagcctttttggagcagtaacaggtctatggggggcgccctaatccgctggccactctggtttcacacgccgcctttgccggcg

SEQ ID NO: 586763 - DNA, 576 bp, Homo sapiens
cctccccctcccccccaccagagctggggtcgctttccgcccacaaccaccggtggcgttctccgcgcccccttcccgccccagcgggcgcatcctgtggctggcgtttatagttccctccccccggttttactttaaaccccaacccactggcgctgggggctggtcgtggccattcggggccccatctcgggtcccgggggtcccaggggcccacgtgaaggtgcttttttggggcccacctccccttttgggtttaaaaaaaatttggggggggggggggcccccccacgggggtcccggtcccccccgcccggggtggtgttttgggccctctgtcaaaaccccgggggggggggaagtggccccccctaaaccccgaggaaacgggggtttccctgggtttcggaaaaaccctctaagggggggggcccccccacccccccttttttaagggggggggggggggggggggaaacaaagcatccccccccctgggcaaaaaattttttttggtttttaacccccccgcccccctttccccttgggaaaaaggggggtttttgaccccgggga

SEQ ID NO: 586764 - DNA, 464 bp, Homo sapiens
  misc_feature (132)..(132): n is a, c, g, or t
gctatgttcatgaaagtttgaagacattacatagtgtatgtaaaactaattagtgaagagtaagaaaaaagactagccaacaggaatagtagagtgatgcattacgttaaatttcaaaagctcataataaanggaactttcaagagatcggttgaaacccaggtggtaaccctggtaaattgagctcctggtgactggataaagacccccaaaaaggcgagtagagggagatatagtgtttactgtgctggtggttgatggtgtgctcgctatcttaatatatagcgtaggtgacacactagaaattctctatttggtccacataatctgcaagtagtttccgtatatttatcgtgtactaagattgactatcaaattgagtctgcgaagaggaaactttttgactgtactgtatttaggagcctttgtacagcttggtcaaatttccatgatatgaagtattt

SEQ ID NO: 586765 - DNA, 349 bp, Homo sapiens
  misc_feature (300)..(300): n is a, c, g, or t
  misc_feature (313)..(313): n is a, c, g, or t
  misc_feature (348)..(348): n is a, c, g, or t
aggagcatttcatcttttattccatagcaatagtttcagggggtctccctgcgctccataaaacaaaacagatctttaaaaaaactattagaatgtagagatcaaaactttgaaaaagtaagctatagttagcccacccataaccccagttgcctccttcagtcactaccactgtcgttagtgtcttatttacccttctagaatgttcttgtttctccttctagaatgacgtgcccaagccaaacagatcttgttctaactgagccctgctgtacagctgctctgcccttcttccacctnaacaccacaggtnttcatcagttgtttaaaatcacgtgccaacacatna

SEQ ID NO: 586766 - DNA, 713 bp, Homo sapiens
gcttgcagagccggcgccggacgagacgcacgcagctgacttggtcttctccgcacgatctgttagcagaggtcgtccagagaccttcttctgctcgctgtgcaaatatgggcaactcttagaggaaaagaactcattgtcaccagttgcgtggaagtaaagtagcgcaatcagttccaagcaataggatcacctgtacgttcgggatgtcaggcacaagtatggttgatggcgatgtgcatagtcagacattctggagaaagtctgctagtgctagcatgagcctatgctcattagtggcgataggttgccccggcacaaggatcacagcctctcacatacggcagtaaaatgtggatggggattcgtgctaggctagttgggaaagctttgattgctcattccagtacccaaccctggaaaaatgaggtggggcaagctatcaatagggattcatgcctggttggacccggacaaggattgattaaagatttcggttaatgttggagataaagcatggactaggggatgtttacgggtcaaggggcagaggaaaagggggcgagagaagatactgagtatccaaagttcttctgggattggcaaaagatgaatagattgtttgaatggggtgctttccagataattttccaatttagtttgcccttcaagaattccagtggaaaaggtttcaaaggtgcctggaatttggg

SEQ ID NO: 586767 - DNA, 775 bp, Homo sapiens
gctgttaccagagtatctgggattacaggcacccaccatcatgcccagatcatttctgtatgtttagtagagacgggcatatcaccaagttgcccaggtgcttcctggtggtccttgggtcggacgggtactatcagaaatggaggagcacaaagattcagctgaagccctcactgcctgggactgggacccttgactcgtcattgtatgcacacctgaaactgcttatgtcgctgaggtgccaacctgctgatggttggaagctaattgagttctgatattgtgtgatacccttaagcattgggtttactttttattttaattaattaagttaattaatttttgagacagagtttcactcttgtgcccaggctgaagtgcaatggcacgatctcggctcaccgcaacctccgcctcctggttcaagcagttcttctgcctcagcctcttgagtagctgggattacaggcatgcaccacacacctggtaatttatatttgtagtagagacagtttctccatgtaatttcaggctggtctcaaactcctgactcaggtgatccaccgacctcggctcccaaagtgctaggattacaggcgtgagccaccaatgcctggcatatttagaatcatgatttatactattagagaatagggtctacactctgttggacgcaggctggagttgcagtgataacgaatcaagtcagtgaaaactcatggtcccaaggtcacgtgattctccagtacaaggctcctgagtacagtggacgtaa

SEQ ID NO: 586768 - DNA, 210 bp, Homo sapiens
acaaaacgcagatataaaaaagttacaaagatttttagattttcattcacaaaaaaagtcattcacattttacactatacacgttatgatataatacaggaaagtattatgtgcattgtaagagaaggaaaatagaactactagatcacacgtgttgttctgtgctctaaaatacctaaaggtggattcatttaatgcaacaccagggac

SEQ ID NO: 586769 - DNA, 955 bp, Homo sapiens
aatatggtcgatctaaaatttacttcggtgcttacaatatgaggtggaggttgcagtgagctgagatcacgccattgtactccagtcgctggtcgacagagcacagagctccatttcgaaaagaatacaaaaagactacctcatcctttttaagtgtgtgagacttcggccgcagagggatcctatacactcgatgaggaggatccctagataggtactgttgtggcatccctgacagagaggagatagtgcctattactaatacttctgttaactctcgaacattgatttaacgactcggctctgttttcttgcttcaagaacttgctggagtaggcccaaccaacatgctttcggggaggagagcttcaattcatgcgtgcccacggcataatagtaattaacgttaaagagccggagccaagcgatcgacggcgcaaaacgcgtggtgcacacgttaccaagtatccactaacgcggaccaaatggctctcacaaaaatgaggagcataggagggtacctgtgggacactagaaagtgacaccgagaaaaccataggtatgccgggtgaataaccctaccagggcctaaagggaaccataaaggtgcgaagaatctaaccaaaaaaaatgtgatatacaaaatgtgttgcaaaactacacaaaaggtcaaggatagagtagagaacgcactaaatgccacctgatgtaggcgtccggcagaaagaggaaccactccggacgggggacatgatcacgaagcagggggacaactgcgacacttagtccttcgtcgccaaaagaacgggaggccgggtccttgatacgacgaaaattcacgtatcaaatgcatatcaacggccactgggacatatcccaagcgagccaactgataaagaggttaacaactcacaaacgtaaagccgggcgacaagcgcaacgtgaaaaagaggaa

SEQ ID NO: 586770 - DNA, 802 bp, Homo sapiens
atgggtccagtagcccctttctttggccaatttctcacttttggaatgggagtgtttacccaattcctgtacccccactgtatgtggaagtaactaactgtttttttaattttgtaagctcacaggtgggagagacttgccttgtctcaaggtggaaattctggatttgggactttagaattagtgctggaatgagttaagactttgagggactgttgggaagatataactgtattttgcagtatgagaaggacatgagatttgggagacaccagaggtggaataatatgatttggatctgcatccccaccaaaatctcatgttcaattgtaatcctaaattttggaggttgagcctggtggaagaggattggataatgggggtggtttctcatggtttaacaccatcccactgggtgctgttctcatgacagtgagtgagttattgtgagatctgattgtttacaagtgtgtgcacctcctcccaactttcctcctggctccagccatgtaagaaggcttgactccaccttcacctttgttcatgattgtacagtgtctggagggtctcccccagcatgcttcctgtacagacctgcaaaactggtgagcaattaaaactctttctcatatatattacccaggatacgggtataactctaagcagtgcagacatacgataatacaggttacattcggaagagattagcaacataaatatatgatcacactggcgtcccataattagcaatcgatcacgccataagagtaccaaacaattgggaagacacacaattcaatga

SEQ ID NO: 586771 - DNA, 871 bp, Homo sapiens
tggcccgacaaccaaactcaagccccccgggttttttttcttgctataaataatttccccttttgagttccccattttctttgtgtttctacttgaagaatacagaagaccccagcatatggggcggtggccgaataaccccgcgtgttgggtatccctaattcccacgtgagaataatacgccgagaatcttgttaaagagccgcctgacacctagcggcctacacagcagcgacaacccatctatcacagaggtattataatgtgccgacgacgctttttggaaaactattctcctctgagagggctgcccgggacacacgtcggggtggcgctcgccactttaacgttccccctccaggccccagaggggttgggacacttcggctgtgttctcctggctcccccctctcgcctgtggttttgggacgcccaggatcttggtcctcgatggaccgcagggatgtaccctccttggggagagcgttctcctcggagttggcaacactggttggcgttttaaaaccacgaagaactctctggagagcaagaatgctcatctcgccacggcaagacacgctccccacacggggcccccgagagccctgtgtgtggggcgacagctgctgccctgtgtgcgtgggtgtgtcccccccatttacccctgtgtctcgacaagggacatgttgcgctctggcacctgccagcgagaggggtcttgccccccccggggggtctaccccgcatggggggcccggcatccacgaagaacctgtcctgttgcgatcatgttacggtcaaaatggactcgccaaccgccttccctttcggttccactgttgtgagtaagaattactctcgccgggccatt

SEQ ID NO: 586772 - DNA, 181 bp, Homo sapiens
agcaggctctgggcccagattaagatgtctgttaacttcaaataactctttagacgtatgtcttgtctgtagccatacatggtgtatagcaccagaaaaattgagggattattcttccagctacttgaacactgtcgtcagtttcaaatgcctgctgctcaaatcatttaagaaggagttc

SEQ ID NO: 586773 - DNA, 331 bp, Homo sapiens
tccccttggggggaaaaaccccctttttgggggggttttttttataccccgggggggaaaaatttttggggggggaaaccccgggggaaaaaaccgggggaaaaagggttttccccccttttggggaaaaattttttttttccccctgggggggaaaaaaaaatgggggggaaaaaacccccccgtgtttgggggaaaaaaaaaaaacccttctccctttttttttggaaaaaggggggggggaaaccccccggggggaaagggacaaataaaaatttttgggggcccccccctaaaatttcgaaatgggggcaaaaggttttctcggaaa

SEQ ID NO: 586774 - DNA, 448 bp, Homo sapiens
tccccttgttttgggaattgggggggggggcttttttgggcccccggcccccctttgtttggggtaatttttttcaggggttttttttttaattgaaaggtttggggtttgttttttcccccctttttttggggcactgggggtacccccgtttttttttttttcccttggggggggccttggggccttttttccgcctttttttggtggtttgccccgggggaggggccaaaagggggggcagccctttttttgggccttggcccccaaaccccttttggggcttggggttggttcccttttttttgggcccccccccccccttccgggggcgcccggggttttttttggctttccctttcccaaatgttccccttttggtttttaagtttttttttccccaaccttttttttttcctttccaaaaatttattgcccccccggggga

SEQ ID NO: 586775 - DNA, 981 bp, Homo sapiens
  misc_feature (356)..(356): n is a, c, g, or t
gacctccggcctagccatgtgatttcagcttccactccataaacgctcctcattactatggcctactaatccaaccagcacgtaatccatataccaactgatggcgcgattgtagatcgatcgagaaatgcaccataccaaggccaccacactaccatctgtccaaaaaggccttcgatacgcggataatcctatttattagcctcaggaaaatattattatatcattcggcaaggtagttttgtctgaggcccttgttacccacctctcagccctaggcggccctaacacccgcgcgaatttgacgggtaggcgctacttggaccccaccatatagtgtcttgtcaaggcgccgncctttaggattccgcgcctaagaacatgcgctgcgctatcttcccccttagaaattcaacgagtaccctggttaatttgagccatcccggcccacattcccaggggagagcttacgttcgataggtccagatctccagtaggagaggcccattcttagcgacaaattaatggttctttaacgaggcttaaggcactaaagtagggcgaacctcgacaaagcagccccgagggggtctaaccctgtctcaatttgtcaaacgtcgcacgtttatattttagccaaactctccttcataagcgtgggggtgtccatccgtaggatacattagtcgcggtgcacttatccagaaggccctctccagtagggtttaacgtagtcaggagtgttaatactccccttgtacagcccaaatgtttccccgcgaccgggcaaaatcgttaagcgagaagttgcgaaccgcaaattgtgttggataaggttacgtcctccacggagagggctatgtgcctaatgggggcacacatttagcagaaagcgttcacagttgtagagtttggggcattttcaaaagcacatggtgtacaccgtgccaaaggttactgtcatgggccgttgtccaaact

SEQ ID NO: 586776 - DNA, 855 bp, Homo sapiens
  misc_feature (53)..(53): n is a, c, g, or t
  misc_feature (223)..(223): n is a, c, g, or t
  misc_feature (275)..(276): n is a, c, g, or t
  misc_feature (283)..(283): n is a, c, g, or t
  misc_feature (325)..(325): n is a, c, g, or t
  misc_feature (328)..(328): n is a, c, g, or t
  misc_feature (330)..(330): n is a, c, g, or t
  misc_feature (339)..(341): n is a, c, g, or t
  misc_feature (343)..(343): n is a, c, g, or t
  misc_feature (363)..(363): n is a, c, g, or t
  misc_feature (368)..(368): n is a, c, g, or t
  misc_feature (371)..(372): n is a, c, g, or t
  misc_feature (380)..(380): n is a, c, g, or t
  misc_feature (390)..(390): n is a, c, g, or t
  misc_feature (442)..(442): n is a, c, g, or t
  misc_feature (445)..(445): n is a, c, g, or t
  misc_feature (455)..(455): n is a, c, g, or t
  misc_feature (471)..(471): n is a, c, g, or t
  misc_feature (476)..(476): n is a, c, g, or t
  misc_feature (483)..(483): n is a, c, g, or t
  misc_feature (519)..(519): n is a, c, g, or t
  misc_feature (521)..(521): n is a, c, g, or t
  misc_feature (527)..(527): n is a, c, g, or t
  misc_feature (538)..(538): n is a, c, g, or t
  misc_feature (586)..(586): n is a, c, g, or t
  misc_feature (749)..(749): n is a, c, g, or t
  misc_feature (817)..(817): n is a, c, g, or t
catgtctcagctcagcgcgcttatctggtgtcacctggcgctacctgcccccngacgtgagagagcgaagttcttgggccgcgctccctccctacctgggtgccctccccctccgggagcctgggtccccggggcggtcgcggcggctgcatcctcaggccaggccgcggggggagggggcggcacgggcctccgaaagcggggccatggagcccagagagtnggggaaggtaggactggaaggcccgggggccgcccgctccctcccgaggatnnccgagcngggctcgggcgaggcggggcggctcgggcggaggccccgcanatnanctatgtttnnngngaaggatttgccggcccgcnctctnttnncgcacttnggcgcccgancccgggaggtggcggagaggagcggacgcttccgttcggtgttcgcgcattntcnccgagctgcngagcgttcgctgggtngatgntgggttnggtgatccccgagtggagcgatgcgaaggtgctttntntttttnccaccaccttnggcgttttgaagaggccctgctaaggcttggagtttggatcggacgcnagttggagctgcagggtgggacgcttgatggcttgatcctgcctagatcctctcttaccaagaaagggctgaaaagagagggcatctggcatgctttttgccacttctgtttctaggttatgtacttcatggaatatctgggcattgcttagaaacctgtgtnataaattggctttgggcaagaggctttgagttggaagaaaaggtggaaagaaagtgcttgggggcggnttcagggatttgacgggattccagcgcttcaggcgtgt

SEQ ID NO: 586777 - DNA, 277 bp, Homo sapiens
  misc_feature (65)..(65): n is a, c, g, or t
  misc_feature (91)..(91): n is a, c, g, or t
  misc_feature (143)..(143): n is a, c, g, or t
  misc_feature (152)..(152): n is a, c, g, or t
aataggtggtgttatgtgtaaagagttttactttatatctactcatgtattgatgcaagttaganatacagttgcttcaagacatgacacnacgcttggcagtgtttcttccccagcttgaggtacctctaagaaatcaattnaactacgtnttaaatttattttgtacgacacttttctggtttataaatccaattacttctgcagacagatcttaacagcttccaggattcttctgatactactttttgctttcttgccataacaccacacaatt

SEQ ID NO: 586778 - DNA, 128 bp, Homo sapiens
agactctagagtatccccagacacacgctcaagatggaggcagcaaacacaaattctgatggagaggaaaggggcacgttgagtatactggctaacggaactgagaagccttgagtgtgatggtgggc

SEQ ID NO: 586779 - DNA, 191 bp, Homo sapiens
  misc_feature (78)..(78): n is a, c, g, or t
  misc_feature (83)..(83): n is a, c, g, or t
  misc_feature (87)..(87): n is a, c, g, or t
  misc_feature (152)..(152): n is a, c, g, or t
ctagtacacacatacctgagactgggtaatttataaaggaaaaaggtttaatggacttacagttccacatgtgatttngagtngggncacagccaaaccatatcacacactctgagttttgttttttccccctcattatacttgatagggantaacgtttcacaatatatgtgaaaactattttttttttt

SEQ ID NO: 586780 - DNA, 1294 bp, Homo sapiens
gatcctgaatctcgccgcaccgccggaagtcgtgttgacggatttaccatgaccctggatggacgccagtacaacccggtcaaagcagcagcatagtgctgttacgccaccagctgttacagcgtgttggtcctgcgactggcctctggtgctgctatactccgattatgggataggagaagtgcccgtggagcccctgtgatgtccccttaccctccagcgatcagggccacgcttcccccgtgggccgtggtactccaaatgcatgaccgagtgcgtgagcatactagccgtggcgctgtctggtaggacaccgtattagacctgcgctgcatcaaacagcgcccacgaagggctgctttgcctccagttgtcagctgatgcattccatgtgtccccatggatgcagggctttggtgagttggcggacgtaagcacagacaaatgcatcttgttggaacgacgcaaatgtttgactccctctgcaaggcctgcttcgcaaaccctttatagcaggaaacccgtggattgtgaaaacaatcttgacggtgaaactatcccttggggtcggagcaattcaaatggcccatcgcattggaccttcttgttgacttggttcaagttcgccgcgcattggcttggaaccccaccttagttgggggcccccggccttgggccatcctggaagccccgcattacgccctgttgacggttctcccctggggtgggctccgaagccgaacgggacggaacccttacctccggttggggtggtgcgaatttgtctgcccattccaaaactcccggacatttcaactgggcccttttgctagtcaaagtgtgaacacctttcgggaccggggcaaacctcttgggccttctatggtaaagccacagagaaattcccccagggtccttcggcttttgacacaaagtgggaaccccttccacgaaccaattaccccgggggacgggacaacttgccaagtgcgaatgggaaccaaagaacgcttccaagacgattcaccatcaccaacgacttttccccggcccatgccggaaaaattagtacgggacggagaaaacccatggcctttccggtgcgcgtccccacatattgcaaagtgcgcccagaagtcactccccgagaccaaggtcccgtcgtagttgttacctttgggggcctcgaacctgtggaaatacaagagtggcaccgtggtcttcaagaaacgcacacaataagacactacaacgcacctgtcaatgtgcaccctagggggaccccataggagac

SEQ ID NO: 586781 - DNA, 244 bp, Homo sapiens
aataatatgaatctgacgctggggacatttgcaacccgcagagtcaccgccacctggtgtctcttcagtgtctatggagaccagtaaatgactgtttgctccactgttctgaaaacaaatgagtgcagaaacaatcttcttttgcttcctgcctggtgagagacatgattgccaagagctcaggccaggagccgagggtttgcttttcatcctaatcttcaaggtggtcatcttcaaaggatgt

SEQ ID NO: 586782 - DNA, 581 bp, Homo sapiens
gtaacattgcagatagcggtgtgatggcaggcctgtctggcccagctgctgtgggcccactgctctgtactcgggtgtgcttcactgcaggccttccccgctagcttggggcggcagagctgatcagtggaactaagccgtcaggattatcaaaaactgagcagcacccttggtggacctgatcatcacggactcccccaactgaaaggtccttctctggcctcaattcccgtctcaaggccacgctcttccaccatacagtggagtcttccgccccagcgcgtcgaccttaccagcggcctccccaccagatgccctgcgctggatacctaagccttgggagcggacagggccgccacctcgagaagggccctcccgacggcagaggagcctggtgtcccgagggtacaaggagcctggttgccccaccccgctgagggagttcctcttgccccctaccccccgggcctgtatatggaatataatattcgggggaaaggggtgggcgggaggggttgtgcggctgggctcacttcccctcttccccttccctggtccctgtcctgcggttgtttgttaca

SEQ ID NO: 586783 - DNA, 122 bp, Homo sapiens
gtcgtattatccaacactgaaatctcaatagcatctagtgtatgtttgttgctctcatgaccacatagagtctgcacatttccttatcctgtgctctgacaacccatgtttctattgagcct

SEQ ID NO: 586784 - DNA, 209 bp, Homo sapiens
attcgcggccgcgtcgacttctattcaacatagtactggtgaaagtgggcgtgcttgtcttgttccagttctcagggggaatgctttcaacttttccctgttcagtataatgttggctatgggtttatcatagatggctctctttacttttaaggtacgttccttgtgtgccagttatgctgagggtttatttcttctaaggatgcttg

SEQ ID NO: 586785 - DNA, 155 bp, Homo sapiens
ggccgggcacagtcactcatccctataatctcagcactctggggggcctaggcaggtggatcatttgagcccaggagtttgacaacaacctgggcaatatagtgaggcccccatctctacagaaaatacagaacattagccagcatacatcgtgg

SEQ ID NO: 586786 - DNA, 367 bp, Homo sapiens
attatggtggattagctttttagatgtgctgctggatcaacttgctggcattttgtggagtgtttttttaatctatgtctatgaggttgtttcttttattgttgtgtctctgcctggttttggtatcagggtgatattagccttgtagaatgagttagcgtggagtttcttttcctcagttttttagagtaggttaagtgtgaatagtaccagttctttatacacatggtggaattctggtgagaatctatcaggtcccaggcttcagtggctgaccaggcttcagtgcctgaccaggcttcaagtgctgaccaggcttcagtggctgaccaggcttcagtggctgaccaggcttcagtgcctgacc

SEQ ID NO: 586787 - DNA, 464 bp, Homo sapiens
tccaaatgccctgggctgtgcaggtgtacatccctcgtgtggactcactgacgccagctctggtgtgcatcttgtaatatggctcatggcagtggtactggatcccagcttggtaggtgttcactcccttggtggtggtgtaatggaagtccccgttgggcaggcttcggggctgcccgcagtctttgatcttgcacctgggcatggagcgatgccacgtgccgtcatcctggcagacagccgtgaaggagggcagcgccttgttcccctccacgagctggtagccttccttgcagctgacaatgaagtagtcacggaactggtactgaggctgcaggtcctggatgatggtgaactcatcgagcgtcttgggctgggggcacttgatgatctcggtggtgtagtgcagcttccagccccggctgtcccccgactcgtccgtgaaaaacagcagatccacctcg

SEQ ID NO: 586788 - DNA, 133 bp, Homo sapiens
ccctaattttggaaaaattttttttttttgttccaaaaaccttaaaaacggtttaaaagcccgttaaattttttctttgccttttagggtcaaaataaaacttgatttaaaaaaaagggcccaacccttccca

SEQ ID NO: 586789 - DNA, 1417 bp, Homo sapiens
tgggttcttaaaaaatctgaaacttgtgaggccaaacaaagcaaggccggggctgtggggggatgtggggtgtggggtccaggggggcccggttctgtgccaactctcagctctcctctctgtgcgtgcaaaagcggggtgtgctgtgttgggggccattcttcctgtggcaatgtggcaagtgtggagtctctgtgggacgcaaagagaggggagagaggggctgtggggtggggtctcccccaagcgcgctcgaggtgtggtgtgggtggccgccccttcttggcgtggccccctctcgcagtgtgggcccgagggcgagttccctgtggaccaagggacaccagtgtggggctattgtgcgcctgtgagaattgtggggagagggccttgtgaaggcgagacccctcaagaacacaaaggagaaagagagacctgtgggtgtgtgtggagagagggaatctcccaggggggacactgtggaagtgggagacccggggtgtgagtgtgccgtgtgtggaagaatctcccatgtgtgggccccctctcctgtggggtgtataaacaaaagacaaacaacacaacatctctatatagcatattttttatagcccaaaaccccagagaaaggcgggctgtggcccccccaaattgctctctccccccaaaaaacgcggggtggcttctctggtgagaggtgggcctcccaccaaatgaatcccccctttgtgtagagcgcagagagggggaggagaaacaaaagaaaaaatttcgggccttgtggaggacatttcacgagggggggaggaggcccactcaggagaaagggcggcccaatagtggagccctttataaccccctgttggagaaccatcacacatgttgtctgttgagcaaggaggcaaaggccccctagtggcatttctttggggatataaaacgcgcccatattccggacaagactggtcttggccaccaaaaggagaaagcgagaatatcctctctaaaaaaggaaaccactttgggtggctttggcgaggcaacacacgcaccccaggggcagaatttgcgggggggacattttgggagcgagaaaaagaacgcccgggggggacaattatagaactccacacagggactaagagagtgaacacctctagatatgacagaagcgccagagacaaaaccgcgggcagatgaagcgagagagggccccatggagacaaggaggcgacaaacccccccagtgggccagatgctctggaccaaccacaccaaaaaagcggggaggacaacaacgcggccggcgacaaacacgggggaaaacccacacaagagagagacagtctgccccgacgagaagtcataaacgcacgggcgggcccaacacggggggaacaccaataacaattcgaac

SEQ ID NO: 586790 - DNA, 1585 bp, Homo sapiens
  misc_feature (1340)..(1340): n is a, c, g, or t
tttatgccttcttttcgtagtttaggtggcctcgtttttgttatcgcggtgtctcatattcttttcactaatactctacgcggcgcgcctaccggggggtactcgtatactcgtcctcttccttcgatctggggggtttttgtcggcggtgcgtctgttgttcttgtggcgtgttttcctcaccacgagggttgtcgtcgcggtcgctctttcagagtgggtgttggtcaccccccactataccggcgccttttttttggattgtgcctagttcaacctgtgtcccacttttttgtgggtctcacctggggggtccacagtgggcgcaccgaggatggttggtcttctcgtgatgaggagcaccactttgttgtggtgatcccctttggggtcttttctctttgctagcggcctcttttttttgtttgtttttccccagaaagatgggtgataggggtgttttatcagagattgagggtcctctcccctctgtgttggtgatacttttgaagtagaaagatggattcctcgtagggatggggtgctccatctccttctctcccagttgtttttcttctgtaaagaaaagggtaaacaccttcgcgagtatagattatatgagattaataaatttttccccccacagattcgtcgcacaactgggggggagatagagaagtcttctcctctcttccccccccccactcggagaggttatgtcccctcttatatttttgtgtgggtgtgatacatcatttgccctgctctcccgccggagaccctctcctccactactacgggctgtgtcctctcgtgtagagagatatttctccctcttctctctgcggctcctcccccacacggtgtctcccagcgggggatatagatattagtggtgagagatactctctccactcctcgcgtggtttcactactcccacagggcggtgtgtgtgacactcacaggggccacaggttctacccccacatactccacatgtccctgtgtctgttttgtctaccacacacacccagcgtctgtgagatactcaagaagagatgtgggttgtgtgggagagcccgcgagagggggctgtggcacatatgtctcgcgagattcttccccttctctgagctcaccgcgtgtgagccacacagtctccttgatcacacactctcctctatatatgtggggcgagtctcaaaacagccgcgggcgctatatccctgtgttctccgagacactttctcctgtgagagagagggagagataaatagcgcgggagagataacccttatgagactttcgtgtgtggttgtcctcgcccacatgtgagatntcacgcgcacagagatgtgacacctcgagaaggagatatcccacaaactttatacgcaggtatagcccacatgagacttttgtgtcacatgaccacactttgtttttatacttatatatcctgtaaaattaactccatttataaagaagattccattttaagaggaaattacactgggcaccacaaaaatattgtaattaagaagaaagtagccctcttatttaaaatttaaattgtttcccaat

SEQ ID NO: 586791 - DNA, 375 bp, Homo sapiens
  misc_feature (27)..(27): n is a, c, g, or t
  misc_feature (29)..(29): n is a, c, g, or t
  misc_feature (32)..(32): n is a, c, g, or t
  misc_feature (38)..(38): n is a, c, g, or t
tcggatcggcgagcgagcggcggttgngncanggcgantgttgtagtcatgtcagataaggatcctccagagtctccagtggtaaccggagtagcttcgacccttaaagatgagaactgtgagccagtggagaagccagaggataaatctcagcctgtagtgtccacccggaaaagaccagagaccaaaccttccagtgaccttgaggcttctgctcttcctgctcaggagactgcttctaaagatgtacctcagactgggtggggttattggggcagttggggcaaagtctctgctctcctcagcctcaagctacggtagctacagttaggacaaggtatttcaaatgtcattgagaaggcagaaacttctctt

SEQ ID NO: 586792 - DNA, 521 bp, Homo sapiens
gttatacaagaggggcttatgcttagcttgatgaccaggatgttatttttaactgattgctgaagtgtttcattctggctggtccttcacttgtggtggatttagaagtgaatgtgtttggaatatgggctccagaggatatgaaacacaattcctggtaacacatttggaggaggcgtgggagctctaaatactgtgagactctaagatctcacatatgagaatcacacgcgggtatactctgccgagagggagagagttgagggtctcatctaggggtgcaccgcatgtgtagtatctgacacattctctcttggagctgctgactgtgcacactcatgtgccaagtttcagaaatagtgctcttctgggtttgtgcttaatagaggtgtgggagcagaggaatggtgacaactctgagtgtttagctactgagatggagctcctctatcattttatagaggacagtgctctcatagagcacacagttctcattttatttagggtatggagattcgcgg

SEQ ID NO: 586793 - DNA, 276 bp, Homo sapiens
atctcagctcaccccagcatcctctttcattccaacagcctcagctcactccaccatcctcagctcaccccaccatcctcagtcgtcaccccagcatcctcagctcagtccaacatcctcagctgacgccacctgtcctcagcgtcaccccagcatcctcagcgtcattccagcagcctcgagctcaggccaccatcctcagctctaccccaccgtcctcagctcaccccagcatcctcagctcactccaacagcctcagctgaggaccatcgttg

SEQ ID NO: 586794 - DNA, 242 bp, Homo sapiens
aggatcccacgctcacctcgaaatcatcagacgcaggccgagaaccgcaccctgtccgaactggccgcccatgatcccctcaccgggttgggcaaccggcgcagcctgcaggcgctgtcgcaggcgctggcatcgcgcccggcaccaaggaggccatatgcggtgctcatgatcgacatcgaccacttcaaggccatcaacgaccagcacggccatgcgcggggcggtgcggtgctggcggg

SEQ ID NO: 586795 - DNA, 388 bp, Homo sapiens
aaacaggaatataatatatatatatatatacacacaaaacagagctggaatgaagaaatgctgaaagccagcaacgaagacatcaattgtattattaattagaattattcccaatatatcagtcaatgaattaaacaagaaataaatataaatattggaaaggggaggaacaaattatccttatgaaatgattaaacatctgaaaattccatagatgcagctgaacatcagttattttctgaaaaaatatgtcgtgagggtatttcgtcattgaatccaacatatagtgtctttacaccaactgttatttgtttttgccaggcgtaagaaggggggatccttctaaaatccaactggaatgcataccattcttagcactagcccgtct

SEQ ID NO: 586796 - DNA, 115 bp, Homo sapiens
tataaccggcgtgcccgcgtctcctaacgctccttcacacgcatggcaggagaggccaaggcaggtgaagcaccaactgagaaccctgctccagcgcagtcagtcagagcagtgc

SEQ ID NO: 586797 - DNA, 189 bp, Homo sapiens
tgcttgcttttggtttttatctgcatggaatacttttttcaacccctttattttcagtctgcatgtgtctttacaggtgaaatgagtttcttataagcagcatatagtggggtcatgtttttacactcatgtatccagtctatatattttaaatgcaaagtttaatctgtttatgttaaaggttattat

SEQ ID NO: 586798 - DNA, 129 bp, Homo sapiens
gctagctgctgccaggctcagaatgagcccgcaccctaggccagatggatgacccctaagagcttcctggaatttggatgcagggttattctgtgtgtgcggcctctcagagcatgttagtttgacgcg

SEQ ID NO: 586799 - DNA, 197 bp, Homo sapiens
tccaaagtgctgggatatcggcatgagacctttcttaaaatgtatcttccagtaacaggtgctatgtgatttagctagcacagcatcagtggggctgcgacatttcctgctctgtacacatcacgctgttcatgttgcccatggatctttctggtagccaagcttgctgtgtgcaggggcatcctctagcagtcgac

SEQ ID NO: 586800 - DNA, 188 bp, Homo sapiens
gttcttacacgggttggaagtacagtacttccggtacgtcagagagttcagggctccgatgcacttccttgtcaaacggacctctgtaaagatgaccatggaatggttactcccataggtcatagaggcactaatggaagtagacggggggcctctaacacggacggtgggatgcggcatcggcaggt

SEQ ID NO: 586801 - DNA, 300 bp, Homo sapiens
tcagaagaggtcgctctagtgtcatcgctgtggacgagaggtctgttagacccatgagacaatgaaatctgcatgcaactcccgtcagcagatccggaagctcatcaaagatgggctggtcatccgcaagcctgtgacggtccattccccgggctcgaatgcccggaagaaacaccttgggccgccggaaggcaggcacatgggctaggtagcggaaggtacagcatgccgaatgcagagaagtcacatggttaggagaatgaggattttgcgccggctgcgagagagggattttggggt

SEQ ID NO: 586802 - DNA, 181 bp, Homo sapiens
aatcgagctcggcaccgctctcgtgagatgagaagaaactaatgaatcgcccaggctcctgctggcatgcgtggtcctcacacctgtacaggggaaaatgagcatcaaagtaccttcaacacacacacacacatacacacacacacacacacatacaaattaaaatctgtatgaatgtgcc

SEQ ID NO: 586803 - DNA, 89 bp, Homo sapiens
gcggccgcctactactactactgctcgaattcaagcttctaacgatgtacggggacatgttgtaatcgtgcaaataaacgctcactcct

SEQ ID NO: 586804 - DNA, 106 bp, Homo sapiens
catgatcatcagctcgtaccgtattgggcattgtttcagctcagtcagcgatttctgtagacatcatcaaaagcaggcacttggggattctgggctttgagtacaa

SEQ ID NO: 586805 - DNA, 329 bp, Homo sapiens
  misc_feature (199)..(199): n is a, c, g, or t
  misc_feature (225)..(225): n is a, c, g, or t
  misc_feature (233)..(233): n is a, c, g, or t
  misc_feature (273)..(273): n is a, c, g, or t
cactctgttgcccaggctggactacagtggcacaatctcagctcactgcggccttgaactcctgggcttaagtgatcctcccacctcagtctccctagtaggtggaactacaggcatgtaccaccacacctgggctattttttttttttagagacagggtcttgctatgttgcccaggctggtctttaattcctggggntcgagagacaacttcatccccatctntcagagtnttggggattacagccatggagccaccatgcccggccaaanttcagccttgaatattagtgatttttgccatattagttttaccatctgtaacaatt

SEQ ID NO: 586806 - DNA, 222 bp, Homo sapiens
gagggacagcacctgcacctttccttttatttacttacttttgagacgggatctgagtctgtcacccgggctggagtgcaggggcacgagcatggctcacggcagatttactctcctgagctcaagcagtccgtgcctcagaccgcttagtagctgggactacaggtgtgcaccaccatgccaggtttggtttgtttgtttgtttgtttgcttgttccgctg

SEQ ID NO: 586807 - DNA, 364 bp, Homo sapiens
gtctgatgacattcacatgcatacaggaaaaccctgcacaagaaataccagacagactataggcaacatcactttatatacgaaaagccaatatcagtagtatcaccacagaaaggtgatagcaactgtagcaattagagtcacaagtacagtcctaattctacaaaccaaaggagaaaatcatcaacagcaccttacaatagttcaagaacaatcattccatgtaatacttttgatcagatgctggcttgttttgtgtaagttgaacaaaatgaaaggcatcagttaccatcactatcacagtttaaaagaacccaaaagtcgcacacatcaaacgaaacaaacaaattcaaagatgctgcct

SEQ ID NO: 586808 - DNA, 750 bp, Homo sapiens
ctgttcggcgtggggccacagatgcggtggcccagtagtcggccccccgttgtgaagatcgcgtcgcgctgatgttccccccccgctcgagcttagttcctatgtcaacagagggcgagcgaacatccccccggggcggcttctcacgccgctctcacacaatgggttcccccgggtggggctagaccctctcttcggtgaccgcccagtgagagtctgtccgccccctgggctctcttggcccgagtggggcaagtttggtggcgcccggcgagactgcccgcgggggttgtccatatgaggacgcttactcatccacgcgccgcctagccgtttctctgtcaactacatgattgtctcctccgagcgttgcatataggcgcggatacctcacgattgtgatcctcccgtgcgacccacaatcgctcgcgcttcgccctgagcgatgcccgcccctcgttgaaccacacagagtggcgccctggctgcgcctcccccctgctgctgcgattgcctcccctgcgatcaggcgtcgtacaatgtgctggccacacgttggtgacatgattaggcgggtgtatcctgcagtcccccgcggtgctctttcagggcccccggcacggaccccccgatggttcttccctggtcctgccccctgtagccccgccgcccctgttcctgtgcgggaacaaggggggcccccgggccggcgggggcaatcaaaaagaaccatacacccacatagacgca

SEQ ID NO: 586809 - DNA, 301 bp, Homo sapiens
tgtgcgaccgcgataatataagaactacagctcatcaggaggagatcgcagcagcgcaagagacacataacaccatgctcgtgagaaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacattataagtcttcctcaaagaaaaaccagtcggagccgagtctatcttcaacacttgggca

SEQ ID NO: 586810 - DNA, 185 bp, Homo sapiens
ccttcgtatatgtacttaatcccaggctatttccaacacattaaaacttctagtccctaagaaaaagatacaaaccctccagcctctctctaatgcatggaccaggaccagccaaccatttagagaaacaaaaaaactccagtaattcttaccttttccaaaatttggtgggtacctattacggg

SEQ ID NO: 586811 - DNA, 129 bp, Homo sapiens
gagtcagactagaggatcccttctgctgtcgctagagaaggagatgtgccagaagatggaagacgacgggtccactgtgcttgggctggtggagatcctctgcagagaaggaccctgtgtcggtgtcct

SEQ ID NO: 586812 - DNA, 105 bp, Homo sapiens
ggggactgcggggccagcctcaggtagcagcagcagcagcagcagcagcagcagcagcagcagcagcagcagcagtatttttattacttctagaaggctgccgca

SEQ ID NO: 586813 - DNA, 103 bp, Homo sapiens
agcaaacagaaaattgtggaggttttgttggtgtgcaacttaggaacatggctcaagaaactaatcacagccaagtgcctatgctttgttccactggctgtgg

SEQ ID NO: 586814 - DNA, 1234 bp, Homo sapiens
ccacgcgtcggtcggagctctatggacggtggcagcgggtaccgacgtggtggctgtagcatcgactcctctgagctgagtttgaggccgtccccgactccttcctccgccttcggtccgcgctttgctgcttccggtagccccatgtcctactcatcgcatctgacgtttattgtacaggacgagcgagtatccgtgctggttaatgccctgtcacccaagttagggtactgctacgtatacgaggacaatgaagtatcaagttccctggagggagaatctatcatcatacgtcacctgcactataaacgaattcatcatcagtcattcagcaccttactttacccttggtgcggccagacatcacatcaaacaggactagacgcgaatacgacaccactctacttgcctacaattgccaccgatgccctgaacccttcgtatgcctgctcccaacgtagccacccactggtatccacacgcctcatacttgctctgccataatcaagctgcacactaatcacattgtgctctcaatcgctatagatgatataacgtagacaggtatatataagtgttgccatcccatatagtgactcatccttggtatctacaatgggtaacaaaatcacgctagtaggagacccatcaatatcgcatgtccagccaactcacatcattaaaaataaggaacatcactttaatccgccctaaaaagctgttcacctagggaggggtaaacaatacgaagtcgataaaacctgccaccaaacaaatatggtcaccacattggcctcaaggcatgcaacccacaccccagatatgattgtaccatcatgatatcgtagcattaaatctcatactctcaactcatgtctctcccataatgaggccctccattgctcaatgtccatacttacacgcaaaccattagagagcacctacactataatctgtctgtctccacttgcatagtcagactgggagaattgcaatgtgcaattcgtgatccagccacttcaaaactcggaccagcatgctcctttgcacaacaaccatcagagcactacagcattatgaggtcaaatcggcacaacactatcatagtccttggcccatttatcttaaagcagcgacactctaacacgctcaactcccacgtgcccacccgcgcaatcgtctatgtggcaaagtcacgtaccccttcatccacacccaagcgctctaactaaca

SEQ ID NO: 586815 - DNA, 868 bp, Homo sapiens
  misc_feature (37)..(37): n is a, c, g, or t
  misc_feature (50)..(51): n is a, c, g, or t
  misc_feature (62)..(62): n is a, c, g, or t
  misc_feature (72)..(72): n is a, c, g, or t
gagagtggaggagagggacgacgcccttacgaggagnaagaaaaaaaaanntttatgagagnacgcccggcnccctttataggtagaacctggctaacagatttcctcagcaggcctgggaagaagctcgacagtgtttgtggaaaaaagagaaaaaataaatggttttggttgattctgtatttgagtacccttgttaatattttaaattgtccaaacaaacattctaattgttccttaagaactcattttcccatgtttatactcttgccacactgtttttttggcatgtactgtacactatttataatgactgtagatactcgaatgttctacttgctaattttgcaaggtgagtttatttcatttatgcagagtatcttggaatttggtaatttccatcgtatgaaaaaatatactctgcatttgtgatatgggggaaaggagacataagattacgcaggctgtttggttcttggaaaaaggaacttattctgctttcattggtgactttacatggtaaggaaacgcaacttggaggaaaaaggcgactgccagctgtggaagttggtaaatcgagacctgagttagggtcgacgaatgagtgtgaagagggatacgggggggtgcgggagggtagcgtggggcagaccccgcatatatgcacgtcgcggtagcggcgggtgccttgggttatcagcagaggggtttagtactgcggggtccaatcgttgtcgcgccaacagcttaccttcctgacatgtcttttccctagtcgtgtgaaatgattttttcggggggtggccgttgacgtctgtcgactgggtctgggtcgtgtgaagaagtggcgcgggcggccggcgcgagg

SEQ ID NO: 586816 - DNA, 931 bp, Homo sapiens
agaagctgccatgagatctggaggtgtacagtgtcatttggcaagacagtcaagcagctttgtagaattggcataatacgatactggctgcagaagctagcatggctaacatctaacgaatatatagacgtatgataacataggatcgtagtaagaatactgagtggatagtcagcaaatctagagtcactatggaatagagtgtgtgaatcttgaagaaatcatttgaagaggaaatacgaaaaaagatgtcactagatgatcgttggtaggtgatttcatagaaagataagatgctggaatgtgtagagcggaaggtaatagcagttccgtgactaaacatggaaaatattgaaatgggtgaaatggtaaatggataaagagaactggcacttgtggaggtcagaaaattcagaaagcatgtccttctcgatggttgtatgtattaatgatgtgcctgttaatattttgaggtgtatttattaaacatactggctacggttgagtaaagtaatacaggttgtgctatgtaatttgagtaatgaacgtgagcgaatagttcgaatgacattgcatctagaggtgagcttattgatctgatttgagtgaatggtcacaagtaaaactattgaagaggtaagtacagagagtgactgacagaacaggtgaagacgctttgttacaagaactgtgttaaaggtgtcgtggtggcaacaatgtcgtattttgaccttggctataattcgtaacctactcagaacaaggttactccatacgtgttcagagacaatattgatgtaatagactcaggaatcactcctcatgtaataatacccaatttattgaatgtcaaagcttattagaagtcgaagacctttattgccccggaaatcaaccctgactcactactgacgcacgggaacaggaagct

SEQ ID NO: 586817 - DNA, 762 bp, Homo sapiens
tgatgccgctgctcgtgttcgtcctcggcggcccgggccggctaggggagccagtgcgcccgcatttgtcgagaaatatggctacgcacacactttctgcaggagagctgcttcgtgatgaaaggaaggaacccagattcacagtatggtgaacttattgaaaagtacattatagaaggaaagattgtaccagttgagatatccatcagtttaattaggagagggaaatggatcgacacaatggcatgccaatgcatcagaagaataaatgcgttgattgatgggtttccaagaaatcaaggacaacccttcaaggatggaaccaagacatggatgggaaggcagatgtctctttcgacctgcttttttgactgtaagtattgagatttgtattgaacagagtgtcttgagaggggaaagagtagtggtaggagtgatgacaatgagagagagcttggagaaagagaattcagacctaccttcagtcaatagagccatttattgacttgtatgaagaaatggggacagtcgccgaatatagatgctgctaaatcttgttgatgaagtttgtgatgaagttgtgccagatttggcggacagggcaagggcctaatttcgtaatcgctggaaaggcatccttgaaatcttgcttgaatattggctttgatagctgctatcatgagccctttttaagggccacgtctgatacttccataagtacgtctcaatagtggctgggaaagtacgtggataaacagagta

SEQ ID NO: 586818 - DNA, 947 bp, Homo sapiens
gcacaacagcaccatcatcaccatatcattgcacaacacattattctccaaataacattctccatcatacaaatccaggtctataacggtcagcacactcaccatctaccagcatcacaggctgcggcggcatcacacatggcatgaaacactcacagcattccaacggccacacaacacagcaacacaccagcgcgctagcgtagcatcccctgcccagcaggcgcaaccatcacgccaagcaagttagtcacagcatggtcgcactcataggtcgcccagcatccatctcagcggctatccaacaatccattcacataagcatatccatcagcccaatcctatgcttaagaacaccacaattggtatctcaccccctcgttcatggcctattctctccactcgctggtacaacactgaacaatgcactgcactacagcaggaacactatctgcatggtgcggggcatcgcgtggtacaccgcacatctagcgcacagctaccagtcacaatggtcacaaccctcttccagaccacaagtttcaccattgggagacccttgcctaaaaacgccttcacactacaccactggcctcaggccttcttggactatcggcctacactggcttgcgcaaggaactctaccgggttgctgtagggtcatccaacgccactcacttacctctggtacacatcaccagcacgtacacacagcattagaccaacaatttacttccacttgatatctcagggaccctggacaacctacatgccaacgttactttacaagaaagcatttcacaggcctggccgttctcccttggcctaaatggacaagttctatgggatggatcacggcaggcgaacccacatttggtcacgggctctttctacacctcccccggtggccttttggcaaaagagcatcattcgccagaattctcatc

SEQ ID NO: 586819 - DNA, 154 bp, Homo sapiens
aagttctcgagccttacttcaggagggcattgaagattcttattgtaggccaggaatttggaaggcttccattagctatgaattccaaccctgttacttccacttggcaattagagccaggaccctatctctgggtatatacatacatcttttg

SEQ ID NO: 586820 - DNA, 362 bp, Homo sapiens
actgaggcaggaggattgcttgaggccaggagttcgagaccagcctgggcaacatagagagatgctgtatctccaaaaaataaaacaattagcctggtggcgcactactgtagtccccgccactcaggaggctgaagtaggaggaattgcttgagcccaggagttcgaggctgcagtgagctatgatagtgccactgaactcccatcagagtgagagagcaagactgtctcttaaaggtaaatgatagatttaaaaatataagtctttgactcttagtatcccatggaagcacattcacagtggtttgtagatggtgataataatttttttttcttggcatctctaagtatattacctacct

SEQ ID NO: 586821 - DNA, 176 bp, Homo sapiens
gacagagatcaagatattgctaaagaaaaaaaaaaaaaggtaatataaagttagtcccaaattataatggtaaccaaaaaatggaagtttagatccaagggtgggtttaaatttaggttaaatttctcacggtcagtgtctctgtttctctctctgtgtctctctgtctcccccgg

SEQ ID NO: 586822 - DNA, 152 bp, Homo sapiens
tgctttttaaatttgcgggtgtcaatccatgaaattaggattggttcccaaatgacatccgcaagtgattgattctaagatttaatagttggcaaagtcattttacctgtgtctcaaacaagtaaaccccactcccttgggttaccatctga

SEQ ID NO: 586823 - DNA, 188 bp, Homo sapiens
cacatctttgcacggtacattggaaataatatcacttctttgtagcatcaaaaatgaaaccttttctgtacccattctgcttttctttagggccttttacccccatttgaggaatttgcagtttggtttgtgtgtgtgtatcaattcattaggaaactgaaatggagaggttatatccttgggaagtg

SEQ ID NO: 586824 - DNA, 454 bp, Homo sapiens
  misc_feature (9)..(9): n is a, c, g, or t
  misc_feature (17)..(17): n is a, c, g, or t
  misc_feature (83)..(83): n is a, c, g, or t
  misc_feature (361)..(361): n is a, c, g, or t
  misc_feature (404)..(404): n is a, c, g, or t
  misc_feature (416)..(416): n is a, c, g, or t
  misc_feature (432)..(432): n is a, c, g, or t
agttgttgncccctttngtcattaaggattactatcatagtaagagtatcatcgtgccgcgtaatcccgttattcgtccctangggggtccaagaatgacagttgaaaaatggtgttcaaatagttcggccagagcctttgtcttcgccaccccggccactgcagcctcagcaacaatagtggtgccgtgtcgttttcgtacattcgccaaacattcagtctattgtccgggttaaatccccatttcacgtgttccatttggcacaggttccaatggagcagtgccagcctcaccaatcgtcataacaattatcagtgtaggtattcccgtcttcattccaatggcaatgggccgttcctncataatagccgcagcccatagttcgtgtttttgcaatgacagncccatgctgttnccgcgttacaatgttntttccggcacgcagtatttcgg

SEQ ID NO: 586825 - DNA, 202 bp, Homo sapiens
tagaggatccccctccataatgtgtgcccaaagaatcaaaattataaacaaactaaaggaaaaaaatgtaaatagaagaaaaaaataatgtgtgcatgtttcaattctgctaaaatgtatggccaaaatggtgaagatggctattttccaacatctccacaaatccctttaaggataaagatttttctcatacagcaatacc

SEQ ID NO: 586826 - DNA, 762 bp, Homo sapiens
  misc_feature (520)..(520): n is a, c, g, or t
ctcaagaacagaagggcggcaacaaatctcacggctttgctcttgtgcaagtttaaacacccaaaagagcaaactgatctcgtaagggagctagatgcaagcccactgtccgttgtccgggtcgaagttgaaatttccaatggtgagaaacgtcaaagtttcgaggcccacctcttccgtggattcgccgcccacgagacgattatagacgtggtgatgattatagacgccgcagcagcccacctgcaagacaccggtctcccaggaggagctttagccgtagtcggagcaggtccctttccagagagaggagaagagacaggtctttgtctccagatagaaactataaaccttcaaggtctttctcaggatcacgcagtcgttcgcgatccaatggtcggaagtgaagtcttcaagcccagcattgtcagaaaaagtgtgtctgtgcctgctctaacagactaggatgatgggaaacaacaatggaggtgttttttttttttgttgttttttttttttnttttggccccccaaaagtctttttaaaatgtttttcccccccatagtgttctaagtatctttttttacttaagatatctgtgcttaatgggtagtaatggtttcatcctgcctcaatgcttggaatgtaattttatgctctttgggcagagaagtgttctgaatggtttgatataggtgatcatttgaagacgattttgtatgctttttttgtttgtacttccattaaaatgttccttacga

SEQ ID NO: 586827 - DNA, 849 bp, Homo sapiens
  misc_feature (51)..(51): n is a, c, g, or t
  misc_feature (100)..(100): n is a, c, g, or t
  misc_feature (138)..(138): n is a, c, g, or t
  misc_feature (233)..(233): n is a, c, g, or t
ttgatgtacattcttgagggacgctaaaggcaaagtaaggtctgtcttcangctgtaaggggatggtaaagaaacaatccttaaggtcaataacaatttngtgatagtttagggggatggctacaggagagggaagancaggctgaagggctcccatggggaccattactttattaacggctcttagatcctgtaaagacgccagttacctgattttttcttaatgatgaatntaggagtattccatggagaatttgtgggctcaatatgtcctgctgcgagctgttcctgtactaacgcaatggcagcgagggttttctcatatgtaagtggccactgatcaacccacacagggtctgtaattttccaggaaattttgtcagcgtggggtacaggaatgtcaatggccgctacggtaaattttggtggaatcctaggcctgttttgtcttttttgggggtaatagtaatgggctgggtgattccttgattattttttcccaacccttggacggggagataccctggcttagcatttgggtcatgacagtatcgttgggactgcacatgacaagtttcatttgagagaggatgtcccttccccagagattgactggcagattggggagagacataaggggtaatgtgaccattattgccttcagagtcctcccacttaagcatttgagcactttgttgggggttggtggcctggccaataccgcgcaggtgagtagcaacggttgttaacggccagttcctcggccggtgagtgtaagatataacggtggcatcggcccctgtatcaagaatgcagaaaagagcttaccatttaattaagttcagggta

SEQ ID NO: 586828 - DNA, 225 bp, Homo sapiens
  misc_feature (225)..(225): n is a, c, g, or t
tcgtgtccccccgagctagcccgacggacaggtagtagggctaagggtcacgacgttgtgacggcgtctgtggcccccagacgacgcctctggtcgtacgagtgtaggctctggctctgtcgggcgtacgtcgggggggtctcctctacgtgtcgctctgcgggtctgcgcttttggctgtgcgccgttgttttcccgtgtcgtgtgtgggcaccctctggcgan

SEQ ID NO: 586829 - DNA, 1120 bp, Homo sapiens
gccaggcaccatgtccccgcgggccccccagccacagcctcctccggctccccactgcatgcagattgctgcatactggatggatgcaggccgatggggagggggcatgggccgcgccagcccggaccgggggacccccgtggaagatgtggtcatcgaagaggtaccacatccaccaggagcctgatccccggtgcagtgcagatggcgggattcttgtgcgctaccactacacacggcacttttgaagatggcaagaagttcgattcaagctatgatcgcaacaccttggtggccatcgtggtgggtgtggggcgcctcatcactggcatggaccgaggcctcatgggcatgtgtgtcaacgagacggcgacgcctacattgtgcctccaccaactgggcatatgggagacatcgagcactggccggggctcattccaccggatgccaccctctacttcgatgtggattcatgctggatgtgtggaacaaggaagacaccgtgcaggtgagcacatagctgccgacccgaccccggtggaccccgacatggtacaaggaccggcgaacataagaacagcgtagcagctacaaatgcgcagcctgactggcacgggcacctccattcggagcaccagcgtacagacaaggggcgggcactatacttgaaaacatatgtcgagcatctgtattgggctgattcaaggggaatggaaccaggggatgatgggacattgtgtacctggcgagagacggaacgattattaatccttcaaatactgggacatatggcgactcaagggtaatgggacaggagaatcccgccacaacagggcctaggacgagcgcatacgcagatcatcaatagatgacggtgaacaacacgaagaacgagacacagcaaaagcacagagcagacccccgggagtgagcgaacagcgggcgccgggaaaaaaagggaaacacaaaaagcgcgtgtactgacgcacaaatagacaaagaacgcagagcaagacaacagtgggcggcaaaacgggatgaaggaaaggaccagcacgagcgaaagccgcccagtgaacagagcagcagccccacactcacagtagagcagacagcggcg

SEQ ID NO: 586830 - DNA, 1059 bp, Homo sapiens
acgaagaataaagagaacaaaaaagaagaaaccagactagcagttagtgtatcattcttactctatcatgttcttgcttgtgttatggtgcatagtttattcgttttcactacatgtgctttcccgcatcagtcctatgtggttcgccccctgtgtgtgtctctctcttttctggcgtcgtgtttgtttttgtttatcggagtgtgtttcttcaggggtgtgtccacatatattgtgcccccgtgttggcgcttatttttcacaccacgtgtgtttggaatccccgcggtgttgttttttacacactgtgtgggatgctgttcccagcccccttgggtgccatatttggtggcgttattaccccctgtttccactcctttggtcttttgtacttggggtctatttctctggtggagatacttgttgcggggcacaattttcctcgaaaggtggggtttgtttctcccgcctttctttgtggtggacattttgtgcggtccacgcggcctcttcgtgggttgatcttctccctctgttctcttacgcttttttgggcgtctcatgatcctgtttgctgcgaaccactctgtgcgaccaatatgagagtgtgtatgtggctctcgacctccctcgtcggtttagtttgtcggcatacttttccctggggcccctctcgttgggttcccgcctctttcttttcgtggtcggccatctagtgttatagatatagcttcacccccttcgggccatctcccctgtttgtgtgcagagaggttatactaccctcttgtcaatattcttttgggcgcgaaacgttttctgctctcccacttattgtgtcatattttctcccgtgggaaaagtgtccaaagaactggggcaccttggggatatgagggcaacacagattctacaaaaattgtgtgagtgttcgcttaggccctcttttgtttttcttccccgccatatctctgttatctgttgtcacgaactttggcgaggtatttagtacaatctgttggagaagggaggaggccgccccgaacatgatacaaaaat

SEQ ID NO: 586831 - DNA, 673 bp, Homo sapiens
  misc_feature (505)..(505): n is a, c, g, or t
  misc_feature (578)..(578): n is a, c, g, or t
agcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaaaaaattaacttggcgtggtggtgggcgcctgtaatcccagctactcaggaggctgaggcaggagaatcactagaagctgngaggcagaggttgcagtgagctgagaatgtgccagtgccctcctgggcaacaggagtgaaactctgtctcacnggacataatataaattagtggtctttataatgttgctgaatgaattttgttcagacaccaattttttaatggattacgaacgcgttaataatatt

SEQ ID NO: 586832 - DNA, 100 bp, Homo sapiens
gtatttgttcttccaccattcctatctgtctacttcagatctgaaatgctggctccctcctgtgtactcctcctctaagcatgtgctcttcaccggccat

SEQ ID NO: 586833 - DNA, 384 bp, Homo sapiens
tgatccccggagtgatgcactgtatctctctgaactggttgttatcgtgtctttgctgaatggtggtgcgggatagcattgtctccaccgacacgcacctgtttctagttatcgctgggtcatgttcaccgttagcaaagatcacagactaaggagcattcagtcggatatttgctttgctggcacatatttaaacacacgacaattcattatctttggacacatataaatattttgttccctgtcctttattgcaatataatcatgaccggccatggttaactacatcagatacacgttacagtcgtgactgggacatgccgtccgtaatacaagtgttcttgggttaaaggcaggcggctttttaattaaatcttaaagcac

SEQ ID NO: 586834 - DNA, 1039 bp, Homo sapiens
  misc_feature (87)..(87): n is a, c, g, or t
  misc_feature (435)..(435): n is a, c, g, or t
agaccgccttttctcgaggttcggccccccgcggtgcagcgcaccaaagaaggttgttcaacgacgcccactacggcgtgtactcanggtccccacaaagttgggcgcccgggtggtgcccagagaacagaacccggggcccgctttttcaatcggaagaacacacattctcaaaggagcgtgtggtttttgggcaacagggtgtacgaccacccgcagcaacgacacaaactacccgagggggggcacaaaggtgatgtctcaagagtagccgcctatttttctcctggccgccgtgtgtgttggtagtgccgcccccgcccgttggccctttgggtggtgaacgccggtgggtcccaccaaggggcgcttttttttttgaggggtcgcccccgccgcccggtgcttctttttggggagacccactccttggtnggtgaatccaccacacacaccccacccgccagacaaaagtgggcgccccggcgccctttctcttcgacacctgctctcctcggcgacgaccacggtgggacgggacaaactttcgctcttagattttccacaccacaccaagcgagggtgtttattcacacgaacaccactgaggtgcccccacacacgaacgaactctgcggggttgggcggccaccgcgagacgcttgatcggacacaacaaatatgttctccttgttttttcacggggagtcattacacaaggacgtcatactccacagaagatggtagagcaacactggggacaaaggcagcaccctcctccattgtccgtcgcccaaccactctacacccctctcagcctgtgtagacccaaaccacacaagccccaccactttcccctttttaacacaggggtccccttagaaccagccaagctcttgttaacaacagaaggatcttttggggggggcccttgccctaaacccccccccccggggggcacaaacccccccccaaaaaaaaaacatccaaaaaggcccaattttgggaagggggaaaccaaaaaaatttccccttttta

SEQ ID NO: 586835 - DNA, 127 bp, Homo sapiens
ggctcgaccgatttcactggttgatatattgctgcactgagtgtgtgcatttttattcaaggtcatcgtgaagctgagaagtttcgttgataaccttgaataaaaattgcacacactcagtgcagca

SEQ ID NO: 586836 - DNA, 121 bp, Homo sapiens
cacgactgggtagactggaaagtgaggaacaagttttcaagccaggtcttggtgcattcagcttttcagtttttagctttttttgcagcacaggatctccctctatgcccgggctggcagg

SEQ ID NO: 586837 - DNA, 134 bp, Homo sapiens
  misc_feature (12)..(12): n is a, c, g, or t
  misc_feature (15)..(15): n is a, c, g, or t
  misc_feature (17)..(17): n is a, c, g, or t
  misc_feature (45)..(45): n is a, c, g, or t
  misc_feature (47)..(47): n is a, c, g, or t
aagcgggagcgngangngagaagctggcggcgccgtcgggcccgngnccgggccatggagctgtggccgtgtctggccgcggcgctgctgttgctgctgctgctggtgcagctgagccgcgcggccgagttcta

SEQ ID NO: 586838 - DNA, 1208 bp, Homo sapiens
  misc_feature (433)..(433): n is a, c, g, or t
  misc_feature (471)..(471): n is a, c, g, or t
tccgtatctgcttcgtggcttccacctcatttttttcggcttgcccattctgtttcagccagtcgaccaagaatcatgaaagtcgccagtgtggcttgcatccgccactgtcgccgtggtccccatgctgcgcgctttaatggcctggctaatgacaggcgacgcggtgcggcgcgaggtggtgcgcttgtctgtctgagcacgagcgtggtccatctcgcgctgctgccgggggcgtccggttgcgctgcctgctcgtgctccatgactgtactgatggcatgcaggttatgctgtgcttggtcttactgacttttgacacagtggctagattacgtcgacagcgcattcaaagttgatcttgagtttgcctctatctcgtgtcctctctaataaactcatgcaaaacggattgaagtcgatcaggctgggnacgcaatttcttccctagctagctgttctatcatcacntaactattcagtggaatcctttcaggttcgggaagcgttgaccaccctgccgtgaaaattcccaggataccctttttgaggaaaaccccccaccgcggtgtgggccccgtggacgggcgctcatagacccggtctacctgagtggcttcctgtgtccaggcaaaccactatcgaatggtcgtggaggaactcaaggggacctcttggtaatgaggcctccgaagcagctcggatcattgactagttcgcttgtcaggtgtaccgaggcggacatattcgtagggtgtgattccgacttgtgaaacggctgtgcctttcccgccaccaaattgggtaaacccagggcaggggaaacaccgccacaaagcgccaatttccaagcgggcgtggtccaataggaaaggtgtacacttgttcacccgttttgcctttctgtgttgcgaggtttcattcccctcccacggaaagcgagcgggcccttctgccccctgcgaagtctttagacggctgggaactgaatcaaaatcgaaccctggaatcctgtgcgttggcgctcaatcatggggaagtccctcttttatagcctttggctattttcccacggccgtggggaggcgctttgcacagcggtcgttaggaggtgaccactttgtgggccgacggtactagatgttgctgggccttcccattcgttccttgggacgcaccccgtaacttaagttcacaccccattgtag

SEQ ID NO: 586839 - DNA, 635 bp, Homo sapiens
ctggccacagtatgaggtgttttctaaggcttgacattaggtatttcctagtgcaaaatttactgatcccgcgtaggctccaacctagagccaggattccttaatggaacacaaactgatttactttgaatatactcaagcttcacagcaaacacttcctgtttctattactgtccaagtcttcttaccatgcctgaggcagacaatttaaggcttgattcctcaccctttcccttcatctgctgaaatcccatttagttttagtgcaccaggcatgcactggtatttcatcctatgcattccttccacagcctgacctataaagggctgacactgagtcctggcttgttcagatcagagagaattaacacttttatttctttgatttcaaaagcttctgaggtaacttttgagctcgtaaatgtcaataatttgttgtcaagacaattatattcttaacccagctgctacatatagggaacatagagactgacagaaagtcagtgaatttagaattaaaacagttaagtttatctgattgaactatgcttctcaaaatgttaaatggatgatacaaattaatacaaccaattccattttatttgggtttgggttttggtttttgaatgggttta

SEQ ID NO: 586840 - DNA, 106 bp, Homo sapiens
cgaagccagtcatgcctaggcgaaaggcaccgacaccaggcatcgccacagtgatgctggtagaagccacaccaggcccatccagccacctggccactgctaggcc

SEQ ID NO: 586841 - DNA, 169 bp, Homo sapiens
gggccccggccatttgccccttccccccccgggggttttccccccgggggggcctgcccccccccggaaaggggggcccggggtcccccccccctgggtttcccgggggggttgggtttggggtttttttcccttttggaaaaaaaagtttgttggggcggggggggca

SEQ ID NO: 586842 - DNA, 1504 bp, Homo sapiens
  misc_feature (300)..(300): n is a, c, g, or t
gaacttctaatccatttgcccatcgtgaccgagttaacgctggaactcctcagagcggacttagaaccatgggcagagggctcctaaaagggagagagagatctcaagctaagagggagacacatgagcccaagagagggaagtacaaccgaatggcacaggatccccgggaaggagacaatcgaatgggtgtcggaggagcaatgaaacatgggaggatccctcatggttcaggagccagaaatttccaccttctaggaggtggtgctgcataggcttatgaagctaatcctggcgttncaacagcaaccatgaggggttccaagatgggaagtgacatgcgtacttgagcgctttggcagggaggtcggggcctgtgggtggacagggtcctagaggaatggggcctggaactccagcaggatatggtagagggagagaagagtacgaaggccccacaccaaaaaccccgagttttagaagtgatatttaggctttcattcccgtgttgttttgtttttttggtttagagtaccaatcgttttaaaattctgtgcattttagtaagcaagctatctttttatggatgttagcagtttattgacctaataatttgtaaatggtctgtttgggcacggtaaaattaatgtaattgcagtgtttggaaccacggagaatttttttttcctttttatttctttatgtttttcttttttacgtataatgtccctcaagtttatggcagtgtaccttggccactgaatttccaaagtgtacccaatttttttttttactgtgcttcaaataaatagaaaaatagttataatatggatcttcaacttggccattcaggcttctatgcatattaggctacgtattccactttgaaagcttgagagtgtctaggcctttgaatggcatatgccatttctgggaaatggcatctggaggctaagtatggctttctacaaataattggcccccttggttttaaaaaagaagaaatgcatattggacagtagttggatcgattggttgggcatataggaagcacgctggtgctaagtatttttaacagggttatgtaagcaaagctgaactgtaaatcttcaggaatatgtcttacgattcgtgcaatgggtgtaacaacaactgggctagggggctgacagcttgggttggatacacactggatctttagttgggccctatgatctatcctttacttgaacagctttcgaaaacgtggaaaggtcactttggctggcattcccctcatttctgtgttttttaacagaccaacaatttctcaagacccttataaatgcgttgtattgaacccttttacattctgacttcacgattgtgaaccctgaagtctttccatgtatctccagtgcatctataatcgatggggctgcgtctaacaaacacaagcttgaagtaagaacgttcgtacctgggcgggcgcgtggttcagccctgtatcccggcattgggagct

SEQ ID NO: 586843 - DNA, 267 bp, Homo sapiens
  misc_feature (51)..(51): n is a, c, g, or t
  misc_feature (61)..(61): n is a, c, g, or t
  misc_feature (65)..(67): n is a, c, g, or t
  misc_feature (83)..(83): n is a, c, g, or t
  misc_feature (87)..(87): n is a, c, g, or t
  misc_feature (145)..(145): n is a, c, g, or t
attcgcggccgcgtcgaccacacatcgcaaataagttcctgagaatgcttntgtctagttnttannngaagatatttcctttntcancataggcctgaaagcgctccaaatgtccacttccagatactacaaaaggagtgattcnaacctgctctatgatagggaatgttcaactctgtgtcctgaatacaaacatcacaaagatgtttctcagaacgctgcagtctgcaatttgtagtcgacgcggccgcgaatttagtagtagta

SEQ ID NO: 586844 - DNA, 738 bp, Homo sapiens
  misc_feature (51)..(51): n is a, c, g, or t
  misc_feature (61)..(61): n is a, c, g, or t
  misc_feature (65)..(67): n is a, c, g, or t
  misc_feature (83)..(83): n is a, c, g, or t
  misc_feature (87)..(87): n is a, c, g, or t
  misc_feature (145)..(145): n is a, c, g, or t
attcgcggccgcgtcgaccacacatcgcaaataagttcctgagaatgcttntgtctagttnttannngaagatatttcctttntcancataggcctgaaagcgctccaaatgtccacttccagatactacaaaaggagtgattcnaacctgctctatgatagggaatgttcaactctgtgtcctgaatacaaacatcacaaagatgtttctcagaacgctgcagtctgcaatttgtatgaattcccgcttccaacgaaatcctcaaaactagccaaatatccacttgcagattccacaaaaagagcgtttcaaaacttctctatgaaaagaaaggttctactcctttagttgaggacacacatcacgagtaagtttctgagaatgcttctgtctagtttttatgggaagatatttcctttttcaccttaggccggaaagtgctccaaatgtccacttacacacactacaaaaagagtgtttcaaacctgctctgtgaaagggaatgttcaattctgtgacttgaatgcaatcatcacaaagaactttctgagaatgctgctgtctgctttttatatgtaatcccgtttccaacgaaatcctcaaatctagccaaatagccacttgcagattccacaaaaagagtgtttcaaaactgttctgtctaaagaaatgttcaactgtgttagttgaggacacacatcagaaacgtcgacgcggccgcgaatttagtagtagta

SEQ ID NO: 586845 - DNA, 238 bp, Homo sapiens
gttctgtttcagatcagtcaccactgggaacccagtggacctctgtgggactgaactcctaaacgcagggtgcgggagctgagcgggagaggtgacctccaactgtgtacctgaagttcgtcttccgcttggctcaggacaaagcggtgtaacgagtcacggtctctgcctccattgtgctcactgactttcttccctcctcggaagaagccataacgtgagaacgacccaagttacg

SEQ ID NO: 586846 - DNA, 1089 bp, Homo sapiens
tatccgcgacgtaccggacacacctgtcccagcctatcacccgtacaagctgcccagtccgactgcaccctaccgacaggaccccgcatctccactcgcaagccccacgcgcgctcgctctcacctatgctgccgtcctagtccaacgcacactcctcccactctcttcctcctcaaccctccctgcgcggcctcctctcgcccggctcccacgcgagctcgacctggacccctcgctcccccccctgtcctcgcgcccccctcgtccctgcccccctccctcctcctcccccccgcccgctccccccgcccaccccaccgcccctctctcctccccctccctacctcgctcccaccgccccctcccctgtccccctccccctctcccccctcgctccctcctcgctccaacacgcccgcccccccccctcccctcttctcgccctctgccccccctccctcctcctgctctccctgtacggaccacaccacacacctacccgccccgtccaccccacgctcctcttccacaccaccaaccgcccccatctaccttcccatcccccctcctcccctcccccctcttctccctccctctgcccacgcccaccccgcccccccccccctccccccccccctcccctcgccctctcccacccctcccctcccccccctcctccttccccccccaccccctcctcccctccccgcgccccccaggccgcacaccgcctccccctcccctctccccctccgactcgcgccccatgccgcgtccccaacgccccccccgcacctctcctcctcacccctcctcgccccacaccctgccccctcacccactgacgccacagcagctccccccctccctgctcccgtcaacggccaccacgtcacatcgcacgcgcgcgctcctctcccaccccccgcacgctgattccctggcgtgactggagtgaggccagcgcctgctggacaagaaggagaccatccgtaccagctcccagcccgccgccccagtgcctgacgtgcatgtccccgacggcgcgcaccctctcaccgccgcccggcgcgcgcgccactcccgcc

SEQ ID NO: 586847 - DNA, 354 bp, Homo sapiens
tgaattcactgcccagtacttgtctcatttcccaagcctttatccaattctcagccactgagtagggtaccacctgggtcatagtgtgctagatagtttcagccagaagcctggaaccaaggtctgtgctggccctcttggcttctcagggggcttccctggtcatcctccagcagcacctgtcttagcgctgggtggccagcgtcctgggctgtgtagacagggacatctttgtcccagagtgcagcctgccccttgataatgtcagctgccttctctgcgctcatgatgtgtgggggcgttcaccaccccgaggacccgtgtctgcggatccaccgcgacagtgggatcgca

SEQ ID NO: 586848 - DNA, 285 bp, Homo sapiens
cgctattcatcggcacctgctggtccactggagctcgtgtgcccccggagacgtggtgagcctggtccccctgtgacctgctggcttatgactggatcccctggtgctgatggataacctggtgctctcgtcgagtctggtgatgcgggtgctaactggcgatggtggtccccttggaccctgtcggacccgctggtacccctggaccccattgataatgtcggtgctcctagagccaaaggtgctcgcggcagcgcaagaccccctggtgccgataaatagcga

SEQ ID NO: 586849 - DNA, 299 bp, Homo sapiens
gaccactgagtcgcaacatgtggcgtgggtcccgcagcatcacttaggaaattgtgagaaagacagactttcagacccacaggatcagaagttgcatattaacaagactcatctttacatgactccaggtgattcatgcacaaattaaagagacatttttgtaaagctcccagatgattcagaagatgttggtccatgtaccgcactttgagtagcatttaacaggagtctaaatgttgtaaatttggaattcatcttccccctcagtagtggcaacaaaaggttcgttgtcatcctta

SEQ ID NO: 586850 - DNA, 877 bp, Homo sapiens
cgcgagatttgaaggagcggcggaggccagagggaggagaggaccggaagtccttcatctcaagcatccaagtgctgaaagacggcgtgagttttctctaccggaagcccttttccagtaggcctgagaacacggtcccagcctagcatggaagtcccacctccttgtagctcctgccacccttcccgaaggttttgctgtcacctgtgtgaggctccgttcccctttccgctgttttatccccgtaccagaaaaggatacatttaggtgcctcccacccagctccactaaagcgggacgcgcggcctcctcagcctctttcctcccggctgccgattgcaccctgcgagcccttccctgcttcctgtggttgtggcccgcttgtgctgtggggagctgtgccccgaccgggggctcattcgagcgacctcggaaccacaatgccagcatggactttgcagaccttccagctctgttggggctaccttgagccaggagggctccagggtttcccttgtggaggctcagcccagacaatgcttgggcccatttgccccgacatcccagccctggacaagggttcagcctttatagcgctgttcagagagattcgacttgcaactttgacttcgaggtccttatgtgcccagaggggcggcatattggtgccgctgttcggtaaacaatggggaattccactgcagttctgaacgatggtgtggcactcattgacggaatccaggcagcagatcttggatccccgtctgtattcattggggagacaaacgtcgaagtacctggcgtgcctctctgtctacagaaagggcccagggcatggcccgacaactccctggcattgcttacccttaagaatcgc

SEQ ID NO: 586851 - DNA, 539 bp, Homo sapiens
  misc_feature (193)..(193): n is a, c, g, or t
agcacacagggccttgtgtccctctggcttcgggggacttggtcgactccatctctggatctcattccacttctggacccgagagctaggcacagatctatactacaggctgtcctgcctgtctcggggcacgatgtcctacgtacaaagtcacggggtgtccaccccgtcatttcacaccatgacagccgtngaggctaatttgcagggtgactctatgaacactgtgtagtcctttcgggttgttcatatggcccactcccataggacacatatttaattcatcagaacatgaaacacttggcaggcacagtggctcacccctgtggctccacacttttggaggccgagatgagagcgtcacttgaggccaggagttcgagaccagcctaagcaatatggcaagatcctatctttattttaaaacgaatgaacaaataaaaaacaggaggctgggccgtggtggcccatgcctgtgatcccaacactttgggaggccaagggcgggtggatcgccttgaggtcaggagttcgagacc

SEQ ID NO: 586852 - DNA, 999 bp, Homo sapiens
gaaactcgcccaacaatcgagcgatcatgaagaacgctagctaagaacggcatacaatacagcgcgcccttcggagcaagcactggcgctgtgaaggaacacacacggctgggagacaaaaacaacggtgtgtgcaccaccgcacagggtgcctccaaagggcccagggtcgcctcgtacgaccagggagcagctgccctacacacaggggggcccgaccgccccccagagtggtgcgcgttcctccgaccaagcaacacccggggacacttgcatcgccagcgagcgtggcgtttcaataacggctccaaagaagcgacgccgcccggtgaaacattacagggagacactccctcaagtgggaaaacgagggagactcttcacacagcaggagacaccaaccagccaacggctccaggcgtctgaagaccgttccccctcgggccgggcttaacagcgttgagagcccgccgtccggatggggccccagtaaggccgcaagtgcggcacgccacgcccaggccgtgtgggaacaacaagaagccccctggcgatctgctcctgtgtcccaagacgcactcgacaagtgtgtcgcgcaggctctcacatcagacaccaaaaactgtgcgcagggcggaggaggcacccccccgccccccccggggccccaggaagcgcccgggtcgcccccacctgacaaccgcggcggccgccccccggctgcgacacgttcgtcgcacctccacgagaagagacgcgggcggagacaggcccccaacgtgcgtcgtccacaccatagcaagctgcgcgtgaggatcgacaaggtgggggaatctccccgcccgagaacaatagaaacatcatgcagaaaaaaagaatagcttcaccgaaaaaagtgagcaaggagagcagggtcgtcgggggcataagtgcaaagatccccgagacccggcagggaggagggcccaacacgcgcctctccccttaaacaaaaaacat

SEQ ID NO: 586853 - DNA, 697 bp, Homo sapiens
  misc_feature (333)..(333): n is a, c, g, or t
ggtggccgatctagacctagtggatccttttggctgcaggaattcggcacgaggttttttaaaaaatacatgaaatagagaaatgataatatctctagttagttagaaaaatatcatcttaataagaagctaaattgttatgccaactctccatcaaagccacttcttctaaaagtaacatgaatacttatttaataaaaagtatacctttagggtacattggtttttaatttacattatttgaaagctctacatggttctcaaggataactagtcagtgggtaaatctaaatgtttacttaaacagaatatgtagagtgactcaagtattgnactagtttgtcaacattttcttttcaggctgtgatgggatctgagtgtttatcactagtaatctaatttttcttcaaaatttaaatctgtatgttttagggtccccttctatactgctttattagagactagtcgtttgttggtaggctggttcaggttcttgactttgctgcacaaaagtacttgagaacaaagtcaaagttatagtagggaaagaaagttattgtgaagcaaaaggtctccgaatggcagaaccgccactcggaagagaccacccccagtccctcaagggaattccccttacgcgccctgcacatccaccttatcactcgtcacgccatctccaccggttacctgcgcttcc

SEQ ID NO: 586854 - DNA, 672 bp, Homo sapiens
  misc_feature (547)..(547): n is a, c, g, or t
agtatagttggtagtgtaaaggaagtagaactcatacctactgttgtaatggctatcagaaggaagacatttactatttattacggcgaattcaagatattgtctgattcccgaatgaataaagcatttgttagctggcaaagttgaagtgtcacagagaattaagacagcagacagagcaggtcattatagtaccaccatctttatcctatggctgatgatcttgttctcaagaccgtgtctgggtttatatagatgaggacgtttgtgaatgatgcaagttaatctcaagaaagttatacatgaccatgaaaataatctatctgccatatgcctgtgtaaagctggatagatgtctcgagagcatagttctctagatgacactgttgtgaagagcagttacaggaagctacccaggcattgagacaacttgaggacatcaggaataatgcaatattcagagatgagacaagtacttttctaacaggttgccgcaaaacgaatgagaatcccaagagtattttgagtcaaaagcgtctctgcaagnatgacagcaacgagcatttcaagcgtgccgtaaggtgatcgacggtttattgagaaagcattctgcaggtcggtaatgctggtggactacctattgtcaggaactcattcgtcacacttatgaac

SEQ ID NO: 586855 - DNA, 360 bp, Homo sapiens
gggcacgacccaaaccagctttgggagggttttttgtcctatttttgactttacttggggggtgcccatgttcattatattttcaaaggagaaaaaaacccttgtaaaaaaagcaaaaatgccaccagaaaaccatttttattccgagcattccagtaattttttggggtaggtatttagctgtactataagaagttggtttgtatgaaatggttaaaaaggccaaagataaaaggttttttttttttcctttttggtcaaaaaagttgctgtttattttttttggcctgtttaaggtatgtgtgaaacaatgttgtccaccaataaacaggaattttattttgttgagttgttttacca

SEQ ID NO: 586856 - DNA, 308 bp, Homo sapiens
taacaagacctatacttccaggatcatatctatagctcatttctaggaaaatttcccgacatgagtagagtgctgcaaataatggtttctacagatagtatatgcacagcctcatgttagcctcaacacaaaaaccatacagtggatacacaaaaaagtaaccagccagaagctaaatcatatcactagagaaaatcaccttcactaaaaggaagacaggcatgggggaactcacgacggcaggcagaccaaaaaataaccaggaaaacaacaacttgtacaggagtaagtccttacttatcaataat

SEQ ID NO: 586857 - DNA, 239 bp, Homo sapiens
agcgatgcgatgtgatctagaggatccgatccaggcgttgagctctctttctatcattttcttctctcagatgtctccgtgctacctttcctgcaatatcacctgtgtcactgcgtctaccagcatccgtacctgttcccccatcttcccaatgcccacgggacccacatccctgagtatcccaaagccctcacagactcaatatgctgccaactcagcctgttgttcttgccactcta

SEQ ID NO: 586858 - DNA, 244 bp, Homo sapiens
  misc_feature (28)..(28): n is a, c, g, or t
agcaggagatttttttaataataaacancaatggagaggtggaaatagagatggaaaaacaggatcaaaggagcaacatatccagtgacttaaaaaaataatcacacgtggcaagaagttttctaaagtaaactgtatgtggggagaagcatacagaaaaaaacgaaatacatacacccccaggtttgaaagaaaataattttgagttgtatcaatctatcgatatcaaagaatgaatgaccgc

SEQ ID NO: 586859 - DNA, 260 bp, Homo sapiens
ggtcggtccctagactggagcttaactcgggaggcggaggctgcagtgagcagagattgcatcactgcactccagcctgggtgacagagtgagactttgtctccaaaaaaaaaaaaaaaaaagtcgggcttgggggcagggtttattgaacttagaccctagtgatttttctgtaatttaaaataattcataatattttctcggggtctacttttggggattccaatggaaagcccaggacttggagactctggtcccaa

SEQ ID NO: 586860 - DNA, 537 bp, Homo sapiens
  misc_feature (509)..(509): n is a, c, g, or t
taacccatgtatattgcacttcattagttcctcaccactgggccaagatcatgctccaccaaccctctctgccccctcactttctttccttaagtgaaacccctaaaagccctctttgtgcccaaagcttacctgctcttccttccctatattcttggccagacacaaaaatctgatgctctggcaaatgtagaaatagggagaaggcagaggaatcatttctcctctcttaggtaagcactgaggttaatgtcattccactgtgtgaggaattaaaaaatgaggcatagagaggtgccgtgatttgcctggacacatgaagctgtcatggcagaagtggaacaaaggctcaggtgtcccgaatgacagaccagctcctatgccttcagaatgtgccatggagggagacacttgtggaccctactcatgctgagcactcaggggtacccaggtgctgagagtggggacataacaagctgagttgactcaatccagtcctcctacaccanataaggatggaaaccctcacataataga

SEQ ID NO: 586861 - DNA, 330 bp, Homo sapiens
  misc_feature (10)..(10): n is a, c, g, or t
  misc_feature (13)..(13): n is a, c, g, or t
  misc_feature (15)..(15): n is a, c, g, or t
  misc_feature (29)..(29): n is a, c, g, or t
  misc_feature (318)..(318): n is a, c, g, or t
gtaacttctnccncntgccatggcacagntaaactgatgtggcacactgatgggcgtgtcttatggaaagctgcttctgccccgccctgttttagctagtcctcagtttggtccggtgtctgagtcccgcttcctgagtcccacctcctgccttactttgctcctttgtaattaatagatcttgtttggtgatctttgaggctatgcaaaaatctgttttctcatacccctttcacctgacagttttggcatccattggcctttcttgccagaattaatgctattatggttgctaaatggagatttttttttaatccnaccattgcttct

SEQ ID NO: 586862 - DNA, 700 bp, Homo sapiens
ggcagtggcggcgcccggagcctttgattccatttcatcagtagtgtgggctctattaggatcccccaggaccccatcgactgatgccatggtgtgtgccctgtgatgccctggcaaccctgctgatggctgtggggcctgtgcctcggcatttggcagacttccatgtggctctgtgggccctgaagagatgaccttcctgagtgtggcgacctcatcgagatccttgagggctgcatggtgccacagacctgccctggtgcagtgggcctgagcactgcatgacctcgtgtgcctgtgtgtgtgtgtgttttggtgcgggatgcaagacctccagtcagccattgcatgtggcacacctgatgatcctgatgtctgcgaacatgtagccgcatttattactccacattgcagtgacatgacaaatggtcatttcttacacgactgatgggagcttggctattaccttgacgtgacgcggcatgcccagtgacactgctgcctcggagtgcagagcaatagtcatggggcgatcctgaaatggtccatggcaacgatggtggtaccaatgcccctggtggaccctccatgtcagccacgtgacacgctgtgagaacctggaggccatggcctgcgcacggtgcacacaactgacaaagtaacactcccacccattgaccttgcagcccctgtgaagaca

SEQ ID NO: 586863 - DNA, 496 bp, Homo sapiens
ctactttaagtgtaaaaaaatctgaacaggcagctttcccagaactggtctgcatctcaggggaagaggcacggttacgtgtaatggacgggcaccatattagtgtactcctctattttctgtggtataggatgcagtgacatatattggacgagagatgagaaatggccatgcttccttattaagtgcacttcacgtgaactgactgaaaacttatactcgtgtttgttactataaggacttgaaagttatcaccataatggactcttgtcttcaaaaaatgcttggaaatactccattttcacaaagttttcaggacgactctgtttagactatttttccctgccagggctgtgtaaaatgtattccccatatggctgaaaacaagaacaaaaacaaacactggagatactgctgctcaggcccatctgacatctgcttgtatagaccgcagaaatctggctgcccacggagaacgatattggcatgggtaccg

SEQ ID NO: 586864 - DNA, 107 bp, Homo sapiens
tgacttagaggatcccaagctccaacaagatcttggcaggacagtggtgcgtgcttgcagtccagctactcaggcagctgaggcaagaggatcgcttgccctaggag

SEQ ID NO: 586865 - DNA, 1111 bp, Homo sapiens
gtgttaatactcccgggtcgtttgttgtagacccttggattctccctgtgtctccctcctcaccgttgtttttgccccgctactgtatgaaccctcggggtccttcatctgctctcctctgtttttttcttcttgttcccccggtggcgggactatacagtttttgtcatcacgaggaactcctcgattgtcactccttttgtcccctcttttttgtgccctatctatggagacaaacttgttttttccatatgtcggtcctggtttcctcttttcccgcgatttttcccgggggtgtctctatcttttttggtttccccctcgggtggcccccttgttgcgagttgtttgttttctgtgctcacctgctctttctatctttttttgtcgctcattattgtggctttcctgtgacactatctgtgtgattgtctttggtcgtggcacttttgttccctctgtccccaaattttccctatagtgcctcccccccggtggtatctctgtggacctcttttagtaagattgagtgtctcctcggctttctttttttttttcttaaggcgacactcccccctcttttttgcggcggcttgtgtttgcccacttgtggtgtgtgtcgtagtagagtggccctatattaatatttgtgttataacttctcctggaccctaaaaaaaagatcgatttcttttataaagaataaccctcttcaatccccatgtgttttataacatgggcttttgcccatatgtctacttcccccacacactcttctcttcgtgtatgtattccccctccccctcaatattatcggggttccaccacaggtggtgtgaaattactccatgctcatctacttgtgctcacacctgagatttctcaccatacacacattgatctgtttttttgtcggcgtttctcctcacaacgggggttgcaccccccaggcgccgcggttaaaaaggagagaaattccaccaaaagggccaccagggtggggtcgtggggcctagaaaaaacaaaaggagggggttaaaccacccttcccccctgggggggtgggtttttttttttttcccccccaaaaaacaaggttacccccttttta

SEQ ID NO: 586866 - DNA, 958 bp, Homo sapiens
ccttggttcgacggggctcttctcccctgggtgtgctgtctcctccccggtgcgtgtcttccgcccgcggttgtgttgccgcggcacccccttttagcggtgcggtgttttcggagcgcattataccccggggcgttttctgggccggataaaccttcactccgggtgtctgtgtgcgccgctttcgtcggagtatgcgttactgcgggtcgttgtgactaaatcgggatcctccccgtagtcccccggtgtcgcacggggttattatctccctcgcagggcgagtctcctcccgcgcgtttataatgccgccgttgcgcgacgacgtgttctccgggagcagctgctggtgggagaccccggaagggtccttttctcgtcgcggtatctcctcgctgcaccaggatgttctttgcccacaaaacaattctctcgttgcgatgactactcccccctcacacttcattcttctcccctccgcgtggtatcgacacaattgaggcctccccctatccatttgctgctcgccccacaccctttttcattaagtttagatcttctcgcctaagttcgctctcctcactccactacgcagtggtctcatacatcataagaacctctcttcttcacacatctattattgttataaacatcaacaacacctttctccctcctcttatagctatcccccgacgccactctagtactgcttttcctctcgcaatatctgctcttgtcatcttggtatcacctcccacaaaatttataggtgtttctcaactatcaaagcaaatattttgttccccccactcctgccacaaaccgagcgctccctctcttgagcacccgacaagtggatcatatccccccactactttttctgaacaccctctgttctgggtaactatctgctgaatccctctcgggttagaaaaaaaggtgcccgcgcaacaaaaca

SEQ ID NO: 586867 - DNA, 633 bp, Homo sapiens
tcacaactctgtttcaagggtttattggaaacctcctgattataagggtcctggccttaaaatgaggatccaaggggggagaaaaaagagtgtggtgctttgctcgagtttgggaaaggtctcacgagggagagtttcccccatccctatacttgaggtttgcgggaggaaatgtgagaacccccacgtggtctaacaagaaagaggccacacgagctcctactagagggactcgtggcattgtgagtgacaactaggttattccagtcaccgtggggcgcatttcccattgtgtattttccacatgtggacaagaaccatctcgcggccaggcaaatttgggagaaactctcgccatatccccgtgaagccacagagttatattcctatagtgttccgtgaacacccatatgtgttgtgcctccgccaggggcacgtgtggttgtgttcaaagtaattaggagagttgtgtgtcgcccccaagacaaccaacagtgggcggtcgcagggtctcttgctctccccaacaaactcattatatacccacaagttctttccacttcgaagtgagcgaggggccacgtgcccaagtgtgcctcttcaagccccaaagttccctatggttcaaagggg

SEQ ID NO: 586868 - DNA, 205 bp, Homo sapiens
ctgactagagttcccaagcttttaccgcttccccaaactctttactgtgtttatttcaaactttattaaaagatattttctatatttctcttattatcagttctgttattaggttgtctgtcttatatagagtttgctttttctcaaatatttaacatgtctgttcattttattttagaatttatttctgttatgattgcggtaa

SEQ ID NO: 586869 - DNA, 1337 bp, Homo sapiens
tgggtgtgttagttttgtttttttttggtttagtgggctcaccgtctggctgtttgctcggatgttcgggttgttgggtgtgtgtgttgtcttctgtcttcttcgtctgtttgtgtttttgttttttgttttgttgttgttttgttttggtgtttgttggtgcttgctgtttgttgtctttcgtgttttttgtttgtttttcgctcttctctggtcctgctgtgtcttgtcgatctagcgtgttcttcctgtttcttgagtgcggctatgcgtttcatgtttctgtcggggtagtctctgttgttttgtcgtctcgggttgtgtcgggttgtgcgtcggggtagggtgtgtcggtgagctcgttctacttcgagttcgggttcgtgtgggttgtgttagtgtctggtcttggtcgttggcgtgtagtgtgttatgagaagaagaagagcggcgcgcggacggcgccggttattattaaaaagaccgcgccgcgccgtcttttgttttttttttgtcttccctcttttgttgctgtcggtggggggggacagtctcccccccccccttgtgtgttgtggctcccctctcatttgtgtattacccccggggggggggtgttggttactctccgtccggcgcgggggtggtttttattgactgtgggttcaccgcgtggggtgcgtgggggtgatatatacatttgttttttctcccactcgcgcggactcctctgtgtttgtcccccactctgtgctcgcgctctttttttgtgtgtggtcccgcccatttgtgtgcacctctgttgttgtcgctcactcacatcacgcgcgcggtgtgtgtgggccgctcgcgcgcgcggatttattcccgcgcgagatgatatttttgtcacacacaccgcgctcgcgctgtggcgtatataacacacaccctctctgtgtgctctacctctgttaaacaccacaatataacacacaccctctctctatatatataaagaaagaccacacctctcttatatgccccccggtgggggtgtttactcccctccgccctctctcttgtttttacccggtagcacgcccctctctcttcctggtgggttgctttcttttttgttttcctccccccgcgcgcgcgaaaaaaggcgcggggagagaacccacccccccgcggttaaaaaatttttttttaatactccccccataatatatatatttaacacacacccccggcgggtgggaagaaaaaaaacacccacccccctctttttttatagtatatatacacacccccccatctttttctcccccctttttctctcccccccccccaca

SEQ ID NO: 586870 - DNA, 1029 bp, Homo sapiens
  misc_feature (15)..(15): n is a, c, g, or t
  misc_feature (121)..(121): n is a, c, g, or t
  misc_feature (341)..(341): n is a, c, g, or t
  misc_feature (367)..(367): n is a, c, g, or t
  misc_feature (371)..(371): n is a, c, g, or t
  misc_feature (374)..(374): n is a, c, g, or t
  misc_feature (376)..(376): n is a, c, g, or t
  misc_feature (383)..(383): n is a, c, g, or t
  misc_feature (459)..(459): n is a, c, g, or t
  misc_feature (477)..(477): n is a, c, g, or t
  misc_feature (493)..(493): n is a, c, g, or t
  misc_feature (505)..(505): n is a, c, g, or t
  misc_feature (509)..(509): n is a, c, g, or t
  misc_feature (516)..(516): n is a, c, g, or t
  misc_feature (529)..(529): n is a, c, g, or t
  misc_feature (531)..(531): n is a, c, g, or t
  misc_feature (537)..(537): n is a, c, g, or t
  misc_feature (551)..(551): n is a, c, g, or t
  misc_feature (569)..(569): n is a, c, g, or t
  misc_feature (571)..(571): n is a, c, g, or t
  misc_feature (968)..(968): n is a, c, g, or t
  misc_feature (976)..(977): n is a, c, g, or t
  misc_feature (989)..(989): n is a, c, g, or t
ccaacctgcaggccnccattgctgatgctgagcagcgtggggagatgcccctcaaggatgccaagaacaagctggaagggctggaggatgccctgcagaaggccaagcaggacctggcccngctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagcaacacntatggcagtggtcttggcgttggagntggnttnanttttttnagtggcagagccattgggggtggcctcagccctgttggaggcggcagttccaccatcaagtacaccaccacctccncccccagcaggaagagcnaaaacactaaagagcntcagctagctcncggncccacantcctcaggccccncnctggcngcagagccctcccntcaggttgcctgtcctcncntggcctccagtctcccctgactgtcccagggtagacgctgggagatgaactgcttagctgccctcacttgcttctctctctctctagtaccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccagtgaaagcacaagtgactagtcctatgatgtacaaancctgtatnntctgtgatgatntctgtgctcttcactctttgaattgctaataaggagatta

SEQ ID NO: 586871 - DNA, 1505 bp, Homo sapiens
  misc_feature (1015)..(1015): n is a, c, g, or t
atcgtcatgtatatggaggacagtggtcccggagtaatgacaccccccctggcagacagcatgctagtcgctgtagctgacaacggataagatagtgcgaacgggcggagagtccgctagtcatccactctactgagggtagcgagtatcccttccaagagatcgtagtggtagtgaccgtctagtccgcgtgaagtacgatcgtggcagcaacagagtccgatcgtacgcctaccaatgaaaaaggctggtggctcgcaatatttgcaagagccgagtgaggaccaagaaaaaagtggttcaattctatgctctctgtccacctctacatgactgaatactccgctcaatggtatctgaacattagtggccgatggaaagcaattgatgaccgtgatgtatcagagcattccttcaatgtaggtctccgcacgtgatacgagccttcctctggtaaagcgggcacaaaacatgtaaatatagggcaacacgcacctggtgtctcaaagggttaaaattcgcaagtgagaacgcgcttcgtgtggggtttacctccgccgggggctatgggggcccctcgagtgcgagggcaacatgcgtaaccacttgccctctgaaaccaccctcgggcgcaaatcccctaaagcgaccaaacctgcggggggacttgcggccccccacagtactggacggaggacgaagaacttggactgagggggccttgtgatagggtctccaggcggaggggcccttgcgtcccccaggcgggaccatttccaatacattctatgttccacaaccattcaacttgggtgtgggtcgttggcttccaccccgcgagcaaaggaacgtgcgcgccacagatcggaaccgtattcaccgcggacgcacagcacctaccgatgatcagcgacgaaaaagaccatcaaatcggtaggcagggcattgtggtgtgatggctttgaaaccccttgaataggttatccatccctcagaggcaattggtctccccaanaatcacagctcaaggttccactgcgggcgcggagacttaaggtgcacatgcggatgatgcactacacttatgggccgtgaccttcatgttaacgataaaccacatatatgccgtgtggagcacccctcatgcagttctggtgcactttggacctctaaatcaccactacgacacaacagcggcatgcggagctgacgggcagacctagagcgggccgacaccagcaggcgtgagagatacacccgaccgcagacgcacacaagagagccacaaatcgaccaggcggggggccgacgccacccaccggaagggacagaccaaacagcggctgcgagaagtccggtcccgcgcaacgggctacaacccgagcgcgaaccacaccccgcacattccgtgcggagacccacaaaggagcgggcccacccaagcacagacgacacagagtgtgcgcccccatatcacaaacgaccccaccctatgcagctgccac

SEQ ID NO: 586872 - DNA, 374 bp, Homo sapiens
ctttcagagtgattaggtcatgaaggctcctccctcataaatgggattaatgccttataaaatagccttcaccggggttcagccttttttgcccttctgcctttcaccatgtaaggacacagcaacaaggcgccaccttgaaagtagagacggggccctcaccagacaccaaagctgctggagccttgatcttgaacttccagcctccagaactgggagaaataaatttctattatttatagattactcgttctcaagtattttgatgtaacagaaaactgactaagacagccatttattgaaacacacaaactcttctctgatgaatacaaaaaggcttgtggtcagggcaataaataattctcaaatggagg

SEQ ID NO: 586873 - DNA, 589 bp, Homo sapiens
  misc_feature (528)..(528): n is a, c, g, or t
  misc_feature (536)..(537): n is a, c, g, or t
  misc_feature (549)..(549): n is a, c, g, or t
tgagcatataagcatttaaagtagcgtctgccaggcttcacgcgtccaactagtcgcatcaggccacctactccttggccttgtcaagagccctactcctccaaggtttaccgtgtccctcctccatgagctctactcaggtctcccctgactgtcccagggtagacgctgggagatgaactgcttagctgccctcacttgcttctctctctctctagtaccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccagtgaaagcacaagtgactagtcctatgatgtacaaancctgtatnntctgtgatgatntctgtgctcttcactctttgaattgctaataaggagatta

SEQ ID NO: 586874 - DNA, 817 bp, Homo sapiens
tgatctatgactcggtcatgcttgaagcaccgaagtgctcctgcggtgacaagatagcaggcacccgtgagcactgctggcgcatcagagcatctggtcccggctgcaggagcgggggctccggagccagtgtgagtgtctccgaggccgtaaggcctcctcgtggaagaagctgcagggtctggtccaagcttcttgatgcgcgcacagtgcgtccgtctactggcagcaaggcacgctcagtcggcgctcaatactggacaatcggggaaagcttggcacgggctcctggcgatcagcgggatgttttgtcgactgcttgccctggtggtgtgggttgtgggttgcgaccatttggagcaccagtcgtagggatactgagctttcatttacctcccaagtgcagagctcgtctgtggggcacagtttgggcaagggtgtctagccttgaacgcattcggtcgctttcatagatcggttgggttatcctcggttggagggcttaaacacggaagatttgggttgtccggcttttggtcggctaggcttggggaaccccccaccagatggggggagcgaaatccgccaatttggcgcatggatattcaagtttttccaaaaaagcaattggcgcctaggtttggagtccgctctacgattggagatttccgttattcgaaaacttttcgagtgcttggtgggccaaaatccggccactgttggcgcgtgtgccaaggcattggccaaacaaataggcaatagagggccgaatggtgggcgtatgccaaagaattcccttcgagttgggttaagaacg

SEQ ID NO: 586875 - DNA, 377 bp, Homo sapiens
gactagtgggattaaatttttttgccaaacaagcagatccctttccagagaagagaaacaaatctgtatttaccctcattagaaattagtatcagctgggtgcgtgcggtggctcatgcctgtaatcccagtactttgggaggctgaggcgggcggatcacgaggtcaggagttcgagaccagcctggccaacatggtgaaaccccatctctactaaaaatacaaaaattagctgggcatggtggtgggtgcctgtagtcctagatacttgggaggctgaggcaggaggatcgcttaaacccaggagtcggaggttgcagtgaactgggatcgcaccactgcactccagcctgggcgacagagcaagactccgtccc

SEQ ID NO: 586876 - DNA, 344 bp, Homo sapiens
tttcccttccacttcctcccaacaccccaagcacgacgtataagaatcccgtgcgcttaggccgggcaccgtggctcacacctgtaatcctagtactttgggaggccgaggcgggcagatcctgaggtcaggagatcgagaccatcctggctaacacggcgaaaccccgtctctactaaacatacacacaattagccggacgtggtggcaggcacctgtagtcccagctactcgggaggctgaggcaggagaatggcatgggcccgggaggtggagcttgcagtgagccgagatcaagccactgcgctccagcctgggcggcagagcgaggcgccgtcacaaaa

SEQ ID NO: 586877 - DNA, 767 bp, Homo sapiens
  misc_feature (19)..(19): n is a, c, g, or t
  misc_feature (71)..(71): n is a, c, g, or t
  misc_feature (94)..(94): n is a, c, g, or t
  misc_feature (120)..(120): n is a, c, g, or t
  misc_feature (123)..(123): n is a, c, g, or t
  misc_feature (134)..(134): n is a, c, g, or t
  misc_feature (150)..(150): n is a, c, g, or t
  misc_feature (249)..(249): n is a, c, g, or t
  misc_feature (328)..(328): n is a, c, g, or t
  misc_feature (339)..(339): n is a, c, g, or t
  misc_feature (371)..(371): n is a, c, g, or t
  misc_feature (376)..(376): n is a, c, g, or t
  misc_feature (539)..(539): n is a, c, g, or t
  misc_feature (664)..(664): n is a, c, g, or t
  misc_feature (687)..(687): n is a, c, g, or t
  misc_feature (703)..(703): n is a, c, g, or t
  misc_feature (723)..(723): n is a, c, g, or t
ccctgttgtctttcttgtnttcacctacaaatggccatgactaccctcgagcaacctacaaacaaataatnaaaccggctcttcctaaacagcncctgcctggagccagtactaaaaagnctncaccctgtcanaaggttatcctgaatnatcccagcccctgggaccaaaaaaaaaagcccgcacagagaaactgcccctttccggggcttccaaggcaccagtaagtatgaaaggcccaaccttcangcatttttaacatggaaaggaataatgccaatgcaatgaagatgtaacaaaattctctataggtttgctaacccacgtnagtagcaagtnacatagtagaatgcccaatatagacttttcangtcangaggaaacggaagctggttgacaaggatctctttatcagacatagaaaaccactagtaactaatcgaaattctctttaaggaaaggctcttcagatgatctccaagtcacacccctttcttttattttcagatcatctgaatttttagtccacaaaatagatnattgattttactatgactgacttccactgttagccaactctttatatgtctagtgtctgttcctgtttaagcctatttcttactttaaaatgttaaattcaattaattttccatcaaaatttatnattacctgttcttttcttttttngagacagggttttccnctgtcacccaggctggagtncagttgtgcaacttgactcactgcaactctaccttacaggctca

SEQ ID NO: 586878 - DNA, 122 bp, Homo sapiens
  misc_feature (54)..(54): n is a, c, g, or t
aaaattgtgccattgcactccagcctgggtgacaagagggaaaccctgtctcanacaaataaataaataaaaataaataaattggtgataccttttgggtataaaggcatacaatataggga

SEQ ID NO: 586879 - DNA, 104 bp, Homo sapiens
aacccgaccccctttgcagaatggaggacgctctatccgtctcctccggggctggtcgccggttgtcttctcctctgggggctctggtcagacccgttcgggcg

SEQ ID NO: 586880 - DNA, 1015 bp, Homo sapiens
taaaacaagcaaattttattaaaggaaaattttggcagggttaaagggtttggcaggtagaaattttggtaggtagaaaaggtgttatatcttttacaccaagtctggttctgggcatgcttctaatagattgtcaagagtcacctgggatcaatgatagccagtgtgtggcccatctctctggtgaggtaatatttcccgactatggctgtgtgggcccatgttacaataatataattggccatctggtgagtgagatgggcacacccatgttttaaagcgccacaactataaggtataagtaaccttctatatttacaaagaatattctctccaaaaatgtctgtggcgcagagtgtgtggatagcgcagatagatattggaccacacaatttatcccggcgttgtggcgctttgggtcctgagagtacaatctctgtcccacagagcgtgctgtgtctatgtgtgagccccccaagagggaacttgtgatctttgccccacactttcttatctacatataaagccaagaacgtagtgttgagagcgccctagtaagatgcttgtgggtcttcacgcgcatctccacagcgtgaagcaacttgtcttgtgcgacgaggagtcgatcgtcagttatgcgacgagccgcgaccaacgctaaacgtctatctctctgttggccgcatattaaagagaagagccgtggtgagacaaccagggctcacgccacgccataacaagccccagaaggagaacggcccaagacaccgcagtagctataccaaggccacaaccatacttcttccgctgctgctactgtatgaggagatacgcgcgctattattattgatagccgctgtttctcctcataaaacacctactcagacttgtgcagggccactcccatcaagacaaacagaaatgttgtgggcgcccccgactccgcctttttatattaaagccgcccgctgattaaccacacaaagttgtagaggcgcccgccgattatccaaaa

SEQ ID NO: 586881 - DNA, 694 bp, Homo sapiens
  misc_feature (121)..(121): n is a, c, g, or t
cccgtttcgtggatcttcaatttaaatcaatccgcttatttatttcttttcggcccccaattaacaatttccttccaactagttttaatatctaaaatacccatctcctcccttcctcgtntaacatcacttcctctgccccacaaagaccttttgtccgcacctgttgcaatccactcatgtgtcacaatccaattccctctgtggtcatgtccccgtctcccagaaacgaatcgtcaaattgtgttagcggcgcacccattcattggcgcgctctagtaaataacaatggtcatatattctctctctactaatttgccccaacaccacttgctgataaagcgcacccacccgcactttttctctacaaccttgtttcgggcccccacctctcttctaaaaccagcttatcttcttctccaacttccctgtagataattcttgttctccccactccccactccatacaaataccttcatgggtatcagtatcaccttgtagacaaattgtttttccccacagtggagatcttgtttctttcagggattggcggggcgaacacgatgtctccccattttcacaattgattgggcaccggacttccttccgccaattgggacgaggtgcgccccccgtagtagagtcagacctagaaacacacaacttcagcccgacaatagtccagacaaacat

SEQ ID NO: 586882 - DNA, 280 bp, Homo sapiens
  misc_feature (21)..(21): n is a, c, g, or t
  misc_feature (35)..(35): n is a, c, g, or t
  misc_feature (92)..(92): n is a, c, g, or t
  misc_feature (152)..(153): n is a, c, g, or t
  misc_feature (217)..(217): n is a, c, g, or t
  misc_feature (249)..(249): n is a, c, g, or t
cctcagccttccttgtagctnggattacaggcgtntttcaccatgcccagctaatttttatatttatagtagagacgggctttcaccatgtnggctggggtggtcataaactcctgacctcaagtgatccgcctgccttagcccttctcccnncccgtgctgggattacaggtgtgagccatcgcacccggcctgtaacaagggacttcttatgagngtggggatgtgtggctggggagtttgcagggnttaaggaggaggatctgcttcaggactgtgg

SEQ ID NO: 586883 - DNA, 181 bp, Homo sapiens
  misc_feature (37)..(37): n is a, c, g, or t
ctagaggatccccgtaacgtggtgtaccgtccatcancatctttggccttcattataatcatagtttccttcctggtcttccactgtataatctaatcagaagaatagcctgtcagtctgttatatgcacctccagttacatcatcctccgcttcaaacttttccattcttacttagcctc

SEQ ID NO: 586884 - DNA, 857 bp, Homo sapiens
cgccaggctgagtgcagtggcgtgatctcagctcactgcaacctccacctcccgggttcacgccattctcctgcctcagcctcctgagtagctgggactacaggcacctgccacacgcctggtaactttttttatatttgagtagaaatggggtttcaccatgttagccaggatggtctcaatctcctgacctgtgtgatccgcctgccttggctcccaaagtgctgggattacaggcgtgagccaagtgcgcctggcaagaccattttagaatgtggaaatttagtgagaaaaaatgccctgtaaatatgctttagttttaatccagggtgggatgcactacctagcgaagaatgtgagaaaattatatattctcagagaaatatcgtgacatctattgtcatccatttgctatttttttcccaagagaattccataatttaaaataaaatcctagatccagttctgtgttttgtgaataaatattaatctatttaaaattttataaaatctgagcttctaggaatccagtgtgtcaacctttattagaatatataatataaatcacttataacggatgctaaagtagatcaccttttaacagatgctgaatgttggggatatgtttgtggcacgttaatggatgggaaccttatacttcaggttcagatatattgatctagatccaataaatggtaacttatggtgtccaaatcgtgaacacaaattatagcttattgattacttatgaggctggaatttaaaataaggggtgcacggggggaataatttttcggagaccgaggggggaccatttggagaagatgtgggccctcaatttaaacgtttgaagggag

SEQ ID NO: 586885 - DNA, 928 bp, Homo sapiens
ccgcggtggtcacgtgcgtggaattttctgtggtctgccgagtgactcagccccgcagtgctcgaaactgcgtggcgcatagtgtgtgcaggtgtacctgagggtgggtgcgtccctgcgccggaaatagtggggccgactgagtggtgccgcgaggcggggaggaaacagtggggtgctgctggttcctgtggctgacatcctgccccctgactgctgtgcctgtgtgagtgctgtggggctcgccccatgtgatgggcggtggcgtgggtgcacgtggcgtctccccatgtggtgtgttggtgtggctgtgttgctgccttgtgtggatgacgccctgccttccctgacgtgcctcgtcttcagcaacccagcacatgtgggcatgcaacccacagagaacttgcgtcgtagcgctggttcacctgcacgtcagaattcttgagcttgtggcgccccagatagtgtgccccgtctgaatggcccacaggattcgctctggaaaatcacccaacgtcctagtatgagatgcgtcaactgacactatttgagcaccttagccagcgggacgagttaggacactttcgagacagtgatccacgaaggtaccttgtgaacgaaaatctgccccgttagtagaactgaggcaccgcgggctgcttagttacacagattttcagcccgaattatacgacgtccaaaaaccgtcgttgtaggctaggttttcatatgcttgggtacccacatggtgggaattacaaccaccaggtagtcaatgaagttgggtacaccgattcgcaggtgagaccagatgacgccctggggataatacggacgtgcggacgtaaagtttagtgacacatcgctcgagcgtcagtaggattgtatagatgatgaaacaaggcaatacagtgcctagagtcgagcg

SEQ ID NO: 586886 - DNA, 728 bp, Homo sapiens
  misc_feature (37)..(37): n is a, c, g, or t
  misc_feature (57)..(57): n is a, c, g, or t
  misc_feature (60)..(60): n is a, c, g, or t
  misc_feature (138)..(138): n is a, c, g, or t
  misc_feature (214)..(214): n is a, c, g, or t
  misc_feature (216)..(216): n is a, c, g, or t
  misc_feature (358)..(358): n is a, c, g, or t
gacccccacatggaatccctcagccagctaagccgtngccgccacaaagcggcaaancgnccgctacgccactgtcacaccgcaaacacccccttttaccgttgtcggtatcgagtatcgcggcggtgaacgcttttngtccgtagcaccgcctggcagcacgcagttgaatcaaatttaccttatccgacctggtgacgctgtggcgggcacngnctggcgactcaacgcgctggacggaagatccgcacgctttgacgtggccggaacatctcaaaccgtaaccgtcgcgcaataggacctcctttatgcactcccctaccacttcctcgaaaacaatgaagcccaggaacatttngggtttcattgcaggcttggccaccttcgcgtttgcatacggctgtcatgcggcttcggggcaattaacgtcgatctcgaacactcagaacagtgaagttcacaactcttctcaaggagcaagtcagacagaactcgcccgcgagtggggattgaccccccaagaatggtcccgttttcaaactgtgatggagggtcctcgcggaatctattcgccaggcctggatcctctgacagcacttggcatcgaagcgaagtcggaggaggagcggcgacgctatgcagagctgccggtgcgagccgagcgacagcgtatcgataaggaactggcgtaccaaagggcctatgaccaagccttcgcacgtctttac

SEQ ID NO: 586887 - DNA, 392 bp, Homo sapiens
tcgctgatacagtagcatagaggtgttatacgtatctgatggtagttgtatcgtgggacagtggtgatatctccattatcattttttattgtgtctatttgattatttcttcttttcttctttattagtctcgctagcggtctgtgttgttgatcttttcaaaaaaccagctcctggattcattgatttttttgaagtgttttttgtgtctcttatctcctttagttctgctctgaacttattttttgacttctgctagcttttgagtttctttgctctggcttctctagtccttgttctttttttttttcttcttcttttttttttttttgggggaggctttggaactttttaacacggggggggacccccaaaatgtcgccctggcaggg

SEQ ID NO: 586888 - DNA, 815 bp, Homo sapiens
  misc_feature (3)..(3): n is a, c, g, or t
  misc_feature (35)..(35): n is a, c, g, or t
  misc_feature (57)..(57): n is a, c, g, or t
  misc_feature (118)..(118): n is a, c, g, or t
  misc_feature (148)..(148): n is a, c, g, or t
  misc_feature (150)..(150): n is a, c, g, or t
  misc_feature (155)..(155): n is a, c, g, or t
  misc_feature (198)..(198): n is a, c, g, or t
  misc_feature (221)..(221): n is a, c, g, or t
  misc_feature (261)..(261): n is a, c, g, or t
  misc_feature (280)..(280): n is a, c, g, or t
  misc_feature (300)..(300): n is a, c, g, or t
  misc_feature (345)..(345): n is a, c, g, or t
  misc_feature (375)..(375): n is a, c, g, or t
  misc_feature (393)..(393): n is a, c, g, or t
  misc_feature (411)..(411): n is a, c, g, or t
  misc_feature (413)..(413): n is a, c, g, or t
  misc_feature (445)..(445): n is a, c, g, or t
  misc_feature (464)..(464): n is a, c, g, or t
  misc_feature (470)..(470): n is a, c, g, or t
  misc_feature (472)..(472): n is a, c, g, or t
  misc_feature (474)..(474): n is a, c, g, or t
  misc_feature (525)..(525): n is a, c, g, or t
  misc_feature (551)..(551): n is a, c, g, or t
  misc_feature (639)..(639): n is a, c, g, or t
  misc_feature (644)..(644): n is a, c, g, or t
  misc_feature (748)..(748): n is a, c, g, or t
  misc_feature (800)..(800): n is a, c, g, or t
tanaagtttaaggaccttaaaggtccttacaaaancaacaaaaaaaaccgacaaaanaaaaacaaaaggggaaagaccttccagcaaaggaacacccccgtagtcaaacattacaaanaaaacagtagagaacaaaggaaaggggaantnaacanaaaagtttagtttaaaggcaaaaatgaaaaacaaccaaccaancaacctccccccccacccaaggnaagaaagggaaaaaagaaacaagaacccccagggcctttncaaaaaacagcctaaaaanaggaaggcgaagaccggggnggggggacaacccccgccaatggaatgccaaaaagcacaagggcnaggatttaaaaaaacccaaaaggggccacnaaaaacagggaaaaccgnattaatagaaaaaaaaangnaaagaaaaaaaaaggaaaagggattaaaaacngaccccgccaaaaaaaacnaaaatnangnatgtcacctcccccgtcataacagcctaaagatcgatctacagtttgcccntcgcctggcactcttaaaccactccnccaatggtcaatgttgaccttgaatcaacagccgctgaacccaggagaccccacagatgtgtagattcagcacctagagggccccccnacccnctgtgctgtgtgttcccatgactccagaaataattaatcgcaacttgcattattaagtccacaggcaagtttgaaatctaactagaaaaagtagcagcaaaggnaaaatacgcgggaatttgttagaaagcaacaagatttcttaaaatgcttccngttcaagtcagaatt

SEQ ID NO: 586889 - DNA, 118 bp, Homo sapiens
gctcgacactaaaaatacaaaaattagcttggtctgccattgcttggactcaggaggtggaggttgcagtgactgtgccactgactgaagcctgggtgacagagtgagactctatctc

SEQ ID NO: 586890 - DNA, 213 bp, Homo sapiens
gacccatctacagtatcccatgtgttgccggtgctcgctgggagatggcagtgggtggaggaggttggagatttggctgcagaggagcagctgagggctgagggtgctgatcccggacgctccaaacacgtcctgtaaacatagaacgagctcgaagggactacgtatatgaccggcctggaagagacctggagaggcgacgacaacaataca

SEQ ID NO: 586891 - DNA, 185 bp, Homo sapiens
  misc_feature (127)..(127): n is a, c, g, or t
tcaagtacatctgcctccccagttcaggatctcctgcctcagcctcccaagtatctgggcctgcaggcacgtgcaccacgcctggtaacttgttgtacttatagtagagaccgggtttcaccttgtnggccagggtggtgtagatctcctgactttgtgatccgcctgcttcggcctcccaaagt

SEQ ID NO: 586892 - DNA, 1589 bp, Homo sapiens
ataccaaagaaccccgatgaactaacttcagatatatgtatcgtgctgacggaaattcccagcttaaggtcgcacactttgcgtatcagtcatccgcatgagtgcgaatcgagccagaagcatgctgcttaacgtcagacaacatagttgcctatggctagcagcgctctagtaagcttcctgtcacagtagcttcattcgtcacgaagtataacccattgacaaactcacctaagggcacatgagaggcatggctagctgacctcaactcctcaatcgtccatggaattgatacaagctgcctcgaaaccggcaagttgaatatagtgtcagcgttcctccttagcgtgtatatacgtcgaagtatatcgctcctgtcatcacgcagtcgcacctaaagagcacgtccctaaaaagtgcgcatagtgataatgccctgcattcggcttgtgtcccatacgtaatagtccgtggatgtctcttacagaatgttgcgtactatgtgtcataatacgacctcgacaggtcatgcttcgagcccgctgacattcgaagcgagcctaaccccttgcctcgttggctaatcctcactcagggctaatggattggccagctctctttgccttggtcatgataatctgaaatcgctaccatggcttatggttgaagaaccgatagaccttcgtttacccctgttgcatggcaaccctgaacttagccgcggactcccatacccccgggtacaccccgcgaactgctcgtgccgtcgcagcaccagccctatcgcccggcactaacccaagacatagataacgcagacccacacggggcagccacgaaaattcaatcccgagtgtagttgaccacaccactcaacaccaagacacccaccacaccaaccacccccactcccaccacaccacgccccccacacctacaacaaacaccccgcctccccaccaccccgacacccacctatactcgcacacagtcatccataccacaactcccaccgacaaccacacaccatcgacgctacagctactattcccatcaccctcagcccacacatagattctgatgcactctcataccccacactcaaacgcaactagtcatatagacacacgctaatcgtcgccaccccatactcaaccacacagcatccttcaactctaacatcgtcacatctgatcgatagctcttcaattactatcctcttacaacatcgctatcaataacaacacaaccatcacacaacagcactctatcataaaatccccaccaatccaatctcacccatccccctacctctaatccactacctcgactaattaccaccaccataacaacccaccccacccacacaaccaaccaccccaaccacacaccaacatcacataaaaccacctacacaccacacacccacctaacccacttctcacaccacacacaaacaaaccaccactaccacccaccacaacaacaaccagaatcaacgctgagacacccaacgtacgcagaaatacctataagaaaacacaattctcagctaacttactaatcctacactacacgataccacatcc

SEQ ID NO: 586893 - DNA, 1199 bp, Homo sapiens
tgaatttccttgcttactgtgcatatacagactggatttttttttttgttttaacagccatgtcccccaaaggaatgtctggcatataactgacattgggtatgttgcattcatgggaatatttcttattttctacggtgtttggaaaagccgtggtaagaaaatacaggattgtgataatattgtgtgaaggctaggaaaaacccaaatgggtttcttcttgtgagaagtcagtgacataccgttcgtgggtggtggagaaaatgtgcgcatggggaaaattgtgacaagttgtgtggattctctcacgtgggtagtggtttaacaaacgtgcaataaagaggcaaatagaaattgtttttgtgtgaataagagggatcacagaaacaatttctaaaacctaacgtggtttgttaccagtgtgacaattataacactgtggtgcacataactgaggctctcccacaacagtgcgtctctagaaagtgccacacgtgcatataggcttcttctctctgtgaacacgtgcgtccagcgtctctcctgtgcgacagctaggatttttctcaagtggtctatcacagtctgtgcgtatcttggctaccacacacaccaccgagacgagacgcgcgcaagagagagagattttcccgccaaaaagagccccgaagaaataccaacaccccccagagaaggcacaaaagcgtggtgacgggtgccgcgtcgtcgtaactactccagtcgacgtgcggagctctccccaagagtcgctggggcccaaaggggggtctataacaaagagacagacacactccttagaaacacacggggggtccgcacaacctacgaggcggtctcgcagcaacgcataaccgtgcgggggggcacacgtccactgacgaaaaaagtcgcggcactctctagcccacaccatcccacctctgcggggcgcaatagtggcccccatccggggcggaccacgcgcccatcacgtgcggcgggccacaggcgccgcgtatagcctcccggaacaaaccagccgagcagcgcccccctacaagaacagccgggggggcaaacgggccccctctgtcgaccagcgacacccgaaggagtggccgccccacagaactagaagacgggggctccccttcgcgggcacgcccgtaaagacaggcaggcatcaccacgaccagcag

SEQ ID NO: 586894 - DNA, 1051 bp, Homo sapiens
  misc_feature (329)..(329): n is a, c, g, or t
  misc_feature (397)..(397): n is a, c, g, or t
gccaaaatgtatacctagtgctcttctaatctcgagaacgtgtgatgatacgcatgacaatgtcgatcttatctcttcgatgagactgcgatggattatcagtcgcaacgtgcttccatcaaagaatgttggagcagagtactgtcgtaacctctggtgatccaggtgggtgcttcattgagacaaaagaaaaggaaggcatccagaggatatgaagaaaggcgcttagatcacgccaataggtatatcttgggtacactgtcccgatactatcccgaaatcatgtgcgaggacatgatgtagtcccaagcgctcgtgtgactgtagcnagttcccggttgctagtgatcgcaaggacattgcttggtagtcgtctagactatggcactctcgatgnggttcgctctattcgatgcaggacttgcgggtcaagtgttttgctaggtagagatcgcaggcaagtcttgccgtcggagatggcataactagagttaccagtgcacctgcccaagaggaatctcggtgcattcgcatgagtctaggggtcgatggtggcctctcgatctacgaggctcactcgtaccatacgtctcctaggaagagatccattgggatactgtgaggatgcggttgttggagagcggtagaaatggacagaatgtaggtctttgggttttcctccaatgaccaacgtcgtgcttccaggcattgcaaaggcagaagtccacgatatgacgtttgtaaaaacaaacatagcgtacttattgaggtgacaactcttctccggcgagtgagtatgcgtgactgctacgtaccgtggaaacagataggggagacctgattgccaaggcacaggacatgaagttgaaagtaagagcacatcttggagagattgaccgttggttcgtaccaggagagagacacggagttggcagaattgaaacaagtatataaaacccttaacttttgttgggattaattttagaacatggaattgcgggtataaggagaaacctaagtttgagttttggaacacataaatgttgctgaa

SEQ ID NO: 586895 - DNA, 145 bp, Homo sapiens
gaccgtctctcccttacgtctacttagtgatacaagactccactcccaccgtgctgctccctggtgtcatgtgtcttactccactttttttttttatttatgggaaaaaagttttggccacaatggcccagtgtgggagtgcagg

SEQ ID NO: 586896 - DNA, 154 bp, Homo sapiens
ctggtgacagagtgagattccctctcaaagaaaacagaaactgcgaacccagtacagtggctcacttctgtaatctaagcactctgggaggctgagggaggaggatcaccagagaccaggagttcaagaaccagcatggacagcatagcaaaac

SEQ ID NO: 586897 - DNA, 935 bp, Homo sapiens
  misc_feature (3)..(3): n is a, c, g, or t
  misc_feature (72)..(72): n is a, c, g, or t
  misc_feature (75)..(75): n is a, c, g, or t
  misc_feature (104)..(104): n is a, c, g, or t
  misc_feature (115)..(115): n is a, c, g, or t
  misc_feature (132)..(132): n is a, c, g, or t
  misc_feature (346)..(346): n is a, c, g, or t
  misc_feature (403)..(403): n is a, c, g, or t
  misc_feature (411)..(411): n is a, c, g, or t
  misc_feature (425)..(425): n is a, c, g, or t
  misc_feature (523)..(523): n is a, c, g, or t
  misc_feature (555)..(556): n is a, c, g, or t
  misc_feature (567)..(567): n is a, c, g, or t
  misc_feature (618)..(618): n is a, c, g, or t
  misc_feature (649)..(649): n is a, c, g, or t
  misc_feature (687)..(687): n is a, c, g, or t
  misc_feature (689)..(689): n is a, c, g, or t
  misc_feature (694)..(694): n is a, c, g, or t
  misc_feature (697)..(697): n is a, c, g, or t
  misc_feature (700)..(700): n is a, c, g, or t
  misc_feature (777)..(777): n is a, c, g, or t
  misc_feature (798)..(798): n is a, c, g, or t
  misc_feature (809)..(809): n is a, c, g, or t
  misc_feature (830)..(830): n is a, c, g, or t
  misc_feature (849)..(849): n is a, c, g, or t
  misc_feature (858)..(858): n is a, c, g, or t
  misc_feature (928)..(928): n is a, c, g, or t
ctntatttccctcacaataccctccgacgcccgaaaatataccccccgcccccttacatcccaccccattancancctgtaagtcaactgtttaaatggatgtnattcttaaaanataatgtaacacatganctcataaagcagtagcagatacatcaatatcttccccaccccagactgacaaatactccactacagcacagacagccaaagcaacagcaacacaaagtttcaccgcacaaaggaaaaccagaaaagaatcctcccttccccattacactctactaggtcaccccttttccataaggtttgtcatgcaattacaattaacaattgatcataagantaaaatgatgtttgtcttactttctccatctagaactaagatctagaagtgttaaanctcttgtnattttctccaagangacattcttaaagccagaccaagttcccttttgcaatagtaatccaaaccaaaaagctctgagcatcaggcaactcaagcagcagaacgttaaaccangtccaacttgactactgatcacaaaaaatttnnatgatattgcnttcttgatcaaaaactaatacagaggttgctctaaggtggtgagtaaaaanacgcagaggctttcaaacaggatggttttcntcctttgtctttaaacgatctttctacagtagtggganangcagnagnagncacgccgggaaggagaaaaaagtttagaatataaagaaattttttttgggttgagtttttggagggttgaggggagntaggataggtttattaaatanattttttaganttttttgtgtaagtgtagaanattttatatatttgatagnttttaggtnaagggggagatttttagaagtgtttggagtgataggtttttgtttgtttttgggaagttttttaatagtngaggggt

SEQ ID NO: 586898 - DNA, 316 bp, Homo sapiens
ttcaggttttctcttcagtggggttgcttccttggctgtgttttgtggcgaaacccctgtggtgggaataaaaaaatttttggggcccatccttgaagggttaatcagaacctttttaactgccggtgttgccgggactgttaacaaaaaaaaaagccccccccaaacccagctattaatttccccgaattttgaacatatgataaaaaggataccccaaaactgaatgttattttaatacccatttccatagcatgaagggccactatatcataaaaaaaacatagggtcttttactgccatgaggttttactga

SEQ ID NO: 586899 - DNA, 286 bp, Homo sapiens
ccacccaccccagtcacaagatagtacgacaagtgattccacttaaatgaggtacctggagttgtcaaattcgcagggacagaaagtaaaatagtggttgccagggactgggggaagggagaaattgagagttagtgttcagtgggtacctattccagtttttcaagatgaaaatagttctgcagatagatgatgttgatgtttgcacaacagggtgaatgtacttgaggccactgaactgtacacttaaaaatggttaatctgcagggggtgggtggagagcggc

SEQ ID NO: 586900 - DNA, 371 bp, Homo sapiens
ccgtttcctgtgttcgaattaaaccaattcaaacaagaactatttaaaaaaatggcccaggcacggtggctcacacctgtaatcccagcactttggaaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggctacagtgatccaagatcgcaccactgcactccagcctggaagaccaaacgagactctgtatcaaaaaataataataattaataaagttttactggaaaaaagaaaaa

SEQ ID NO: 586901 - DNA, 865 bp, Homo sapiens
ctgaagactagctctgcagcagctggtgctttgggctgtgcgctgtccctgggccagcttccctcgaccttggggaggccagtggcctgtggaggaggcccaggtactggctgggggctgttgactggctatcctctttgcttctgcaagtttctggctcactcagaatgggcaggacagacccacgtgactggactttcagagtctggaggttttccatcggtcaggggaatggcggactacgtgaacttcttgttggcgtggcccttggtctaatagaccccagagggagcacactctgtcccctgagcgtcgggtgcgtcccgggggagaggtggacagacacctcgcctccaatcgtgacatttggtaacaggagcctggacttctgtgcaagagagggagacctaagggtgaacagtggccaataagaagccctagtagaaacaaagcatccatttcctaggatggttacgaagtcataacttcctgcaaatcagcgccaggagagcgacgttataccttcactttcttgtgtcttaagaaagtagcatgccaacgtggcccacaacaaactcctgtcgtggtaagttattctgccaaccagctaacaggacggagtggaagtgagttggaataaacgggaccggagctgggcttctcgtttctccctacggaggggagagtctcagcacttggtccggagctgaggaagtggtgtctgtgtaaaccgtttttcccagccaattctatcttcgccctcctgaagcaagcaagagcgttgaggcttttctgcttggaaagacctccaaactggagtaacccttgttaaaatgtgttttaaaaaagtgtttttttgaacctg

SEQ ID NO: 586902 - DNA, 136 bp, Homo sapiens
ggatccttcacgctcatgtcacaaggacgtggttgtcgatttggtgtgttacctggctgcaacgtgccacaacgatgatggatgagcccatgttcacagcagccgaatcatgtacaagcagatcctgcaagacaga

SEQ ID NO: 586903 - DNA, 159 bp, Homo sapiens
atttacactgcctgtctgctggtccctgctggacagttgagcttgttatccctgcactaaccccattattgtgtcatgtaaggttgatggttaccagtctcctgtgttgctcagctaacacaggggtgtcccatcttttggcttccctgggccacactg

SEQ ID NO: 586904 - DNA, 209 bp, Homo sapiens
  misc_feature (16)..(16): n is a, c, g, or t
cgcatagggtttatcngtgtgaccaccatatatttacagtaggaatagacgttgacacacgagcatatttcacctccgtctaccataatcatcgctatccccacgagccatgagccacgcaacgagccacgctaagggccacgcaaagtgccccccaatgcgccactcaacgagccccgcaaggagccacaccaagagccacaccaaga

SEQ ID NO: 586905 - DNA, 255 bp, Homo sapiens
tcgtcgtgtacttgaagaaccctggcgcattacatcaggcttttcatgtatgcatgatgactcaatgttatagcatttaaatggcaaccaggggacttatcatagcccgagaaaccacacataatcttttgttgagatcagtttgctgtactgacgctgcactttgtaaacagattaggatgttctttacttgtgggtgtgattttttaaaatagttctatatatctaatataaattaggtttaacttttcaaaa

SEQ ID NO: 586906 - DNA, 134 bp, Homo sapiens
ctgctacgcgacattcaggatccacagaaagataaagagttctatcttgtacttgtccttcattaatattatctggtaaaaagacttcttccattcggaaattctctgccactggcattaccatatttttccag

SEQ ID NO: 586907 - DNA, 121 bp, Homo sapiens
tgtgaggtgatctcagaggatccgaaggattgcttagttggatcttctcattttttaggtttatgcacaaataccaccgtcctgggaaggaacttccctgaccatgatgtctaatagtgga

SEQ ID NO: 586908 - DNA, 514 bp, Homo sapiens
  misc_feature (330)..(330): n is a, c, g, or t
acgcggagtcacatggaatgcgcgagtgtgagacctgtgctgagtatcccaagccctctgctgtgtacacgaatgtccccttgctatatgaaagcaacccttcgatcacatatgagaattctttatttctttttatataaggattttacaggggaaattaacaggcaccaacatggtggggtctttggtggggagagggggagacttttggaaatcaagtgagaatccactaaagaaattaaatttggactggtgaaacatatggtttaaggacacaatggactcggtgcctctttctgtactctgaatatgcacgggtattgcggtggngaatggggagttggcggccctcacttgggccttctctgtgggtcttttccgagacacaacccaagggcccttgtgatgctgtgcaaccctggcccaatatttcccctgtgccttttccccgtgtgcacaaggtctgggctcggatacccacacccgggttctcttgtaccacgattgggggccc

SEQ ID NO: 586909 - DNA, 175 bp, Homo sapiens
atcttcaggtaaataacttctcagtgtccatctctgctgtctactactcttcaatgtttattcaggcccactaccttctctacacttcaattctgaaggatttgcccccacccaggactgccaatttagcttatactcaacatgccccgagtcacaaaaactaaaatacctctta

SEQ ID NO: 586910 - DNA, 366 bp, Homo sapiens
  misc_feature (4)..(4): n is a, c, g, or t
  misc_feature (9)..(11): n is a, c, g, or t
  misc_feature (17)..(17): n is a, c, g, or t
  misc_feature (24)..(24): n is a, c, g, or t
  misc_feature (31)..(31): n is a, c, g, or t
  misc_feature (93)..(93): n is a, c, g, or t
  misc_feature (111)..(111): n is a, c, g, or t
  misc_feature (118)..(118): n is a, c, g, or t
  misc_feature (133)..(133): n is a, c, g, or t
  misc_feature (144)..(144): n is a, c, g, or t
  misc_feature (149)..(149): n is a, c, g, or t
  misc_feature (207)..(207): n is a, c, g, or t
  misc_feature (209)..(209): n is a, c, g, or t
  misc_feature (215)..(215): n is a, c, g, or t
  misc_feature (233)..(233): n is a, c, g, or t
  misc_feature (236)..(236): n is a, c, g, or t
  misc_feature (241)..(241): n is a, c, g, or t
  misc_feature (267)..(267): n is a, c, g, or t
  misc_feature (270)..(270): n is a, c, g, or t
  misc_feature (280)..(280): n is a, c, g, or t
  misc_feature (292)..(292): n is a, c, g, or t
  misc_feature (295)..(295): n is a, c, g, or t
  misc_feature (297)..(297): n is a, c, g, or t
  misc_feature (355)..(355): n is a, c, g, or t
gaanggggnnngctggngttaaanagcttanctcataatatctgtggaagcgatttgcgcgctgaggaagtaccctttgggacttgtagctcnactccggggaaagggctnggcgggnctgaaagttgctggnagtgagggtgnggggnatggccgccgctgcgaccatggcggctgcggcccgggaactggtgttgcgggctgggngntcaganatggaggaggaagagggntcnttggngggtggtcctgggctccaggaaccantgnaacttggggngttggatatganttntnatgaattcatcctggatgaagtggatgttcacattcaggcaaatctggaggatgagtnagtaaaggaag

SEQ ID NO: 586911 - DNA, 279 bp, Homo sapiens
acgacttcacgaggctgaggcatgaggattgctttatgccaagagtcatagccaacctgggcacatagtgagttccctctcttacataaaaaagagttccctttgctttgttcctattcttccctctccacagaagtacttttgttccacttgtggctgctttagcttgccgctgcagttcattggctgcactacaattttatgcattgtttccagctttacccctatccctattaagctagtacatctctttatgtatcctaactgttaaattttttt

SEQ ID NO: 586912 - DNA, 206 bp, Homo sapiens
gagaattgagaccaaacctgtgataacctgtctcaaaaccctcctcatcatctacttccttcgccttcttgatcacttggggtgatcctgcctgctgttgagttttgggcaaacttacttttgggcaccattatttccttattgccgagactccacaaagttcctcattgtctcatcggaactggcaccttattgttgtctttggc

SEQ ID NO: 586913 - DNA, 429 bp, Homo sapiens
tcagcaaaagctcgagagacagcgccagcatggacattaggggacagcacttcagttacgcacataaccgatgtacaggctagcaagagaggccagccacgtaggatatatatctggactctcttgtattataggattttgctggtgctgaatatcctatgacattcacagctgtcaaaaacaaacactggtcatttcagatctgttttctgaaatcttttaagctcaaacatcacatgcaagcatggacttggcagctactaatttggacaccttttagatctgtataaacgtgtgtggtgttgcacgccaagcacaccaatgcagtgctgcattttggatattcagttttatctttgttcaacaccatcatgggggcattcatttataccgtctaatatatgacaactgtagtcgtattgtataaag

SEQ ID NO: 586914 - DNA, 96 bp, Homo sapiens
aaaaagggggggcccccaaaggaaaccccttttcttttttggggggggggccttgggggggcccctttaagaaaaaggccccttttttttgggcca

SEQ ID NO: 586915 - DNA, 145 bp, Homo sapiens
caagacgtaggacctcactagcaggtgtctcctctatcttaggggccatcaattacatcacaacaattatcaatattaaagcccctgccataacccaagtacctaaacgctccgtcttcgtctgatccgtcactagttacgagca

SEQ ID NO: 586916 - DNA, 1538 bp, Homo sapiens
gtggttgtttttccacggagtgttctcccgatgtgttgtgtgaggaagactgctggctgtgggagggggcaccccgcatattggtggggggggaagaaagagaggggtggtggtttggtaggggagtgtgtcttctgccggacggttgtgtctgtttcccccctccttgctgggggggtggtggtgttctgtctgctgcccggcgggggccgccgccaagagtgtggtgctcggcaggacgggatgcgcagcgttctgtgtgtgcttggtaggtgggcggcggtggtatggatgctggcccggcgtcgttcttttctgtagtggtgtggagccccctcttataggagagggggggagttgtagattgtaacagctgtggggcaggcgccaccaccagggacgaggttggcatacgagcacatcgtttgagatttatgccccctgcctagtgatgtatgaggaagagcacatgctgggttatatgcactcgcccccgtaagtatggtgttgcgtccgccgcccccgccggcggcggggcgggttcaaaattataggtaggtggaataagacaaggtggtgggtaggagccccccgcgctggtgttggtatagaacaatcttctagtagaagatatgttctcgtggtgcaccggcggggcgcgcacgcggccggtgggtgttttcatctcgcactcgtcgttgtgttgattattctgccgcgcgcccccctctcttgtggtgggagagatgttttgtgagccgcgcgggctgtgggtgatgcctctcgcgacgacgaggtgctgctcgcggcgaggtggggtcgctcgcatagtcgctcccgccgctcgtcgcggcgcccacgagagatggtgtggtagatatattcacccgtctctgtggtgtgtctgtgtttaagatatatcgcagctcaaatggtatctctcccgcgcgggcgtgtgagtgtggcgcgcggcgcgcgcgcttggatgaatctcctctccgcgctctctctgtgtggaggagcggttagagcgcgcgcgagagagagatgttgttgtgtgaacaccacgcgggggcgcgagagggtgtcaccactgggcgcgcacacagatgttggcgcaccctctctgccactctccacccctgctgggggtggcacacagcagggcgagagatatctcctctgttctcacaatataataaaacacacacacacacacacccctcaaaactttatatttttttgtgttgtggtttgtggcgcccttgtgtccgcggtgttctttttgtggcggagatatattgtgtggcgcatcttgttttgttctccccttgtgtggtgagatttcgccctttatatatattgtgtggttagtgggttctcaccctttgttaaaaaagtctccacacacatattttattttttctctggtgtgaaagagatttttttttgttattttttctctctttttaacacaccacacagacacccctctcccccatttgggcccttgtgaaaaaaaatttttttttccttta

SEQ ID NO: 586917 - DNA, 244 bp, Homo sapiens
cacaacaccgtccttcccgttgcaacttttttaaagtatttttagggggaaaatttcagaactaagttgggtaatatagggggtatatatttgtgaaaaataatttttacttttatttttccgagggtttgacccgataaccctcctttgatggaagagggaataaataattcccctatatgtgtttgaggttgtgaccgacttataaaatctttttaaaaaataaagctctaattttttttta

SEQ ID NO: 586918 - DNA, 285 bp, Homo sapiens
tttttcttctgagattgccattctctaggcctcttcgttgttcaccctttccacgctcatgcactgcttctggctgacagcacaagagagactcctagtttagaggactggtaagccagctcctcaccacttccactcgaggctcctgtcacccacaccaccagtatcagtcagctcccattctgggcgttgtccctgtctcactcggcccatactagcgtcgggtcgccgtcagccctcaggaagcgcatcagctgcaccaagagcgggagcagcgcgcacagc

SEQ ID NO: 586919 - DNA, 213 bp, Homo sapiens
gcccctgatccgagaggcggcaacaaagctagtgccagcagcagcagctcatggaacggaatgacaccccctgtgaaccaccattggacctatcttggcttctcagctggcactgcgctacacggatttaggcagcccacaactggccatgcactctatccggaagatggactgcaccacaggagtcctccagaccctcaccctcttcaaggg

SEQ ID NO: 586920 - DNA, 726 bp, Homo sapiens
cgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacaggtgcagagagggatctctagtttttggtgggttctttttagtagcggttcaaaaactgcgcctcctgtgtacttattccctgtagacttttcaaggagagacagggccacaggatgatgaagaaatgtatggccagttcactttggcgcagtctcaatggcggaaaaaaacaaacaaaaaaaatgtgctttggatacacggcccattcacgtggactcattattataggtgggaggggttggagcatgttgagatttttcaaaagtggaccggttgccggtccttaccttctgttaagaaaaacccttatgtgtcttttaatccactcttttgtaatagatgaccttttgcaggtatattccccttgctgtagtatctggtgtacttatgttcaaatcaggcatcaactttgggggtgatttttaaaaatcttttcgctatctatctttttaaccctagccttctataaaagctcatacagccagttacataaatgttggctgtcacgggcattgtacttttatctgatattgtttcctctaaattcagtttccagtgatgtttaccatcttgtgacc

SEQ ID NO: 586921 - DNA, 366 bp, Homo sapiens
  misc_feature (19)..(19): n is a, c, g, or t
  misc_feature (89)..(89): n is a, c, g, or t
  misc_feature (99)..(99): n is a, c, g, or t
  misc_feature (129)..(129): n is a, c, g, or t
  misc_feature (137)..(137): n is a, c, g, or t
  misc_feature (251)..(251): n is a, c, g, or t
  misc_feature (365)..(365): n is a, c, g, or t
gttacccttgtcgtccttnaatggtaatgggcgggtcctcctttgatccgctccaatggcaacgggaaagtccaagcggaacttgcggnaagaatcgtnaaatagagctgatttctgagccctggaccncctgaagnaactttgtattggacccaggagccgggagaaggctgcagtgtactcgctgggggagacacagtccttgatgtagccttctccagggcttgcattgtcttcaccaccgcaaacantctgccatgttgtcgtacttctccctctcccgggtgttcttgtacaacttcacttcctcatacagttccggcttgttcccagggctcctattcccggcgtggctgggatcccant

SEQ ID NO: 586922 - DNA, 172 bp, Homo sapiens
ggttccgtgtacactagtcagaggccaaaagcagcactgtctaaataaatactaacaaaacttggtttttcgatactgtcttaaatgtaaatttcatatccttaaatgaattctagtcatatgctactttacagtatttatgacgggtaacaccaacagtacggggtaaccg

SEQ ID NO: 586923 - DNA, 367 bp, Homo sapiens
attatacaaatacacaaaattcacagtggtgctagactgtactaaccactattgggaaacatcccgtaaacctagcctgtagccatgccaatggaagtgactgaactggtagacatctgtttgcgcatgctttgtgtggctggtagcaatcgcccaccgttgtgcatacactattgaacatcaggggtgcaagggagggtttcctaaacattattgggggagggtaaaatttgggattttttatgtgtgtcccttaatttgatagggggtgctgggggtcatagtcctcaagtcttatgaccctaacaatcaacatgtatacaaaacccctggaagtattgtgtagggtgtgtactgtgtagagtgt

SEQ ID NO: 586924 - DNA, 123 bp, Homo sapiens
aagattcctcccaacaatgactaatcaaactaacctcaaaacaatgataaccatacacaacactaaattgacgaacctgatctcttatactagtatccttaatcatttttatttgccatgtgt

SEQ ID NO: 586925 - DNA, 181 bp, Homo sapiens
cccttctagactataaaaagcgtatcattcaggccttccagggttctttgtgcttggatttcataagtccaggccacgctgtgtggatttgtcaccatcaagtctagttctcctaacatggctgcttcaaagggtcgcttgagaatgccatttccccattacctctccaataaaggctcct

SEQ ID NO: 586926 - DNA, 487 bp, Homo sapiens
ttacaatcatcacaccactatccctgttaccctccaaaaacaacagttaaatcttgggaaatggacaggaactcccaggcagacacataggagtgagatggagcataaggggcatttttctgctctggcctccatcgctgtatggtgtgggttctcttctcctgcccagagtttgcagcactgcctctgccccctatataaccctgcgttcctcaattttagggttccacgcttttctgtgtgactcccccaaaaacaagggagtgtttagagttgtgtatatccccattaaggcctcaggcttgaacctataccctttcccggggcattgaccaggaatggagttacccattgttttaatttagacccctcccaaagttcaagatcagcgttattttgtgccatgagtgtggtggggagattttcccctaggacaaagagactttccctcccatttttgccattgtgctagttaaaaaagaaaaaa

SEQ ID NO: 586927 - DNA, 362 bp, Homo sapiens
tcgcgaacgtgttacctagcttactttctccatgtgcagatgatagctagggaaagagtaacccaaaaactttctgtatagtctgtcccttcggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacacgttcgcgag

SEQ ID NO: 586928 - DNA, 322 bp, Homo sapiens
ttgggcctccatgtagggagaatcgcaagatagtccattttttgtggatggtcccaacatcagcaaatatataaccaaatatatccatcacaagtaggaatacagggaaacataaatggccagccactaaccattcaggttaacccagtagtcccaataatagcttggtcacacaaaaacatgattatgtgggcggggcacaggggctccggtaatcttagcatggggggagcccagggcaggaggatgactggaggccaggagtacaagaccgggcggggtaaggtagcaagacccggaagggagcccatagggtaccgag

SEQ ID NO: 586929 - DNA, 134 bp, Homo sapiens
gatgactagagttaccctggctgtacatagtctagatcagtaacaggtctatggtcgatggaccttgcaactcaagtaaggagacaggccatgccattcaagtgcatgcagctcactgatttcatcctcaagtt

SEQ ID NO: 586930 - DNA, 566 bp, Homo sapiens
atgccaatccaagggtcccaaatcatcccgcacatccaacaaggggcgcttatattccgatcatataatttctcccgtgccctagccggatccgcctctaccgaagttacgaagagttaatacgggagcccgtctcttgtacgttagccgtagccgtcgacgggacctaataatcttattctcgtgatcgctcagaggaggtgtttgttatggtaaggatgagttttttggggggaaggttaaggtcgtatctttatgaggtatatatatataggatcctcgactatggaatactgttcgatcctatagcccttgttttaaggtactcttcgttgctattactctattttatagcttcctaaagggccacttgctttaatataatatcgccttagactatacgcgtgaagcgccgattttagcttggcctggcgaacgatttttgtctctgactttttcggaccgaatgttagacgatttcttaaccggtaacctagagggccgcctatccctatcggaaaatagttttgttaattttggataaaaggatggtcccgtatgcttgt

SEQ ID NO: 586931 - DNA, 244 bp, Homo sapiens
ggcaatacgtcctacccgtgatgacttccacttgtaccaacaaacacttccgcgctgttgccttggtgtaggcggctgcgactcagccagggactctttctcaggggtggcctcctgggactgaggactcagtaccctagactcggcagctgtatttttcccgtgttggcatctgaacgtgacctcgtattacattttggaggggctcaaatactcgctcgcctcatgttcctggccaagatac

SEQ ID NO: 586932 - DNA, 149 bp, Homo sapiens
gattctttgtcaccagtggttgcgttgccgtcttgccatcctcttacctcaagctttgtgtgtcataggcatattcactgagtggtttggaagtatctcactcggactttttactatattccaccacttactacccacatctctggggg

SEQ ID NO: 586933 - DNA, 1137 bp, Homo sapiens
cactggcgctcttggtgcgcggtagctgtctttttctcttctattcttcttctactttgttctctacgctctgcttctctactgtgttgctattcgtcctgtcgttctcttgtgatctcactcttgtgttattgtctccgcctttctgttctccctcttgcctcatccgtccgtccccgcttcttctctagtgtcttctcctttctcttcgtcctctcttagtgtttcccgcgtttgtcccgctggggtccctttctccgtggggctgtctggttgtgttctgtgggctcttcttgtgatacttcccttgtcaccctggtcctggttccctgtggttacgtgccggtctgttgtttttttgacaccgtttatgccttcgatcgcttgctaatcgatgtgcggtgtcctgatcttctgtagtctttccttggtgcctagctgccgtgatgtagcagctaatgaagcccagcttctgatgtaaagtcagttggttgtgcctcatggagagtgagcgtttcacacgacctgcctaatcacagacaactcacttttgaagtaactgccggatagtgcttgatatcacagtgtaatgagcctggagcttctggtgatgaaggccctttcggtgggggctggtgaaaggcagtatagacgaggtggaacattacgagtccacatgtaccctgggtgcagccccgagtgttggatttgcgacagatcaagtggaatgaaggaccgcctggagttctggtgcacggatgtgaagagcatggagatgctggtggagcaccaggcccatgacatcctcacgtagggccccctggttccccgtcgtcgtctcctttgactcacctgagagaggcgtttgcacgcccaactgaatgctggctgctcagacggtccgacattgaatttcgggtcgggggttcgggatcctgtctgaagtacagactgttcttgctctaatgacaggactgtccctgatgggagcccaggcacacagggaggaggtcttctttgatgggtctctcctgcagaggtgtgggcggtctcagggtcttatggtgatacgggagagaaggaacgtggccaacggacaggaggcccactgaagtctgtgtactccgaggtggatca

SEQ ID NO: 586934 - DNA, 273 bp, Homo sapiens
tttttccccccccccggggcgcgggaaaacctcccttttggggggttttttggggaaaaaaaaaaaaaaagccccccttttttttttttagaggctcttccccaggatttttgtgggccccccggaggggttgccaaatttgggccccacccggtttttttaccaaaatttttttttttgggggcccccaaaatttgggaaaattggggttttttttttgttttcccaaaaaaccaaaacttcccgcccttttaattaaatggggggccttta

SEQ ID NO: 586935 - DNA, 123 bp, Homo sapiens
tcatttaactttactgttaagacatcactgaaatgaacttcagtaagctttcaattttgatacacagttcattattcataacttgaggcagtaataccagggggatgaagactggcaaggaag

SEQ ID NO: 586936 - DNA, 964 bp, Homo sapiens
gctattcctcctgctttgccgcgggcgcggccgacatcatgagggaaggtcgtgcgcttgcatcgtcaggagacaggtgcggcaagcacctgggcgccgagcttccgcgaggtgatcacgcgattaccacgggatcgaccccatgggcaccgtaccacggtcggacatgcgatactgcaaggcggttgtgatagctgcactcaatcgtgatactacctgtgttcgccagtcggcgcgtgtgtacggtgctcctccgccgtccgtgctcgtggagtctggagacccggcgcgcagtggactccgtgtgctcggggcccttcgggtgagatcttccggtcggagaacttcgtccgtcgctcagaggtggtgctgggagcaactgggccacggggctctgccagaactgcgcgtcagcttggtggtactcggtgctgtgatgttgtgagacgcggtacggctgacctgctgtgactttgtcctgctgtgttgccgtctgatcctctctcctgtctggggcgactgggtctgggatgggtccctcctcatccatcccgcaggccggcgagggagctccccgcaccggcactcgtgcccgcgttagtgtgctgccttcgccctgtgtcccacccgttggtggcccctgcctacgccacctctcaggtccaccagctcgtataaccaccggacgacgagctttgggtcgtggtaacagagctctctacgacatttgcttccgaagccttaagctgacacgccccacttggtgaacctgatacacctggtggctggtcccttgagtggcgtcccacctgtcgcgccttccggccctccacggctgcctgcggaacccgctcgttcacctttgccgctcccggtggctctatggccggtgccactgcgcgggcgcagtacgggtgcggccgccccccccgtgttgtgcacttgtctgcccctgtcgctgggc

SEQ ID NO: 586937 - DNA, 131 bp, Homo sapiens
tgacttatgaggatttccctcaccaagacccttgcagaagcaggaatgcagcagaagcaggaagcactaccattgaaccataccaggttgacttatcttttgatggagtgcatgaagacaggaagcgggta

SEQ ID NO: 586938 - DNA, 1297 bp, Homo sapiens
ctggcggctgccagagctgctggagctgctcggggtccccgtgtgcgtgctggctgtgctggctgcatgatggagtgagtgcatggctggcgtgcccctgtgtgtgctccccccctgtgactggtgctgctggccctgtgccctgtctcgctgaactctgctgtgtgtgtctgctgctgtgccctgctgctagctcctgacccctgtggccccttcctgcctgctgccatggctctggcctgctatgtgcccagctctgcagaaggctgctgctgctggagctcaatggtggcttgcaggaatgagcctgtgtcgagggattcctgcgtgacactggtggacgatggcgatctatacaactgggaggtggccatctatcgggccccccaacacctactacgagggcggctacttcaatggcgcgcctcaagttccccatacgactacgccatactactccaccagcctttcgcgttccttgaccaagatgtggcaccctaacatctacgagacgggggacgtgtgtatctccatcctccaccctgccggtggacgacccccggagcggggagctgcctcagagaggtggcaacccagcagaacgtcaggaccattctccttgagttgtgatctccctcctgaacgagcccaacaccttctcgcccgcaaacgtggacgcctccgtgatgtacaggaacgtgcaacgagatgcaatggcgaacggatccgggagtacaccagacatcatgcggcacacattctcttggctgaacacggtggactgcgtgatgctactgcgttaacggtgcccaccagtcctggccgactacttgcgctactcatcattgcgccgtccgccccaacgagtgactccaggacctctttcctaagaccgactctactaacccaagcacccgtcattgcttaatttaagacatcgtcgacttacttcttcgccgagcaatcagcgacacacttggcacgagcggcgtctcctgtcagcgtgtgatatgtacaaatatcgatcattaaactcacgaagctgctggatcccggtggctctcttagaggtacaggtaaccgcaccggaaggcaattcggtgctgaccgagcactcgttgcgggacatggatggactctcatacgtacctcggatggttgacgcacactgatgacaactgagggaggtccacccacaatacaactgcgcttcaccacgtcatagcacgcactaccgctctgagtagacctctggccccgttgcttccgcagccacatccgtcgtaattatgagatg

SEQ ID NO: 586939 - DNA, 337 bp, Homo sapiens
caggttatctcgcttctcctagccaacatgagcctaccacagggacaagggtaagagcacgggctgtgcaggctctagcacacctggcacgtcctgcctcccgcagttcactggacttcatgcaccttgtgccagtttcacattccttccccatctctgcagcctccaattttctccatctgtccaaatggggcatgcaactcacctgccttttcaggcattgttttagtgccatcagcaccaaaatgtccaagcattttgcacttcagcatccaaagctgcactccacaggccactccagtgtctttgttccactccttagtcattcacctttagc

SEQ ID NO: 586940 - DNA, 241 bp, Homo sapiens
acccgaggtggtcggttacagtcagatatgccagcaggaactcggtttacatgatacttatatacagatcagaagggacccgaggtccatatataatatatattatacatatatgcagatcagaagggaccctgaggtccatatataatatatattatacatatatacagatcagaagggacccggaggtggtcagttatagtcagatatgccagcaggaactcgtgtatacatgaacacg

SEQ ID NO: 586941 - DNA, 297 bp, Homo sapiens
gcacgagtatatattcacttttctcctttaccattatcatagttaattacacatttagccaaaaataaactgcaaattgccttgcaaattttcttcttttattattcttcagatatatcaatcaatacgaggctttttttcctccccaacgctttaatcattctgatcattactccgggtgaaacggttctctaacgcgatcgtttaaatttcgcgatagatcagggaaacgttataaagattgagtggaaagaacttccattcttcaggctgcttgtattactttgattctttttc

SEQ ID NO: 586942 - DNA, 857 bp, Homo sapiens
caaaacgaaaactcttgtgcttcaaaagacactaaagaaaatgaaaaggcaagccacagaaggagagaaaatatttttaaagcctacatctgataaaggatctgtatccaaatacataaataacttttacaactcaataataagaagacaaacaacccaattaatacattgacaaaaggtttgaatagacatttcaccaaagaggatatatgaatggttaataagcacataaaaagatgcccaacatcattagtcattagggaaatgctaattaaaaccacagtgaaatactacttggcacccactagaatggttataatcagaaagatagacagtaccaaatgctggcaagaatatggagaaatgggactcctcatgtattgttgatgggaatgtaaaatggtacagctactttagaaaatagtttggcagtttcttaaaaagataaacacaaatttactatacaacctagcaattattccactccttgttatctacccaagagaaatgtaaacagacatttacacaaaggctagcatgtaaatgttcatagcagcactattcctaatagccaaaaagtggaagcaacccaaacatcaatcaacactacagtggaatactattcaataatagaaaggagggaaatactgatgcatgctacaacatgggtgactctcaaaaaaattatgctcagtgaaagaagccagacacaaaagaccacatagtctatggttctatttatatgaaatgtccagaaaaggcaaatctatatagacagaaaatagattactgattgctggggctgggggtgggaatggagactgattatactgggcacgggtaatctctagaggtgc

SEQ ID NO: 586943 - DNA, 347 bp, Homo sapiens
cttatgttcgacccaccggaatggtctgtctcatatcacgtaacagcaaaggcgatccaaatggtggatagtctgagtaagctctcgtagacacatgtggcttgtcaggaaccatatcaactagtggcagtatcaccagacttcaagaatttagggccatgttccagctgtgtaccagaacggcgatcaatcttttccttcagctcagcaatacttgcatgcaatgtgagccgtgtgtcaatccaatacagtgggcattgcctgggcttattttggcctggatggttcagggatgttcacctgagcagtgatgccaggctgcttccattggtgggtcagatgatctg

SEQ ID NO: 586944 - DNA, 139 bp, Homo sapiens
tagagatccccaacttgcggacgtagtctagacgctcccaatgacccacttcagatactacaaaagattgtttcaacatgctctattgaaagggactgttcaaccactgtgacttccatttggaacattcccaatgaag

SEQ ID NO: 586945 - DNA, 249 bp, Homo sapiens
  misc_feature (5)..(5): n is a, c, g, or t
  misc_feature (242)..(242): n is a, c, g, or t
ttttntttttttaaaaggacggaattctttattggggaacggaaatattctggtcttacacagtagataataaaagggaatacggtataccctttattattcataaatgaaaagagaaaaccagggcaaaaggcggcagacagtacatctctaacatatggcaagggcggttcccggggacaacacctccttcagaaagggggccagcacaagggggggccggggtaccggagctcagaatncgggtaa

SEQ ID NO: 586946 - DNA, 469 bp, Homo sapiens
ccactggccccgaagcctacattcccaggaggatgagctgagtgctgtgcaattcatggtgcctcttctttatgaagccaagtgtgtaaaggttgccataaaggacaaacaagtgacatacttcataccttacagtggttggaatcacaaatagggctgagtgggttccggcagagccagagtactcaaatccgtggaacacccaatatgcagaaccagcgagaacttcaaaaagccaatcaggagcagtatgcagaggggccagcatgagcaggggctgcccccaggaacgcacgacatctggtctgcaacagcaaaaatgttgaagtgaacacgacaacgaacaaacagaaaacacctggcaactggagctggtggcagtcccagtgagacccctcagcctccttggaagaaacgggcccgggtagatcctcctgttgaaacttgaggcacccttcatgaacagcgt

SEQ ID NO: 586947 - DNA, 1500 bp, Homo sapiens
  misc_feature (543)..(543): n is a, c, g, or t
attctctacaagaccacaaagacatttggaacactataccgtattattcggcgcatgagctgggagtcctagagcacagctctaaggcctccgttattcgagccgcagcctgggccgagccgagggcgaacctctcctagtgtagagcggagcgacatctcactacacggtgtgagtcgtgcgaccgacccagtgcgagttggtgaataatgcttctgtcataggtaatgatcccatcaattaatgcgcgagcgctctgtgtgccacactcgacgtgaggtgtgcccactatgtaaactccggatagcgccacgcgagtatggagcgtcttccctcgacataaaagtcaacattagagcattctggactgcgttaccatccctacgtcatccgtagctcgcgtgcgtcggcatcatgactgagtagctagtggaggccgggagccaagggaacaggatatgacaccaggttctaccactcaccttacgacagggcaactagctcccgacctctgggagacctctccgttaggaccgtaaaccnaatcttactcacttgtaactaccgtacagcaagagtagtcttgccgtcatgaatcatgtaagggaggccgtatcgaaatagttcgatcgacacaaaccaatttgatcgcgaatgatcaaacaaccacgccgtgcgcaactaacacgcgcaaagagaacacgaacaacgccacccctcgtatcggtacgtgacctcacgggtcgccattaattccagcaagctagggtcccatgacctgtgcatgcgcgtagtcatacatacctcaggttaccgttagggcctggccatggggccagttcactacgtagcataccgttagagcaatgaaatccggaataacacttccacatcaactccggatccttttcatattcggaaagcccgccgagcgggaaggagcagtagaagaaaaccccgatctacatagtagagcaaaacaaccataagtgccttgagattataatccgggtcagacactcctgacaaggtctacactacataacttgattccgtagcccaagagggcactgaccggggacaactaacaatcgttcacccgagaataatgccggtaagacacctacagcgaacgtccccggcgagaacaatacaaacgaacagccccagattatcgggcgaacacacaccaccaagggacacacatggggacgcatgcaagcgcccaactgtaatcgactccaaaaagggcgccgagtacacccaccgagggtatgaacacacgaacgactgacagaaacaagaccaaaaacaaatcacgacccgacaaccgaaccctacacagagtcactcacaaccacacagacagccacacatgagacaacaccccgcgacgtgaacacccaagagaatacgcagcactaataccacacacgaggcactacaccatcatatgctatcacagcagacacgacacacagaacaggacacgagctcaca

SEQ ID NO: 586948 - DNA, 256 bp, Homo sapiens
tccccggccctttttttttaccccccggttgcccggggggcccccccccccttttttttcccccctttaagaacccgggggccgttcccccctccggtttttttttttgggcggggggggggtttccttttttccccgggggcccctttttccccttgggcctttttgggggccccttttgccccgttttttccccccagccggggggggccggggcggggtttcccggggttttttgcccccccgggccccccca

SEQ ID NO: 586949 - DNA, 735 bp, Homo sapiens
gggcccttttcctcagctgcctgcaaggtgctcggtccttccgaggaagctaagggctagcgtatgtggtgtagaggccctcacttacatacctggctgacctaagcacctgtgttacctggcaagctgccagccctaacactacggcccgggcccattggccctacttgtctacctgaaggcttactgccctggcaattctacactcgggcccttcagtttctggcaacggaacgcatcgaaggtgttgacaccatgtacaccgggagaggaataaacgcatacacatgggccctcaattacaacactgccaggccggggtagtaacacattggttgcgacggccctaatttatctgggcgcactatgggacttgttgttcatggcacaaaagtcgcccccttgtgggcccaaacatcgtacaaaccacttcatgggagacgccctccatttcgtggccaaatttgtaagggggcgccccgggtttgggacccattggaattcccacgcccaggcatgggaggtaggctatggccacaccccaagtgccaacaggagaacgggccaccttgggaccccccgtatcccacaatggcacaatggcctaggctacacaaggtcatggaaagcggaacgacaacgcaacaagcggtgtcgccagcgcgcagacaacgggaaacgaagcacacgacaatccccggcaggcgacagcatccgtggcactggacatgaaca

SEQ ID NO: 586950 - DNA, 106 bp, Homo sapiens
acctagaggatcccctggatcccacccatacattctcatctctacatctgtctgatgtacccagctcctgtcagcccaggataaggtgagagcagctactcagtcc

SEQ ID NO: 586951 - DNA, 817 bp, Homo sapiens
  misc_feature (4)..(4): n is a, c, g, or t
  misc_feature (101)..(101): n is a, c, g, or t
  misc_feature (138)..(138): n is a, c, g, or t
  misc_feature (148)..(148): n is a, c, g, or t
  misc_feature (253)..(256): n is a, c, g, or t
  misc_feature (310)..(310): n is a, c, g, or t
  misc_feature (332)..(332): n is a, c, g, or t
  misc_feature (385)..(385): n is a, c, g, or t
  misc_feature (392)..(392): n is a, c, g, or t
  misc_feature (403)..(403): n is a, c, g, or t
  misc_feature (417)..(417): n is a, c, g, or t
  misc_feature (432)..(432): n is a, c, g, or t
  misc_feature (483)..(483): n is a, c, g, or t
  misc_feature (533)..(533): n is a, c, g, or t
  misc_feature (663)..(663): n is a, c, g, or t
  misc_feature (699)..(699): n is a, c, g, or t
  misc_feature (725)..(725): n is a, c, g, or t
  misc_feature (729)..(729): n is a, c, g, or t
  misc_feature (817)..(817): n is a, c, g, or t
aatnttaaaagctatttatcttttaatatgaaaaaaattatttatttcaacataaaataaaaatctcaaatgtaggataagaacaaaaccaagtgtgtaangggggaagcaacagcaaaaggaagaaatgagatgttncaaaaaaaangaaggagggttcacacactcctctggggactgactcaaacactgatgtgagcagtatacacacactccagagtcaggggtgttcattcttttttgggagtaagannnngtggggattaagaagacgtttctggaggcttagggaccaaggctggtctctttnccccctcccaacccccttgatncctttctcttttaaagggaaaggagctgagtaagggaggtaaagtatagaaanggaaggnttccaaatatnacagaatgggacanactcctccaaagtanagcttagagagagagaatataaaagtggagttaatactgctgacacctccnttgaagctgggatgggaaatggacatacttagaaatttaataactttaanagcaaaaaaaaccctctccaaaacttttagaatggaaaatcccatccccttccttatatagtgacttctacccactaccttctaccattttctactttgggcttaggatgatagccattatctacatgtnttttcagcacctggttggttctaaatgggatctggngacccagcttcttggagatttttaanaggnagtattaactggacaaatggaatgggcaccagaaagaaatacagggtcacccagaatggcagaaacctaggtttcccagagtggaaan

SEQ ID NO: 586952 - DNA, 251 bp, Homo sapiens
taggggctgagcgggagtctagaatgtggatatttgaaagcccctggggtgaagcagtgactatctagacgagcactctgtaaatattgggcaagacgttggacttccctggggcacgaaactgccatagaccagaatgtgtctattatgttgttttttgttgttgttgttgtttgttgttgttgttgttgtttgagacagagtctcactctgtcacccaggctggagtacagtggtgcaatctcggctca

SEQ ID NO: 586953 - DNA, 416 bp, Homo sapiens
  misc_feature (14)..(14): n is a, c, g, or t
  misc_feature (21)..(21): n is a, c, g, or t
  misc_feature (40)..(40): n is a, c, g, or t
  misc_feature (48)..(48): n is a, c, g, or t
  misc_feature (81)..(81): n is a, c, g, or t
  misc_feature (90)..(90): n is a, c, g, or t
  misc_feature (120)..(120): n is a, c, g, or t
  misc_feature (207)..(207): n is a, c, g, or t
  misc_feature (212)..(212): n is a, c, g, or t
  misc_feature (237)..(237): n is a, c, g, or t
  misc_feature (297)..(297): n is a, c, g, or t
  misc_feature (300)..(300): n is a, c, g, or t
ccccctacctgaantgccttnacccatcttaaccccccanttcccatnagggccccctttaaaaaaaacctgctggagacnacaatatcnaaaatgtgaaggggcgcccccatattctgnatggaaaaaaaacatctaaggccatcccagggcaaggaactgtctttctggttcaataagactgcccccgaacagtcctaacaaagnctcancactgaccatacctcagcccctaanccctggggctgaggtatggtccagttgctgaggtatggtcagtgaccatacctcagcccnctnaccctggggggcagctttaacctgggcatgtttcctgggtaccagtggggccaggaggtggctctggctcagagccgtcagtgtggctgaataaaggctctcttgggtaaaaaaaa

SEQ ID NO: 586954 - DNA, 115 bp, Homo sapiens
taatagaatagtgtatagcaatgaacatagggaatgcagatattgctacggatatcattttcttttctattttttggtggggaaaacgggaatcttgtctgttgcccaggttgga

SEQ ID NO: 586955 - DNA, 1716 bp, Homo sapiens
cccttttaagggccaccaccgccctcatggaaagagctgagccgcttcagactgcggggcaagccgggcccgccggacttccccctttccctcgtcccactgggacaaggacgcaagcgcattcgtctgtacatgcgaagtcgacagaatctacagaccagtacttacgcaaacacgatcaatgatacacggtaactcatcactacagcatagttacacaacaacacattagaatcacacaataatacactagtatataggaccacgagacgcgagagaatggagagaagcaagaagacagaacgcgcgacagacacgcacgagccacccatggatgccatagaggaatacgaaagacacacagagagcgaacgaggagagagaggcgaacgaaggcaaaaacgagcgagaggcacgagacaggaaaagagtccaagagcgacacacaacagacgagagaaataaacagaaacaaacaaacaaactcaacacgcccacaccaacaacacctcacagcgaccataaaccaaccacacgaagcaaacagccgaaaacacataatccaaacaaccgaaaacacgtacccaccacaccccctctgacacgtcaccaagatataaacacacataacagcacaaacacacccacaacaccactacagactctataccacatacccagaaaacaaagtaaaatacaaaacacaaaaatagacagacacaactaaaacaaaacacacaaaccaaaacaactcaaaacacacacaaaacctaatcacaaacacagctcaaaacacaaaccacaccacaaatacaacaacaaaacaacaacagcgattcaaaaagtacaaccgaacactaacacacactactcatagaacactagccaacaaaacaaactaaacacaatctatacaagaccaatctacagaaaagatatacgcgatactaacaatattggatatacaaaccactagactcacatggcaatccagatatatacattcaactaaaacaatataatctaaacactatatacacaatatatcaacaactgagacatatctgctatagcatcatacaaaataaactaacacgcgacctacaacctccaccataaacaccaatgcaaaataacaaactaacgattatacaagaactcagaatcacgatacacaaccacaatacatacactagaaatatagatagcatacatgcacatcattactacatcatagtaaccgcagataatcacactctcctcctaaatacacagacatacagtaaacctcagcgaactaatcaataaagataacagataaatacacataaaaaaaagagaagctaacacacataccacatcactcaatacaagaataaaaataaagacatagaaaagaaaatagaaaacaatatacaaacctatacactacataagacacagacgacgtacgctcctaccacatccgtaagctccaaacaaagacaatgacgattacataaacaactaacacacacgtcaattaaaacacaacaaacatagaagatcaataacacccacaacacacaaaccacacaacaacaccaacacacgtcataaatctctcagctgcaaatacacacaaacaagctgacatacgtatccatcagactaaaccaacacgcagacacgaacctacgaagcattaacgagcagaacacaaacacaaaacaacaa

SEQ ID NO: 586956 - DNA, 154 bp, Homo sapiens
  misc_feature (66)..(66): n is a, c, g, or t
tactcttgagtatccccttcacgtggctgcggaacgcagaagaggagtctgaggataactaaaacncaaatacacaaaatgaaacaaagaacaatttaagtattttttaaaagtttcacgtcttcgccaatcacagtgcagcaaggccaagcag

SEQ ID NO: 586957 - DNA, 205 bp, Homo sapiens
  misc_feature (37)..(37): n is a, c, g, or t
  misc_feature (62)..(65): n is a, c, g, or t
  misc_feature (74)..(74): n is a, c, g, or t
  misc_feature (87)..(87): n is a, c, g, or t
  misc_feature (138)..(138): n is a, c, g, or t
  misc_feature (141)..(141): n is a, c, g, or t
  misc_feature (156)..(156): n is a, c, g, or t
  misc_feature (196)..(196): n is a, c, g, or t
ctctgcgagccacaggctaatgagcccttgtctcctncgcacagcctttggacctgtctatnnnnatggtctgnaaacttcaggaanactgatagctgagcatctggcacatattatgcactcgaaaaccatgtattnctntctccttccctttgngacccgtaaaccagggactggacattttttcaagaagcangaactggct

SEQ ID NO: 586958 - DNA, 962 bp, Homo sapiens
  misc_feature (2)..(2): n is a, c, g, or t
cnaacgactagccgaggaaaggatacggctgaccacataagaaggagacctaggagcggttaactacacagtataatagacgtctgtcagacaggatcaaagcaaagctgtgttaacccgggggctggttgatctcccgcgccattggggtgctgtacaccacccgaaaggggtacgcctttaaaaagggggccgaaactatttacaagtgccagcgggcacagaagtttcactcccgccgctgggtgggccttacgggcccccacttggggtcgttaccgggcccgctagtaccgaacccgtgtaaagaagggggacaaagagccgatgtgggcccccccttggaggtgaggcccacttggggccgcacaccagggggggacaccccggggggccacagtgtcgggtccccttctttgttggggtccgcgccttttgttgttgccgccaagtggccctcacaacatttttgttagacgctacttcgggcagagaaccccgccgctagtgtactcccaccccccgggcgcggcacgcttttatgacgccatgtggggcacgccccggctgctttaacgatgacatgtctctggcaacattttagagacctcgcccttcgcccgcccctccccgcccccgattgttgacggttgcggcctccaagcgaccttgggcgacgggagacaccgaggcaagaatggcccctcacagccattgggagacaccgcgtcgagtcgtgtctgagcaacggagacccacacaagagggcgttcgatgggaggagaaggacatcctcgcacctcgaagaatgcacacagaggagtcctcagatgagcgaggccctcgcgaagaaggtgggactatcaaaaaaaagatgataggcgtaaatccatgtgcggcacgggaaatttcgaggggggtggcacccaggcccttaaaaaaaaaaatcccccaacataaca

SEQ ID NO: 586959 - DNA, 915 bp, Homo sapiens
  misc_feature (1)..(1): n is a, c, g, or t
  misc_feature (3)..(3): n is a, c, g, or t
  misc_feature (5)..(5): n is a, c, g, or t
ncncncttcctccgtgggtggttataaacagcttcttgtgacccgtctgttctcgtgttggcaccacccagaccgtgtgtgtcggccccttctgacatgcccgcgggtcgtattaccttctccgcgtggtgttttctttcttcccccgggctgggttgatcaactctttattccaccgcgacgacactgtttgatctcctctctgccctcctttgtggtggcccaccattcttagaggaacacgattgtgtttccccacacaaacgaccgctgctggtttcgccgtcctgccggtcattttccccgcggctatttttgttttcaacccccaccctcttccgccgccgcgctggtgtgggtgacagacacaccaatattatgtggttgctgccgctgtcagatgaaattcttcccgcggcggtttttttggaataatagatgatgcggcgcgaccacacccccagacacctcggtggggagattactcccccccctctgcattataggggccccgccgctgctttataactccgcgtgtctcgctcacggacgtagtagaacacctcccccttgctgccccactaagtcctcttctcctttctagtgtctcggcggtggtggttgtttttatagttctctcgcgggttggttttctcacccccccctcctctctttttgaacccccccttctcttgtttgggggggataaagaactaccccccccaagtgggttggccacgcccccacatgctgctgcgcttgtaatactgtggcctctcccccgcggtcgccccacccccgctcgttggttttgggggcgcccccccccccccggggccccaattttcccgttcccccggggaaaaaaaaaaaaaaatgtgggggaaaaaaaaaaaaaaaaacccccgcgggcca

SEQ ID NO: 586960 - DNA, 568 bp, Homo sapiens
  misc_feature (459)..(459): n is a, c, g, or t
  misc_feature (463)..(463): n is a, c, g, or t
  misc_feature (512)..(512): n is a, c, g, or t
ggtggatggtatagatggaggcatggatgagatggatggatgggtgaataggtaggtaggtagatagatggatgtatagatggatgcatggatgccgatggatggatgggtgaatagatagtagatgatggttaggtaggtagatgagtggatagatagatggatgcatgcatgagatggatgggtgtatagatgatgggtaggtaggtagacggatggatggatagatggatgcatgcatgagatggatggatgggtgaatagatggtagatgatgggtaggtagatagatgaatggatggatagatggatgcatggatgagatggatggatgggtgaatagatggtacatgatgggcaggtagatagatgaatggatggatatatggatgtatggatgagatggatggatgggtgaatagatggtagatgatgggttcacagtattggaagggggangacngaatgcctgtttacagagacccgttacagagctatgttaagtatactgnatgtcattctagtaacgatcgagacatagggtaccggctcgattcgtatctgtctg

SEQ ID NO: 586961 - DNA, 746 bp, Homo sapiens
  misc_feature (2)..(2): n is a, c, g, or t
  misc_feature (63)..(63): n is a, c, g, or t
  misc_feature (104)..(104): n is a, c, g, or t
  misc_feature (188)..(188): n is a, c, g, or t
  misc_feature (192)..(192): n is a, c, g, or t
  misc_feature (194)..(194): n is a, c, g, or t
  misc_feature (197)..(197): n is a, c, g, or t
  misc_feature (210)..(210): n is a, c, g, or t
  misc_feature (219)..(219): n is a, c, g, or t
  misc_feature (258)..(258): n is a, c, g, or t
  misc_feature (268)..(268): n is a, c, g, or t
  misc_feature (276)..(276): n is a, c, g, or t
  misc_feature (280)..(280): n is a, c, g, or t
  misc_feature (283)..(283): n is a, c, g, or t
  misc_feature (287)..(287): n is a, c, g, or t
  misc_feature (294)..(294): n is a, c, g, or t
  misc_feature (336)..(336): n is a, c, g, or t
  misc_feature (353)..(353): n is a, c, g, or t
  misc_feature (377)..(377): n is a, c, g, or t
  misc_feature (379)..(379): n is a, c, g, or t
  misc_feature (383)..(383): n is a, c, g, or t
  misc_feature (385)..(385): n is a, c, g, or t
  misc_feature (391)..(391): n is a, c, g, or t
  misc_feature (411)..(411): n is a, c, g, or t
  misc_feature (433)..(433): n is a, c, g, or t
  misc_feature (437)..(437): n is a, c, g, or t
  misc_feature (440)..(440): n is a, c, g, or t
  misc_feature (464)..(464): n is a, c, g, or t
  misc_feature (480)..(480): n is a, c, g, or t
  misc_feature (548)..(548): n is a, c, g, or t
  misc_feature (578)..(578): n is a, c, g, or t
  misc_feature (583)..(583): n is a, c, g, or t
  misc_feature (604)..(604): n is a, c, g, or t
  misc_feature (669)..(669): n is a, c, g, or t
  misc_feature (734)..(734): n is a, c, g, or t
cngtgccagcccttgagctgccgacattagagacgcccaaggccgtgccgccactggcacgangccgcccgccacgtgtggcccgtcctggcctttcccgctgnactgccgcgctcccgacactcctctctggcgttcctctgtcttaggattttccctctctactgttgtaatgtgtgagcctgtcngccncnccncgagtgaccctcntgcgtcccncgtgtgacggccagaggctttccctttgtaaggcttaantctgagtgcngtcaagantganganaccnaacaccngaaccctaaactccaatgatatggcgccaatttagagcggcncccccccccctccgagncagcggcattccacccctcggcgngngccncncccccnccccctcagagagagcggcncccccaccccctcagagaaagngggnggnccaccccctcagagagagggggancccacccctcagaganagcggcacccccacccctcagagacagcggcacccccaccccctcagagagagcacccccaccctcanaatcctactttggtaaatattaatgtttancagtnagcaaaatatttaacccagtnagcaaaattaacaccgtcatttcgatagttactctgttgtgcatagtaaatgctgcaagatgagnttcacattggatgaagcagatttgagaaacgtttgccagacagtgtgcctccccttcgacaggancctaagccagag

SEQ ID NO: 586962 - DNA, 431 bp, Homo sapiens
gtcgacttccgtctcctcagtcacactgcgcccccctcccttgagtttgaatctgagtttgacttgctttgcttcatttgtttccttcatctctgttgttcaccccacaatagttgcgtgtcggaaaattcttcagggtgtttttagggaagttttagtttttcgttttaatcctgtctgtaagatttcccacatccgatttgtttttcgccccggacgctctcgggaacacctatacataaaaaaaaaagaagaaaaataaaaaaaatcctaggggaccgcttttcctaggcgcctcccgataggccaaagagtttatattggaagcttttttttgtaaatcccaacgtcaaagcacccatccaggcatgacggtagtggtacaggtagtgcacagagaagattgattgccatgccatgtgtttccttga

SEQ ID NO: 586963 - DNA, 362 bp, Homo sapiens
aagtcgcagctactgtgggaggctaaggtgggaggtctctgagcctgggaggcgaggtacagtgagctgagactgcgacactgcacaccaacctgggtcatagagaccccatctcaaaaaaaaaaaaattcagggccacaaaaaagagacaccggagtcgacattattgaacccaaagctgtttctttgacaaggctgattacaccaagataggcaacccacaaaattcccaaatgatatagtcaagcttttaaggcacaaaagtgtcttctgaacaattattgaggtgacagagtgcgtagcctggagatactaatgtaatctgccttgcgcaaattggtatccagacaagtgcagcgtag

SEQ ID NO: 586964 - DNA, 307 bp, Homo sapiens
cacatcactgggctatacctatgaacactaagtacacaaatatctcttagagaccctgctttcaattattttcgagtatacattaggtcatccttatctagatgggggggatccaagactcccatggatgtgtgaaaccaggaagagtatcaaaccccgtatagtgtgttttcacctatatatgtatatccatggtacagttaatttctaaattcaggcagagtaagagattaacaacacagtaaaaatcgaactataccaatatttggtaataaatacatatagctgtggctgcgctgcaacgggc

SEQ ID NO: 586965 - DNA, 789 bp, Homo sapiens
  misc_feature (39)..(39): n is a, c, g, or t
  misc_feature (68)..(68): n is a, c, g, or t
  misc_feature (73)..(73): n is a, c, g, or t
  misc_feature (81)..(81): n is a, c, g, or t
  misc_feature (87)..(87): n is a, c, g, or t
  misc_feature (101)..(102): n is a, c, g, or t
  misc_feature (122)..(122): n is a, c, g, or t
  misc_feature (146)..(146): n is a, c, g, or t
  misc_feature (155)..(155): n is a, c, g, or t
  misc_feature (160)..(160): n is a, c, g, or t
  misc_feature (166)..(166): n is a, c, g, or t
  misc_feature (170)..(170): n is a, c, g, or t
  misc_feature (253)..(253): n is a, c, g, or t
  misc_feature (287)..(287): n is a, c, g, or t
  misc_feature (373)..(373): n is a, c, g, or t
  misc_feature (412)..(412): n is a, c, g, or t
  misc_feature (418)..(420): n is a, c, g, or t
  misc_feature (439)..(439): n is a, c, g, or t
  misc_feature (455)..(455): n is a, c, g, or t
  misc_feature (461)..(461): n is a, c, g, or t
  misc_feature (550)..(550): n is a, c, g, or t
  misc_feature (560)..(560): n is a, c, g, or t
  misc_feature (567)..(567): n is a, c, g, or t
  misc_feature (584)..(584): n is a, c, g, or t
  misc_feature (596)..(596): n is a, c, g, or t
  misc_feature (601)..(601): n is a, c, g, or t
  misc_feature (607)..(607): n is a, c, g, or t
  misc_feature (655)..(655): n is a, c, g, or t
  misc_feature (657)..(657): n is a, c, g, or t
  misc_feature (694)..(694): n is a, c, g, or t
  misc_feature (714)..(714): n is a, c, g, or t
  misc_feature (765)..(765): n is a, c, g, or t
ctctggtactgggtgttccctctagctcccaggctggcntggcctcctgggcgaggggctggcccagngcctncgtttctnggcacntactcagagagttnnggaataaattatagttctgncactcagggacaatgtagatattntgatgcaanattanacattngcanacaaagggtataaaaaccctcttggagccacccctcgcctactggcctcagggtcattgtgtgcaggttgtggccacgcttgnatatgttgcaggtgccctagtaaagtctccgtgnagataatagtctggggcatggttcgcgccccgaggtaggccctttgccctctctgggcttcctgtttcctccttccccctcctacntccctgggcctggtattaaggcttgtggcctttgtggangggggnnnatggaacagagggcaggangtggagggggcagggnggggcngaagggagtgttggtctcagctgttcagcccaggctctccccctgccttgatgatgtccttggccagcacctgcccgcagagccatctnggagccaggnagcaganatagatcacagagctcnaatccacacctngtctncaccanagcccaggcagggcaaggtgtaggactacaaggcaaaaggggctcttnanggcctgttcccaccccacccctggcattacccaccanccaaagaagtgcaaccaaancctcctcaatctccaaataaattatggaaataaattatagtcttcacagtncagttgatttagccacccatgggt

SEQ ID NO: 586966 - DNA, 448 bp, Homo sapiens
  misc_feature (80)..(80): n is a, c, g, or t
  misc_feature (360)..(360): n is a, c, g, or t
ctgcagaatgttgaatgaaggagagctgcctcagcatgtaccaagtctatatatcaggtctactgtgaacacttccaaanccaaacccgtctgaatgcataaacacataatgaagtcctttactgtcacgaaatttgaatccaggatggccagtacataagtaactccttgaaattcaaattggattcagttcttgaagaacgtcaatcaagacttctacattccatgtgtgtgcctgtgctccatcactattatctttcccatcactccagatcccactggccggagcaaggaaaccatactctgtaataggaaggccatctgttaatcctgaactgagttcgagccaatcattcccanaaacccttgcaaacctggggcagctggtgacctcccgaaacaccaaaactggcacgattattattgcaaccattcttcagcacgggga

SEQ ID NO: 586967 - DNA, 479 bp, Homo sapiens
  misc_feature (33)..(33): n is a, c, g, or t
  misc_feature (375)..(375): n is a, c, g, or t
  misc_feature (422)..(423): n is a, c, g, or t
  misc_feature (427)..(427): n is a, c, g, or t
aattcgcggccgcgtcgacgatcggcgtcacgntcacggaggcgtcggccacgttcagcggacacgggagcaagatggcgattccgggcaggcagtatgggcttattttgccaaagaaaacacagcagttgcaccctgttttgcaaaaaccatcagtgtttgggaatgattctgatgatgatgatgaggatcttgctctttcacccaggatggagtgcaatttgtgcagtcacaactcatggcagcctcaacctcccaggccgaagcacgcctctcacctcagcctcccaatagctgggaccacaggcacacaccaccatgcctggctattttttaattatttttgtagagacagagtctcactgcgttgcctangctgctctgaactcctgggctcaagtgatccactgctttggctcccnngttngggcttatagtgtgagcctgcactggctgtgcttagtatgtgtatatatgtg

SEQ ID NO: 586968 - DNA, 466 bp, Homo sapiens
tttgagcctctcctatcccacacgtgcagtagctggagtttcctttttatctaatacttgagtttcccactgccatacgcacgccttgttgatgcctaatgtcttcttgaggtttcctttagagggcactccttacctttggtgccagccattctgctattctgatcctacttcccctcattactgatcttccttctctgccatcctgaccccttcctgtccttggatgcctttggagttgcagagaagctgtctttatcttcctggtgtgatacttgttttctaatagtaggaaatagtgttttcttgttctgcccagttttctctctttatagatgagacatctaagttcctgctccctggatgtatgtcagtttttctcttacatggtaatgttctgatctgagtccggtatctccattgtctaactttgcatagaggaacatacctgtgctttggtggggac

SEQ ID NO: 586969 - DNA, 698 bp, Homo sapiens
tgcccaggctaattctcaaattcctgagctaagagcgatctgcccacctcggctccgaaagtgctaggattacagatgtgaaccactgtgcctgggcctgataagtgtatgttctggttaagaactattgtctccagtcactcattccaggttcccagagcaaactctctctgctctcggagcgcggtgacacatggcatatgtgctccaactagttgtcagtcccaggtctagtactctccagatcagtttatcagagctctcatatatatgtagatgccatccttgtctaaaaacttctcgcgacctcctggaatattcctattgatctcgatgtttatttagcatcagtctcaagaagactaggtcttagtgcacagtatctctgacaaagaaaacagctttgtttgtataactggtatgaacatgaaaagattctcatcagagtgagcatgttaaagttatatcagtttctcaccaaagaagtatgcctgggagccctccagctgttaaatagacatatgctattactacttcttatcaaataatctgtaatgccctgtgatgtttgatgatacttcgttcaatatcaaagtgttatgtatgtgtcactcagtaataagtagcgaaccatgtaaaatgccacttttcaggaaaactgtatgtaacattttgtgtagcaatgttaaacaagaaat

SEQ ID NO: 586970 - DNA, 777 bp, Homo sapiens
  misc_feature (33)..(33): n is a, c, g, or t
aattcgcggccgcgtcgacgatcggcgtcacgntcacggaggcgtcggccacgttcagcggacacgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaatgctttggggaacgacagaaagcccaagtatattcacaacttgctaaaagcacgttgagatcagaaaaacaggaacaggacaccaccgaactggacaagaaaatacagagagaacgagaaatggaaacacagggggagttcgactgataacagaagcatttgtgacatctgcatataagacacaactgcaagagagagctgaagaagaacgaacgcagaacacgagggctgctgcactggaagcatgttggatgtaaccaagcagcaaagatctcaggtggattctataggcacctattaaatcaagcagctcggtgaagcaggaagtacctaaatgccagctttcgtgaagccagatctgctataccggcacgacacatcaggggctctccaatgacgtagttcaaaaaaccgattcccagagaat

SEQ ID NO: 586971 - DNA, 749 bp, Homo sapiens
  misc_feature (33)..(33): n is a, c, g, or t
aattcgcggccgcgtcgacgatcggcgtcacgntcacggaggcgtcggccacgttcagcggacacgggagcaagatggcgattccgggcaggcagtatgggcttattttgccaaagaaaacacagcagttgcaccctgttttgcaaaaaccatcagtgtttgggaatgattctgatgatgatgatgaggatcttgctctttcacccaggatggagtgcagtggcgcaatctcggcttactgcaacctctgcctcccgggttcaagcagttctcctgtctcagcctcctgagtagctgggattacaggcaggcaccaccacgcctggctaatttttgtatttttagtagagatggggtttcaccatgttggtcaggctggtcttgaactcctgaccttgtgatctgcctgccttggcctcccaaagtgctgggattacaggtgtgagccatcgcgcctgagcaatatgtggtggttttttttcgagacggagtctcgctctgtcacccaggctggagtgcagtggcgcaatctcggctcactgcaagctccacctcctgggttcacaccattctcctgcctcagcctcccaagtagctgggactataggcgtccgccatcacgcccggctaatcattggtattttatagtagagacggggtttcaccgtggtctcgatctcctgacctcgtgatccaccctccatcggcctcccaaagtgctgggattaccggcatgagccacgcgccca

SEQ ID NO: 586972 - DNA, 400 bp, Homo sapiens
ggcgagatcacatcacagaccggggctgtagtggggtggggggagggatagcattagaagatatgcctaaggttaaatgacgagttaatgggtgcagcacaccaacatggcacatgaatacatatgtactaaccttcacgtggtgcacatgtaccctaaaacttaaagtataaaaaaaaaaaaaggtaatggcaaaaaacacaattactttggcaccaaaagagtgcctttatcaggtggaggaagttcccttcatatcttagatagctgagagctttggtttattttttatctcagaacggatgtgggattttggaaaggttctctctcctggcttaatggagatttcaaaaatcgggaagtgaaggtgggattttggaaaggtatctaatgggcctaa

SEQ ID NO: 586973 - DNA, 151 bp, Homo sapiens
ctgcggtagcgtcatacgagctcccggaacactctgcccccgaaaacggtgtgttactctcgacacgacggcctctggacgtggacacggcctctggacgtggccacggcctctggacgtgggtctggggtcacgactgtggcgcgggtac

SEQ ID NO: 586974 - DNA, 187 bp, Homo sapiens
  misc_feature (5)..(5): n is a, c, g, or t
gctantggaggcaggattgaacctacatactatgttgggttcttaacctgctagagacacaacaggaaccaacccctaggtatatctgtctagtattctacttcctagtggcaatatgacgaggtgattccacaaaggcagctgggacaagggaaggacctcaacacatgaccctatggacagaaca

SEQ ID NO: 586975 - DNA, 445 bp, Homo sapiens
  misc_feature (187)..(187): n is a, c, g, or t
  misc_feature (195)..(195): n is a, c, g, or t
  misc_feature (200)..(201): n is a, c, g, or t
  misc_feature (213)..(213): n is a, c, g, or t
  misc_feature (255)..(255): n is a, c, g, or t
  misc_feature (422)..(422): n is a, c, g, or t
aacaatattaaagaccaataaataagtgggagtgaacaaaggtaaaaggtaactaatatcacaattaaaatattctgctatctctcactctctctcttcccctttccatttgtcacacccaggctggaatgtgacaaaaaaatataaaaggtcaatttcatcatgcaggaatgagtcgtagaaaaanggagaaangaacnnagaagaaaacancagcaagtcactgtaagtactgtgaaaataaactgaaagtangggctagaaaaaaaacagagaatgtccgagtagtctgatggaattgggaggtctgagatgagaaggccacccaggtgagaccagggagattgaggccacaattgattcacgattgcatctctctgctggaccttaattggtactgtaattggacaaagagccatgtngctcttagatgttggcaaagtga

SEQ ID NO: 586976 - DNA, 535 bp, Homo sapiens
ctaacctccctcacgcggcggtggctgccgggacctagcaggtttcatgctggagcggcggcggcggcaacatggcagagaccgcggactggagtgggccgcttcaagaccaactatgctgtggagcgcaaaattgagcctttctacaatgtggctggaaaagcacagcgtggaccagactggccagcacctcattctgcagtctgtggcaccagagtcaacattctggaagtggcctcgtggggccgatgctgctggagtctggagcaggatggaccatggaggacatcaactgcctttgaccatcagcccatgacaatcgaggtgcatggtgacatgccagatcgggccattgcttgctggctcagttgtggcctggcaagagtggcagcgattacccatgcctgtggaaaggctgatacacactggaccccggtggccaaccatggcctatcagaccacaacctccacttctgctagaccacaggtggcatgtgatgggggccgttgctgcgtactggggacaatcggtgcg

SEQ ID NO: 586977 - DNA, 261 bp, Homo sapiens
aaggttttttttcccgggcccgtttttttggggccccaaattttttccccaaggcccaaaaattgggccccccccgttgcacccgttttttaagggggggggcctccctgcttggatttttttgggccccccccccccccggggtcccaatttttaaatccctggggattttttggtgacatgccttgggccaaggtgttgggttgttttttttgggaaagacaaacaaaaaaacaaattttaaatggatttgggggccca

SEQ ID NO: 586978 - DNA, 103 bp, Homo sapiens
gagtgctttgacatacagagaaccgctgtccaggcaagagctctggatcaagaatgggctacactgaaggcccttgcttcactgtattcaacaacgtccacta

SEQ ID NO: 586979 - DNA, 164 bp, Homo sapiens
aaggtctggcccactagttctccagtggatcacatagagcctcacagctgctagctgttcccgggcccggaacgtctgggtcagtccccctgtgctgtccacctcctctgtacagcacagaggagcggagcatgaggacaggagaaggggctacttcttgctgt

SEQ ID NO: 586980 - DNA, 583 bp, Homo sapiens
acttacgcaagcagagaacctaccccagaacaacttaaaatacttctttaacactcccacatttgagtcatattacttgggaagacccattaaaagaaacataacttaaggaatgtgatatagttaatttagtgactggctgtccctctccgtacctcccctattcaggtacaagcattggctatcagaaatagaagagaaagcatacgtaacagagcacatcctcaaataaccaggctctgtgacaaaataagtcctgagaaggaaaactggagagccacagatgttagtgatcagaacagtgtgtctaacatacctgaacatattacctcaagtggctctccaatccttcctcatggcactgggcaaccacttgaattatgacccttcacaccacaggagtgaatcacagcaagagatatgtaataatggaaacctttcattattatcacagcagtagtagaacaatgatgatgctatcagcacttaggagcacaggagaccaggaattagatggggtccttacacgtgggatccaagacctttcttacatgttatgttcagcacacagtatcatcccgca

SEQ ID NO: 586981 - DNA, 266 bp, Homo sapiens
ggctccaccagtgtaaaagctggcctccagtctttggaggcctctggtcgactggaaaataagtttgacatgtttgcgctgacacggggcagctccctggctgaccaacggaaaaaggtaaaatacaaagcccctccggtgccttgccctccatccttcctttgttccttttggccgggcaccacagcactggggctcccctcttggttgatcctcttgtactggaaaaggtgccttttgtatccccaattaaaggtagaaaccca

SEQ ID NO: 586982 - DNA, 510 bp, Homo sapiens
  misc_feature (308)..(308): n is a, c, g, or t
cgaaatattggtggcagttgggtcctgaactctggtgtgtcagcggctggaaggggtctgggagacacatctttcggaagctggctcctagggcttccagtcagaatactcatgatggagtccacagccacggagagtgaggcctgtagtttctgctgagcctgggcagccgggtgatgtggctccaagacctggtccacagtgaatgggatggaacctggcactacacggtggctctccacagggatggcatggagatgagtggtgagcaaagtatagactccccagatttccattggcgggacggnaaaggcactgggggaaatccacaaagagaaaaagcagcagagttggtccttgaggatccatagtcggagacggatcctcctcattgggattccacctgataactcacatcgggaagcaccaaatctagaggacaagatattacgggaatttctaagataagtaaagctcttgaaatacaatgggactacagaacctgtattc

SEQ ID NO: 586983 - DNA, 1439 bp, Homo sapiens
  misc_feature (108)..(109): n is a, c, g, or t
  misc_feature (133)..(133): n is a, c, g, or t
  misc_feature (213)..(213): n is a, c, g, or t
  misc_feature (223)..(223): n is a, c, g, or t
  misc_feature (256)..(256): n is a, c, g, or t
  misc_feature (260)..(260): n is a, c, g, or t
  misc_feature (279)..(279): n is a, c, g, or t
  misc_feature (308)..(308): n is a, c, g, or t
  misc_feature (330)..(331): n is a, c, g, or t
  misc_feature (333)..(333): n is a, c, g, or t
  misc_feature (359)..(359): n is a, c, g, or t
  misc_feature (363)..(363): n is a, c, g, or t
  misc_feature (368)..(368): n is a, c, g, or t
  misc_feature (373)..(373): n is a, c, g, or t
  misc_feature (386)..(386): n is a, c, g, or t
  misc_feature (393)..(393): n is a, c, g, or t
  misc_feature (471)..(471): n is a, c, g, or t
  misc_feature (1221)..(1221): n is a, c, g, or t
  misc_feature (1311)..(1311): n is a, c, g, or t
agtgaatgaggacaggatgcgcatgtggagcgttccagttggtgaggagctgtgggtcgtgtaggggatgccctgggtagagtgcggtagtgatggaaagggtccaannggttccaagacgcgtaggcgagtnggtctgaaagcccccggtatcattcctcgaatttcagtgcgggaaccaatgcagactggcattaaggctgtggatagctnggtgccaatnggtcgtggtcagcgtgaactgattattggtgancganagactgggaaaactcaatngctattgacacaatcattaaccagaaacntttcaatgatggatctgatgannanagaagaagctgtactgtatttatgtngctnttggncaaangagatccactgtngcccagntggtgaagagacttacagatgcagatgccatgaagtacaccattgtggtgtcggctacggcctcggatgctgccccanttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgccccaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccctggctattgaagaaccagtggctgttatctatgcgggtgtaaggggatatcttgataaactggagccccgccagattaccaagtttgagaatgctttcttgtctcatgtcgtcagcccagcacccagccttgttgggcactatcagggctgatggaaagatctccagnaccatccagatgccaagctgaaagagattgtaaccaaatttcttggctggatttgaagcttaaactcctgtggattcacatccaataccngttcagttttgtcattgttttagtaaattagttccctttgtaaaagggttactctcatactccttatgtaccagaaatcacctgaaaaataaaggttccctaatgcgtaaaaaaaagaaaaaaataaa

SEQ ID NO: 586984 - DNA, 1191 bp, Homo sapiens
gggctggagaggcctggcgggccgctgctgcgggccagtggacggggtgcggagccggagccggagccgactgggctggtgtgcctgcactgtggaccccggcaatccctgcgcgctgcccacgattctgcttctgaggaacctagaaagattgtacaatgaatgtgtgattctcgtgctgctggtggtgacctcaccaacccccgaccacagcccctcacacggcgaggtcacttcgaccgagtagcatgagaacaacccagagtacttgaggcgagcaggaacatggcaccagaccttcgccaggaccttcaacactgactggacgcaaaacgacacgacgggtgtccactgacttctgcaacagcccttgctttctgtgaagaactcggacctcacatgactacacggacgcacatttacaacgaacggggcagacacccacaggccctatccggcattacacgccagattgcacgacttcctactgacccacagaaatgtacccaaactggtcttaccccaagacagactccgcaaggcagggcatggcctgccttacaaacattgagatctctggtatggtgacctcctgtgaaccgactctcacacggaatctgacttctactatgcgctactgaccaccggaccaccaccctactaccgcccgtaaccacagggcacaaccaatcaccataacacacttaaaaaacaatactacaaacaccacatcaacccacacacaattatacataccaacacacatactcacccacacaccaacattccacaatcccccaccaaacacacccatcccatcacatcgtcacccatcaagacacccactcacaccaccacaccaactcacctaccatccacgacaggcaccccagcacaccaccacccagccagcaacaatcacagcagcaaccggagaccaccaccccacacgggaaggcacaaacccagcgcacgccctacacaatacccaaccctgaaaacaaaccgcacgccgcatccaggtaacccacaagaacgaccacgacacaacaaccaccccgtacggagaatcgccgaccagagtacagctgccacgcgcaccaacgccaccacacccctcacacgcaaccagatatcaagcccactcacaaaccgagaccccacacaccaacaacaaaacagacaaccgca

SEQ ID NO: 586985 - DNA, 111 bp, Homo sapiens
ccttgtgatagctctctggagactgctgaagagtgtcaccatcagagacaaggtagagccaactttacaatgtagagcctgagagacaattgtagatgccgagagacaagg

SEQ ID NO: 586986 - DNA, 162 bp, Homo sapiens
ctagtgtgtacttatccaagtaaagtatcccctaaaggcacttcctatctgatttttcccagcaaataggcaggcattctagatcttccacaaaacatcttgcctctaaatggagagatgaatcattctacctgtacaaactagctagctattagagggttt

SEQ ID NO: 586987 - DNA, 182 bp, Homo sapiens
ccctttttttggggggggccccggggggtttggccccctcctggggttggcccccgccttgggggttgttttaaggggcccttttcccttttcccaaggggtcccttttagggggggggggggggttttttggaaaaaaatggaccccctgccccttaattttgccccggcccctgttttta

SEQ ID NO: 586988 - DNA, 647 bp, Homo sapiens
tatggaatacccagggtctgactagtttctggcatacagcaggggctgaataaatttgctgaacatgaatgggggcggcagattgaaaattcaaggacccccaaatgtctggtttgaataccattaactgagagagagaactctacaaaaggaacaggtttggagggatataagatatgctcagttttggacatgttgattttgaggtgctgtgagatttcatagcagaaatgtctatcaggaaactgaaaacagatctggggtttaggaaggagatctaaactggagatacatcgccagaaatagctatatttcagagctttgctcaatatttatatgttttttgcagtagagaatcatacataacttgatttttccaacttaaatgtatatcttgaagctttccatgttctttaatattcttttacattattttcatgattgaataatgttccattgggcaattgtctcatagttatttaactaattgtctttcattggatatttagattgctaacagcttttgtcattgagtgtaatctgtaatggacagtcttcagctaagacatggttctcactagtgagtaattcttgaaaagtgttttctagaagtggaatggctaaataaatgaacatacaaaaaaaaa

SEQ ID NO: 586989 - DNA, 685 bp, Homo sapiens
  misc_feature (491)..(491): n is a, c, g, or t
  misc_feature (612)..(612): n is a, c, g, or t
ggcggaaggcgggctgctcctcggggtgggggagggtatccggcttaagggggctgtggtggacaccgacttcttaatgtcgggggtcttcgcggcgctcacctcggctgcgtagggttcgggacggtacgcaccaggcacagcttcgcgccagaatggcggtacgggcgctcacggaggagtgaatccgcttctagtgctagcgtaaaggcactcgctgagggttgctgtgcgcgcgcgagagcaccgtctggtgactatgtagtgacttggtaggactggatgcttaggctgtggctccgctcgtcggttgacctcatggcgttcagaagcgagacggctgtgtcctatggcctttgtcacgtgcgcggcgtaccataatgagccatgtcttcctcgcgcaggaggcgagtctcagcctaatggtgaggaaccggtttcctgggcaggacgtggacgaagcatagctagcgtgtgcagactgagcacantacttccagtgctgtgctgccatcgtgtcgtatgtgcacggcatctacgcaaggctcacagagagggagagagtaagacgagaggaccgcgtggatgaactttgtcacaaggctcctatgnaatggggccccgtccgtatagcactgggttgtcctagcgcgaatcgacgatcctgctttacgtgctcggggac

SEQ ID NO: 586990 - DNA, 145 bp, Homo sapiens
aggcatccccacccggtgctccaccactgccgcacaactcttgtggacatcaaacgataaccactctggcgagtcgccgggtgccagcaagccggttgctgaggtatcgccaggaattagtatgctgtatttctaggtacacgct

SEQ ID NO: 586991 - DNA, 137 bp, Homo sapiens
atccattgccaaggttttgacgaactccttgaagtctggggcctcggccgtcttctgctggatcagggcagccccgttgagctgcggctgcagaagcggatgtagggctgcatgtgcggcactgtgcgctcaggctt

SEQ ID NO: 586992 - DNA, 577 bp, Homo sapiens
aagctaagcgcgtttgcagccgtctccttggtcctgtcaggacttctggggatggtggctcatatgctatattcacaagtcttccaggcaactgccaacttaggtccggaggactggagaccacactcttggaattacggctgggccttctacacagcgtgggtttccttcacctgctgcatggcgtcagcggtcaccaccttcaacatgtacacgaggatggtgctggagttcaagtgcaggcacagcaagagctttaacaccaaccccagctgcctggcgcagcaccaccgctgtttccttcctcctccgctgacgtgcgcaacccacgcaggggaacctttgtccagctgccatcagtaccccagccatcccatccgctctgtctctgaagctattgacctctactcggcgctacaggacaaagaatttcaacaagggatcagccaggagctaaaggaagtggtcgagccatctgtagaagagcagcgttaggagttaagtgggtttgggaagcaggctaagtcctaccataggtgtcgctcactatcaacatctgcttgagcaaaaaaaaaaa

SEQ ID NO: 586993 - DNA, 264 bp, Homo sapiens
ttcgtatggtgagtggatcccggtcgggcttgcagatgaatatacagtcgagcctcatattttctcatcagttctgcggtctcctccctatcgtcatcccacttaagactgtcactgatcatgtcctcgagctgctgctgtcttagctcaacgccatgctggatgccatcccacaggtactagaccccttaccaatttttctgctattgctgttctcatatctgaaccggaagctttatttttcaatttctgtgcccattgcaa

SEQ ID NO: 586994 - DNA, 163 bp, Homo sapiens
acaggagcgcgttcttaatctggattcgagctacacttgtgaaactgtcttcatgagactggctcatttattgtcctatagttctcctgcttgtacattccaaatgccgggagctcagagcatgtcatctgggccacacgcaacaagatagttgtaaatggcg

SEQ ID NO: 586995 - DNA, 397 bp, Homo sapiens
  misc_feature (174)..(174): n is a, c, g, or t
ggtacttaatagagcagaagaaaataaaaatgtaagaccttgtttagctgaaagacagtgttagatgatattttaagttataaatagctttaatccttgctttttcctttatcttgatttttgtgtggttttttttaggtgtgatataaaaatccttattagtaagtgtctggnagacaattttttgaagtttcaagctttgtttttacagggacctcttctgtgatcacttaggctttttttcaagtatacattttgatttatctgtttttcactagaaatgactaccctgactgccctggtaactttaaaggaggatttctaaaaatgtgatgaagaagataaagattatgtctggatacctaggtttgaatcatagtaaaggtttactaaaaat

SEQ ID NO: 586996 - DNA, 108 bp, Homo sapiens
  misc_feature (22)..(22): n is a, c, g, or t
  misc_feature (51)..(51): n is a, c, g, or t
  misc_feature (72)..(72): n is a, c, g, or t
atgacttgccccacagccatcntgggatgagccccttttcagccaccatgngttcaaattcatcagcattgnaccttggtgaagtcccacttctttgagatgtggatc

SEQ ID NO: 586997 - DNA, 318 bp, Homo sapiens
gcaagaatgaaaaagggctgaagcagtgcctactcgacagaaccggtcatcgtacaagaaatgccacgtgactcaagggcaagcagagtgcagcttggagcaagaagatgatgtctcactctgtcacccaggatggagtgcaatggcagatctcagctcactgcaacctctgcctcccaggttcaagcaattatcctgcctcagccacccgagtagctgagattacaggcctctgccaccatgctcagctattttttgtatttttagtagagcggggttcaccatgtaggcaggctagtcttggactactgacctcag

SEQ ID NO: 586998 - DNA, 389 bp, Homo sapiens
aaccaaatatcaacactgtgaagttgacactgaaatagacagagatcagaaacagaaaatctctctctccctctctccctgtctctctctctctctctctctctctctctctctctctctctcacacacacacacacacacacacacacacagagagagagagagagagagagggagagagagaggaagtggtatgtggtgaggcttatagaagggaacactcgatgtggggaacaggaagagagagaggggaagagaaaagaaaagatgtgctcccgggcccctatgttctccgtgttccattttctatagatctcttttttagatatttgtatatctatatgtgtgtgtgtgtcttcagagtatattttctgtgtgtggggctcctc

SEQ ID NO: 586999 - DNA, 80 bp, Homo sapiens
  misc_feature (2)..(2): n is a, c, g, or t
cntttctaacactgaaaaaaaggtcatttttgctggtataaacattaaggagcaacttttacattaggtcaaagattgtt

SEQ ID NO: 587000 - DNA, 698 bp, Homo sapiens
gacagatggaactagaagctagtctttttacccgatcagtttacactgcttagagccacgacatctgacacaagccgtcaatggtggcaagacagctttgaagctcaccgaccattctcaagacacatgattattcttcccatcactgtttagctccagctgcttgagtacagaaaccctacatttagaccctgtccgattagctgttgagaagttgaactgtggcccaagctcatgtttcttagtccgtgttcactgaataaagtccgattccggtttatgtatctgcttagtgacatcaaatagggtacgagcccatctttagagcaaccgtctttctcacgagcatgagctcaagtcttcgagctatcgactatctggcagaccccctcacaggacgtatccatgctcttgataattatacttgctggaatgctgctaggttctcacagtctgaatcagtgtaaactttctcagggttatagcagtaaccttatataaggtaccaatcttcaagacgtcctagtgcagcgccctctttaggtaacgtatgtgttcatgtacttagtaggcacagggatgatagctgcaactgtcattctcagtataccgacacatggactcgataccatgcactccatggactactcataagtgggaggtcgactatggtacatggacacagctagtttctatac

SEQ ID NO: 587001 - DNA, 1562 bp, Homo sapiens
  misc_feature (462)..(462): n is a, c, g, or t
  misc_feature (753)..(753): n is a, c, g, or t
  misc_feature (1021)..(1021): n is a, c, g, or t
tccaggcggccgggaaaatgggggactttcagaacgtgagcggtgccttaccaaaagcagccgaccatctttcaaaacaagaagagggctccgtgcgtgggagaaaacgtggcaaggagaaagcctcccggcggttactacaagaaactctcggctcgtgggcttcaagaacacccagagggaggctattgtggagggccaccttacttgtgacagagaaaatgtgcccctttcagcgtggtctaagtggtgctccattctcgaaggggcggaatccctcttcgtggccggtggtgtgcaccaagaattgaaagtagtgcagaagcgcacccagtgtggtcactccgcccgagagaacttattcgtgcgacttacattcgcgcagagttcacacacgcggttctcgagagaagaggcgcccaaagagacaacctgtgttctgtggtaccacctgtgtttccnccgtgtggcttctcgaggggaagcgtctcccaagaaactgcgggtgtgacacctatgcgtttccacgagtgtgggcgcccgaagtgtggccgcgaggccctcgtgagaaggccaagacacgaggtgggcgacatctacaagcgggtgcccctcaagagcgggtcccacccaagaggggctgtgtcgcgggaccaccctaagaaaaagacgagttctcccgacagaaaaggtttctccgtgagagggggcgttgggccagcaatcttctgcggcccgcccggctttcccccnccaaaaaaaatgttgggacaacatacttaaccgccgctttaacttatttccttcacaattttcccccaaagaaaaacaacactacacataaactacacaccagcaccactcacaaacagacaaacaaacacacctcgcgggacggggcaccatcatatattacaggcggagcggggcgggggcaacaaaccacaagggggttttaacaaaaacatggcggacccaatgtgtgctaacaacatagtgttgttttcctctgagcaccccncagtctgttttttgttgaacccaacaagtcgggtagaaaactatgcgcgggaggggacccccccaataagaagagagacgccaggtcataacaatttggtaacaaaacgcacgggtaacccttttattactatctattcacgttctaacaagaacaggcagactagctgagcaccagatacgagatacgacgcagctcatagcactacaagagtagttacatcaccaactatgtatgtacataaacaaaaactcatgcggtcggcagacacaacatatcaccaaaactctaatacatctatcataataatatatataataaacaaaaaaataaacactaacacacaacagatacatcacatctatgacattacaatcatcagcacataccaaaaatcaggaaaacgaacacaaaacaaatacaaactcaacatactacataaatgcattacaacctaaattaataaaagttgaatacaataacactcatcaataagcaatgaacgatatcattccattatcgtatctccttcatctcaata

SEQ ID NO: 587002 - DNA, 6968 bp, Homo sapiens
  misc_feature (5108)..(5108): n is a, c, g, or t
  misc_feature (5114)..(5114): n is a, c, g, or t
  misc_feature (5186)..(5186): n is a, c, g, or t
gaattccgtctgagtggcgctcgcggcggccgcgccagtcgcgtcccccaccccaacccccaccccaacggccgcacgcgcgcggcggacggacgggcgcggcgcgtcctcgctcccgctcccgtcccggctggggcgcgtggccgtgtccgccgcgtgcgcgtgctgcgtccaacggcctcgcggggcaggagtaagccgcggccgccgcctgggccccagggcggtctctggggccaggggtcccgcgcccagcgtttcccgcccgccaccctctccgccacgcgcccgcggcaccttttcctcccctggccaagggatccagtcggttcggaccagaaggaggctttcgtttagggtgggggcagcactaaagtctgattggagtcttgcggtccgcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggtgggtacggctatcctccttccttagcggcccaaggcacgggtttggagagcggggtcacaggcacgcacgggaagggcggggatttgttgacgccgggccctctgactccgagctccccgcttcccaagcctgtttttagtctttgcccccagagcacttgtccctcggggcagtatcagcctcaaaaggccacctgccgagaaggctgcagcggcatttgtacttgggctagttctgggcttccagggagacaagggttggaagtgggaatgtgacaaaggaaaagggtttgggcttcctttctacgtgtacttgtacaggccctgggtagatgtgccgccaccgtagcttctggaaaaaagtagggaaaacgatgagtaagtgcaaatgaacatggactgtgttcctcatcgggtttgaatctcagattgctgatgggaaattcccgccagcgggaagttaggctccggttttagacgttgaatttttttttctctactttttttttaattggaggagacttttgcagaaagaccttgagaagattcactttatagttgaagggaatgaggtgcaaagcgacgaatttaagatctcactagcatctgtgggttaaaatacggaattggaatagaaaggttggcgcccagttacagtatacatttggacctctgtggagcgtgtcatgctggatgaattactggtgttggagatgtgttggaaaaaacaactgtgacagtcgagatctgtggatgaaagtttgtgtacactccgtttatttagcatttactctgctgggttcttgtgtatatgcagaaacaagatgcttttcttcagggactggagcttatatttttctagtagttaccatcttttagattatttaaaagccaacatactccttggcttagtgaaataaatcttctatgttatagaaacacttctataaacataaagatttctataatcgtgttctggaaaccctttctataaacatgtttctataacagtattataataatctataacagtattataataatgttccaagtaacatttacttggaactttgctggtgtggcgattccggttacttgcccttacagactggttactatgaatagcatttaactagactaaagttgagcaatttaagttgtcaaatgaaaacactagaatgacctacatttaaactgtttaagcttgagtccagctaattttattactgcttgaggcaaaatagaatgaaattaccttacacattattgagggaaaatttcgttagtttctacttaaaatattaaaaaaatacagttcttggcctcaggcaaatggttatcacttgggcaggaacatgaaaattacgtgattatttcacaaactggtgctctaactgattacttgtgcatttatcaggaacaagtgaattgaagcaaattgtggtaatgtaaggcttggcaaggctgccctacatccctaccaagtcatacgtcagttttgttggagctgcttaccggtacaaaagtctaagcttttgtacctcttacaggtagaaaagtagagagttctttgtttaactcagtttgctgttcctgagctgacactgcaccaggggaacattaggagattttggtaatgtttgtttgtgacctacttagagcagtttttgttttgtaacttatggtttttttttttcccactcgttctagtattttgcatagaaagtgaacggcagaaggcagttttaagtttttgtaaaagtttgtgaattttatatcgtccttaggactgatggggctagtgttaaaagataaaatttaacataaagcttacatttgtgactaaagccaattttatattttttttctttatttttgtcagtctgataaaactgcccacttggtcttttaacattttgcaaattgattttttttttaactttcagaatttaaataggcattgtatgtttgtttaattatattgtgctttggcttccttggacgaaactattactgactttacaaagaagaatggataattgtggaagtaggtaggtcaaaaaaaaaaaaggaaagcctcgcccgccccccagtaatttgtcaaaagcaagtgggaaaaatctctggtagtgcagtactgcccttccagtactccagtacaagccctggagttgaatttagattcagcaactattatcttacatgtagttggtgatcacaatgtggtggcacactaggtttataattttatatctcagaaatcagctatttacttttttttaaaaaagtattcttggacatcctgtctgtctttagttgggaaggtcaagttgcaagccaggtgatagggttaagagtaggaataattcacacacacgaatagtgtcttaatattctgtcttacaaggtggaaagcaatttcaaaaaaattgcccttacagcctgtagcttagtaaataaggtctttaggcgactttgtgatagagtccctcttctgtcaggtggccagtctgtcatgtaataagctcttggtatgtgtgttgtatcttaggtacttaatcaaaagtaaagattaaagatgattgacagaaatttggcttcctggatggtatacacatctacttagtagggatgtaatctttggtggctattaacttcactggctgtataaagcatcattatgtatttgtgtaaccttttgcatatttagagagtgctttcacacatctttggtattaccatacttttactaaaaagtgaattggagctctgaaaccgaattgtcaaaactattttgaaaagcatgtggtacctaatagggtactatagccagcttatttccttaattgaaaaatcttagagggattttgaatctggaatgtatgaatgtgacacctgcctgcccttgccagttctcccatatgctgtttatgcaaagccatagcgtgtgcttaagtacacccttgtttctgcactgaggttgcctagatttccctggagtgtatccacctgtcttgatctgtttaagaattttgcggatgagcattagtattaactgtaacatatcttttcacgtgatgagaaagaacaaagatttttttaaattgtgaacctgagtaggttttaactttggagtggggaagggatacactaagataaaagatagttgttaagtattctgattcctgaagttttttttctttcaggaaaacggtatttttgagataaagtaagatttgtggaagagttgcaatagagaggtcttgaatacccattatccactgttaacatcttatgtaatccaagtacatttaacagaactgagaaattaacatcgataaaatactgttaatgaaagactttatttggatttccttagtttttctactaatgtcctttttctgttctaggatccagtccaagatgccacattgtatgtagtctcctgatctgtgtcagtttctgtctttccttttgtctttcgtgaccatgacacttgatctcatttggatttgatgttaaggattagactgaagttacagatttttgggggaagaataccacagaaattacccttatcacatcagattgggggtccataatatataactggttgaatttaacctgatgatttggttcaggtggtatctgtcaggttagtgtttttttcccctttagatactattccttagatgctagtcaccaagtccagctcacactcaaggagagaggggaattaggctctactttctagagggaggagaatgtgaatttgtggaagtatattaaagctactgttattattttgggggagatgcttcgaagccatggaaataaagttcccctccttaattttagcattttaatggatctcgtctgcagctattattacttcggggttctaatggtgattttttttattttcctcattccttctacagtataaattttctgtgaggaagatttgtgtattcttcatgttttttctttttttcatttatatcactatagaccacggatattaattttattctttgggttgtaatccacaattatccttgctgatgtttacttatttttgattattatttattttatatttttataaaatatcgtccaggctgtctcacactcctgggctcaagcaatcctcttgtcttggcctctcaaagtgctgggattacaggtgtgagccactgtgctggccacagtttattttgttgttcatgttgttccagcttttttttttttttttggctcctttctccttttgacacttccctatcttatctgttttttaaaagcatgttttttctttcattaattaccaggtatttcaggctcatcttgcattttgcctgtctcaggtccagaatcaaccatttctccaaggaggcgtcaggaagaattgtgaagggaggtgacaggtggtaaatgcgaagagtttggaaaaatagattgacagtaggcccagtgatgttgatacttttcttgctctgagcacagatgttggcttctgtattcatgttactccagttctggnaaaagnttttgtttctaaattcccacgatttagagaaccagatatcaaatgtttgaatacatgacataatcctgaaanaaaatttacaaaaatttaatatattctcaagttagtacacacaaacacttgctgtttttccttggtgtttttgacaacttttttaaagtaaaaagaccacttaaatactatcgtactcagaattaacatttgacattttgcattgccctctaagactcctttttttctatacgggcttccattcccttccttccagggatctttttcacatctttccaggctgttttattgatggggaatttttaaaaatagctttattgaggtataattgacaataaactgcatgtttttaaaatgtactgcctgataatttcagacaccttttgtaatcccagcttctcaaaagactgaggcagcagagaggattacttgagcccagatgtttgagctgcagctgcagtgacctatggtcatgctacgcactccagcctgggcgacacaggagactcttaaaagaaggtatacccatgaaaaccatcaccacaatcaagattgtgaacctatccattacccccaaaagttttctcatgtcccttttccctctttcttgcttgttccttctacccttctccctgcaggaaatccttgatctttttatcactgtagattactttgcgttttttagaatttttttgtaaatacattatgttctttttttaattgctcagtgctagtctgttgtgtaggcatatcacaattttttggtttacctgttggtgggcattgaaaaacggcaaaagctgtgtgtttccagctttttgactgttacaaaataaagcttctgaactttgtgtacaagtctttgtatgggtatacgcctttatttctcttgggtaaatgcttaataggggaatgtttagatcatgtagtagatgtatgcctaacttttaaagaaactccctgttttccacagtggttgtaccattttacattgccaccagcgatgtttggggggttccagttctgccagtatgttggctaacagtgtgtatggtcagtctttttaattttagtcattgtgacaggtgtttagtggtacctcacaggttttaatttgcatttctgtaattgctagtgatcagcatttttcatttggcattcatataatttctttggcgaaatatctttaagtcttttgctcatattttatgggattggttacttaattattaatttttttgttttgagacagtgtttcgctcttgttgcccgggctggagtgcagtggcgccatctctgctcactacaacctctgcctcctgggtttaggtgattctcctgtctcagcctcctgagtagctgggattacaggtatccaccaccacacccggctaatttttgtatttttagtagagatggggtttcaccatgttggccaagctagtctcgaactactgacttcgggtgatctgccctcctcggcctcccaaagtgctgggattacaggcatgagagtactttatatattctggatagaggtattttaaaaattagagatatgggtcaggcgcagtggctcacacctgtaatcccagcactttgggaggccgaggcaggtggatcacttgaggccaggggttcgagaccagcctgggcaacatagtgagaccttgttgctactaaaaatttaaaaaattagccaggcatggtagtgtgcgcctgtagccccagctactcgggagggtgaggtgggaagatcacttgagcccaggagttagaggctgcagtgagccatgatcacaccactgcactccagcctgggtgacagagtgaaaccctatc

SEQ ID NO: 587003 - DNA, 713 bp, Homo sapiens
gcggcgcccgggatcctgtgtagcggctgcagagggtgccgccgccctaggcgaagtagggccgtcctgagcgaaagaaccgcccccagcaggagcaccaccacggtttagcaaagaatcccagaccccgcccgggaaggcagccgcaccatggagtcttccagttcatctaactcttatttctccgcttggcccaaccagtcccagcgctgtcgtgctcctctactcgaaggagctcaaaaagtgggatgagctttgaacgatattttagaagagagcgaggcatgtcacgtgacttgaacatttgcacactgaacatgctacacacctccttgtctactaacgggaattacctccatgtacaaccacattgactacttaaactgtacgctgtctctcaactatctgacggagactctcacttactgctcacttacaacaggctttccaaggaactccccttcaactctgctgggactgctccctccgcacgaggacagttgacgtgagaatcttacactgcacactgagtccaccacactggcgctcttggagccacttcgcgcctctcgtgcccttcacccttgagcacaagtattcacaacaaacttatatctcgaagcgctgtgctgtacactgaccgcacggtacttcagaacacctaccaaagcagccactccaggaggcatcctggtcgttctgctggcctatca

SEQ ID NO: 587004 - DNA, 196 bp, Homo sapiens
gcttaatgctgtacctaatggcgttacctatatgctgttacctaaatggctgttacctaaatggctgttacctaaatggctgttacctaaatggctgtacctaaatggctgtacctaaatggctgtacctaaatggctgatatggctgtgacctaaactggctgtacctaacatggctgttacctaacatggctgt

SEQ ID NO: 587005 - DNA, 186 bp, Homo sapiens
  misc_feature (31)..(31): n is a, c, g, or t
  misc_feature (98)..(98): n is a, c, g, or t
  misc_feature (125)..(125): n is a, c, g, or t
  misc_feature (152)..(152): n is a, c, g, or t
  misc_feature (159)..(159): n is a, c, g, or t
  misc_feature (161)..(161): n is a, c, g, or t
gcgctcccctccacagccttctactcctcanttgacctagggtccccaagccttgccatcaccccggggcctgctgcagaaccgtggcctcaacaatnacagcctgagcggaggcgcaggctggncatggcagctgaccaacatcagccggnacgactncntcaagaagatcgacagccctacctt

SEQ ID NO: 587006 - DNA, 656 bp, Homo sapiens
gcggtctgccgggagtgctggcgtgcggccccggtgagctgccgatcggtgccgggacaaaggcgcggccgcccggtgcctcttcagcagccctgagcctggggcgcacagccggggcgcagcaccgagccacaccgaccgcgattgacatgatgtttccacaaagcaggcattcgggactcctcgacacctaccccagcaactcaaattcaccacctcggactcctgcgatcgcattaaaagacgaatttccagctactgcaatgctcagtaccacagcctcaagctcgaatgtgacaagttggccagtgcagcacagtcagagattgcagcgtcacctatgttcgacattgtacctacgagcatgtcctacgggctttgaacatcggagatgcacaaacaggctgaagatacgtcaaaacggcctgaacaggggaatttggatgcccaagggtccttgcccttaaccttctcccaagaagacaccagcagcagagtcttgaggagacccatggaagagggcccaagtacaagggtaacacgattccaccgaagctttgaagatctaatcaatccctgaacaggcagactcccaaggcccaaacaagactgtacccaacttgtaagggcccttggccccttgccctttgaccgag

SEQ ID NO: 587007 - DNA, 427 bp, Homo sapiens
atcatgtagcgcgtcccttcagtcaacatgttgccctgtctgacagctcatgatgtagccctccctccagacaagcatgtagccctcgctgcagagcaacatgtagcgctcgcttcaggcaagcatgtagccctcgctccagtcaggatgaagcgctcgctccagccaagcatgtaacccaccctccagtcaacatttaagccctcccttcagtcaacatgtagctcatcgcttcagtcaacatgtagcccacgctacagacaacatgtacccctctctacagtcaacatatagcccctccctccagtcaacatgtagctctcccttcagtcaacatgtaacccacccttcagtcaacatgtaacccactcttcagtcaacatatatcgctacgtacagaaaagatatactagactcgacatgcatg

SEQ ID NO: 587008 - DNA, 443 bp, Homo sapiens
agatgagcaaatcatgaaccatccttactcatacctagtatgaaacaacattgcgcagaaacgctagtcctccccagtaaccccttatcatcatattccaatacatgaaaggcatcaagtcagctttcatgagatacatggacaggcgctctttgctttgatcaaaggggaaggtttctatcggctctgctttgtagtcaaactcagcaagaatcacacggttgtagccggtcaccagtggacatgatgtgtagccatcatacttctttgttggtgtttgattcttcataattacagaatttgtcctatcaagtattcctgactgggcagttactgcagcagcggtctttgacgtaggaaggttggtgcagtccccaatcccaaacgcatttgggtacctcctgtgttgcagagtttctttatccacatccacccaaccagca

SEQ ID NO: 587009 - DNA, 156 bp, Homo sapiens
  misc_feature (18)..(18): n is a, c, g, or t
tctagcgctacagggatngcctttgataggggtcggtcccagaccacgcccaagggggtgagagcgcctcacagcatctgagtgcagatcatgggggtatcgcgcttgaatagctatataaagggcgcgggcgggattgagagagaaggggttttt

SEQ ID NO: 587010 - DNA, 1060 bp, Homo sapiens
  misc_feature (102)..(102): n is a, c, g, or t
  misc_feature (104)..(106): n is a, c, g, or t
  misc_feature (118)..(118): n is a, c, g, or t
  misc_feature (194)..(194): n is a, c, g, or t
  misc_feature (211)..(211): n is a, c, g, or t
  misc_feature (213)..(213): n is a, c, g, or t
  misc_feature (218)..(218): n is a, c, g, or t
  misc_feature (256)..(256): n is a, c, g, or t
  misc_feature (270)..(271): n is a, c, g, or t
  misc_feature (298)..(298): n is a, c, g, or t
  misc_feature (573)..(573): n is a, c, g, or t
gcgtggtgctgcatttccggtagcggcggcgggaaatcggctgtgggagagaggctaggcctctgaggaggcgaatccggcgggtatcagagccatcagaancnnncaccatgacggngggcaagagcagcaagatgctgcagcatattgattacaggatgaggtgcatcctgcaggacggccggatcttcatnggcaccttcaaggcttntngacangcacatgaatttgatcctctgtgactgtgatgagttcngaaagatcaagccnnaagaactccaaacaagcagaaaggganagagaagcgagtcctcggtctggtgctgctgcgaggggagaatctggtctcaatgacagtagagggacctcctcccaaagatactggtattgctcgagttccacattgctggagctgccgggggcccagggatcggcagggctgctggcagaggaatcccagctggggttcccatgccccaggctcctgcaggacttgctgggccagtccagtggggttggcgggccatcccaacaggtgatgaccccacaaggaagaggtactgttgcagccgntgcagactgctgaccacagacagtatagccggggctccaatctcagtacccacctgcgccgtgggggtcttcccccgactatgggccgatggagcaccccctccaggcatgatggggccaacttcctggtatcgagagctcctatgggtaccccaatggggatccccccttggaagagggactccaatggcggcatgctaccctccgggaaacggcgggcaacctcccgcacagcatcgcgacgagaccccctccgcctgacaagatcccaccgcgccaacgggcccacaacaacgccctcactgagaccctacaccatgacgcaccccccgcccggagaacccgcaacacggccgccgcaaaacacaccaaccagagccgccacacagaagcggcgacaacacaaccaggcgaacacacacgaccaacccgaaggcgcacaccggatcgaacacaacacacacgacacgagccacagacacgcaga

SEQ ID NO: 587011 - DNA, 887 bp, Homo sapiens
gccccggcccggtggaggctgctccggaccgggacgcagagtctgcgtgacccggcgccgaggcggcaccgagacgcggcgcgcacgctccggctgcgcagcccggccggcatgggggccccgcccgttcccgcgatctccgttcggtctcggctccggctttttacgccccgagaaaagttccggccctgtggtggccccaaaagcccaaagtgaattccctaccggcccgaggaacagcgagcctcccccggcaacccgggggccccaaaaagcagcacagcatggggccgggtgaagccaagaatacaccacggacaaacacacgaaaagaaaataaaaaaaaaaataaaaaaaacacaaataaatagacaaataaaaaagaaatacaaaagaagagcacaagaagaaaaaaagacatataaaagagaaaaaacccaaacacgaaaaaaagacaggaaaaggaagacaaaagaagaggacgaagacacacaacgacaagcacaaaaggcaagccaaaaacaaacagcacaagcaaaacaacaaacgaaaaaaaagaaaaagaaaaaaaggaagaagccacaaaaaaagcaaaaagagaacagaacacacaaaagaagcgcagaagccgacacaaaaacaacaaaaaaaaaaaaaacaaaaaaacaaaggcacgaacaacaaacaatacagaaaaaaacacaccaacaagaagaaaaaaaataaaagcacaacacacaaaacgaaacaaaaaaaacagcaaagcaacaaagagaacagcaagaaaaaaaaagcagaaaaacaagaaacgacaaaagaagcagaccaggaacaaacaaaaggccgaacgacaaaaaagacagaagaagaaacaacagaacggacag

SEQ ID NO: 587012 - DNA, 237 bp, Homo sapiens
tttaatttcccctaaaagtaagtagttgctcagaaccatgggttggatgtatgggaaatcatattgcttctgtgaaaaaatgtttagccaggcattccactacaaacgccatgccatatctacctagatcttgatatctgggtacttagtattaccaagagaacttatcaaaagcaaatggttaagcaaacaaccaaataggagctcaggtcccttaatttggatagtcaactaagt

SEQ ID NO: 587013 - DNA, 379 bp, Homo sapiens
gactattccctatagcttctgcataatgaattcactagaaataactctgcaagtagcagcaaagttaatacccccgaaatccacgacgagctatctaagaacaggtaaaagagcagacccgtctatgttgcaccatagtgggaacggtttactcggtagaggcataaacctacctgagcctggtgatagctggttgtccccgatagactcttagttcaactttaaatttgcccacagaaccctctacatccccttgtaaaatataactgttagtccaaagaggaacagctctttggacactaggagaaaaccttgtagagagagtcccaaatttaacacccatagtatgccaagcagtcgtcggcaaccggaggggact

SEQ ID NO: 587014 - DNA, 144 bp, Homo sapiens
gccatctctcgcctctgcgaggacaagtacaaggacctaagaagatccgcgaggaagcgctcagccagtgtcaggacaacccttgacttttgccccggtgggtgccccagcccatcaatctttttgaagctaacgggagggccc

SEQ ID NO: 587015 - DNA, 339 bp, Homo sapiens
ggggggggggggggttttggggggggcccccccctttcccccccccttttccccccccccccccccccaagggggggggaaaaccccccgggggggggggggccccagggggggggggttgttttttttcccccaaaagggggtttcccccggggccccctaaaaaggggggaaacccacggggggttgttttggaaacccccttgggggggggttgggggataaaattttttttttttggggttgggggggggggggggggcccccttttcccccccccagggggtaagggggggggcccctttttttttttttttcccaaaaaaattttccccccca

SEQ ID NO: 587016 - DNA, 725 bp, Homo sapiens
ggtctgcaggcgcgcgctcccgaggtcccgcctcgcccgctgagccggcctgtaagcgctgcggagattgggctagaggcggaggcctgggccacggcggaggcgctgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccgggagccccgtaccagccccagaggaaagaagcacgttccctcagctcttaaggaggctgacagtttaatgagaagagacacatgaggctttcgagccatgagcccaggaagtaagttggtttttctagtagggatgggagtaataagagctggtgaataatggagccatagatctgagttcaaatccc

SEQ ID NO: 587017 - DNA, 265 bp, Homo sapiens
ctgctccgcccctctctgccgagtctcaatatctgtcttcggtggactccttcgggagtacacccaccgtcgacgcctagcaggagtgcgccggactcggggaaatgcccggttccttcgtgcccacggacaccgcgatcacaaccagccaggacctgcagtggcttgtgcaacccaccctcatctcttacatggcccaatcccaggggcagacactgacctgccagcccccggacgtagacccctacgacatgccggtaaccag

SEQ ID NO: 587018 - DNA, 1098 bp, Homo sapiens
ggtctgcaggcgcgcgctcccgaggtcccgcctcgcccgctgagccggcctgtaagcgctgcggagattgggctagaggcggaggcctgggccacggcggaggcgctgggtacgtagcgcgccacgcgggccggtgagagccagccgggcgccggggagggggcgggccctggccgcggctgctacgcggggctgccaccgccccgggcgacccaatttcgcggcctagtggggcgtacgggcctcttttgaaagcctgagttacgatgtattgagcgcgtcgtatgcggccagcactagggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcaccgtgatgcggcggaacagcctgaaccgcaaggacgcagaggcccgcatcaatgcccaagctgccctgacagacaaggcccgcatggccgccatgtctaagacaactcgggcgaagtggagtgtcaccaaaccgccaggtcaatcctccttgcacactgagctggagcgcttcctggagtacctgcggctgaggttggggtcctcacagggctcgctggccttggcagcttctctacttgttccccattaactttgg

SEQ ID NO: 587019 - DNA, 1002 bp, Homo sapiens
  misc_feature (368)..(368): n is a, c, g, or t
gctgaaccgtgcggtcgaaccctccgtgtgtcccgacccaggctaagcgttgagcatggctgagcacgggtagcccacagcacgatgcagctggcccagattgcagcggcagaactgacggaggatgagcacctctggtcaactacagaggccccctggcccatgaatgagcatccagtgagatccaggcagctggacaaggacgacgatgagcctgcgaaggtacataggaggcccgtgtctgggcctgcgtggccgtttccagcatgacccctagacgtcccacaaccgtcgtgtgtgacgtgtgcctgaccgcttgtgtgttgcagcgtcggactcccgagtgcactcccctggtagtctggacnctgatcagtggacgaccttgggagcagtcttctagagagagcaagatcgattgtgtgctagagacgcgaaggggtgctcggaggttagccgtgacttaaggagaatcatcttctaccgggtggttacatcactgcacggaaagagtaagggtgttcccgtgtcattgtagaggttaccagtcccagcgaattagcagtagcaagggtatagaccgggcagtcacatgactttgagcgaaagaagcttgagctaacactaggttacgtgcagggcctattgagggcgcccaggggcccggatgggagtagcagaatgcttccttgatccccccgcgttgggcacggacgagtcgactcgcgaagggcgatattgcctggggtccccggagggccatagcttaacaagacattctaaggtccccggctttccacgggaagcggaacggaacataagaacccgcgagcgagtccttggtccctggggaagggtgggacattcctcgaacccgagtccaacggaaaagcgaccttggtaaagggaccttggaggccccatggccaagcaggcgcggagcgaggggtcaagacttgaaccgggaacgggaacgaacgggacagagcgggatggtgcacg

SEQ ID NO: 587020 - DNA, 223 bp, Homo sapiens
agtctgtaccgctgatccgcttagcattttgagatgaggtgattatgcgagtaatcctgtggtgcccagtgtaaacatgagttcttaagagctacagtcagtgcccgggtgctggtggctgacgcctgcaatcccaacactttgcgaggccaaggcgggttgattgcttgagcctgggagtttgagaccagcctggtcaacacggcaaaaccccatctctacc

SEQ ID NO: 587021 - DNA, 937 bp, Homo sapiens
ggcacgagggttcgatgctggtttagggtttcaggcgtggaggttccaaaatccgaggtttgatttcagcctgcccttgccagtgcctgggccgctgggagccgttattggctgccgttaaggaccgttacgtttcccgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcaccgtgatgcggcggaacagcctgaaccgcaaggacgcagaggcccgcatcaatgcccaagctgccctgacagacaaggcccgcatggccgccatgtctaagacaactcgggcgaagtggagtgtcaccaaaccgccaggtcaatcctccttgcacactgagctggagcgcttcctggagtacctgcggctgaggttggggtcctcacagggctcgctggccttggcagcttctctacttgttccccattaactttgg

SEQ ID NO: 587022 - DNA, 214 bp, Homo sapiens
gtggagtacatggcacctccaacatcacaggatcgagggcgtctgacagggactgaatctcctggtctcccacagtggtatgggcagtggcttcggaacattaaacagattctcttctttcaaggggccaggtaaagatgctacttccccatgtccattattctcaccatcacagaaacccaggtatggggcaggccaggcggactggccccct

SEQ ID NO: 587023 - DNA, 152 bp, Homo sapiens
atccacatacacccacgtactatcagccatcctcatccaacgcccctgaagatccacctgtcacaatcattctcataatcgcccacgggcttacactcctcattactattctgcctagcaaactcaaactacgatttgaccttgtgcgtgtg

SEQ ID NO: 587024 - DNA, 918 bp, Homo sapiens
  misc_feature (912)..(912): n is a, c, g, or t
ggtctgcaggcgcgcgctcccgaggtcccgcctcgcccgctgagccggcctgtaagcgctgcggagattgggctagaggcggaggcctgggccacggcggaggcgctgggtacgtagcgcgccacgcgggccggtgagagccagccgggcgccggggagggggcgggccctggccgcggctgctacgcggggctgccaccgccccgggcgacccaatttcgcggcctagtggggcgtacgggcctcttttgaaagcctgagttacgatgtattgagcgcgtcgtatgcggccagcactagggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccgggagccccgtaccagccccagaggaaagaagcacgttccctcagctcttaaggaggctgacagtttaatgagaagagacacatgaggctttcgagccatgagcccaggaattactggtatatctgcagggcttcgaggcggcagtggctctccccttctgaaattaaacatcggataatgtcnccagcc

SEQ ID NO: 587025 - DNA, 350 bp, Homo sapiens
ccccggcctttttgtaaaaagtgtggcaagccccccccccataaagtgacccagtccaaaaagggcaaggtttttttgtacgcccagggaaaacggggttattacaggaagcaaagtggctatggtgggccaactaacccgtttttccggaaaaaggctaaaactccaaaaaagattgtgttaaggcttgggggggttgggcccccctgcagatttaaaagaatgctggctattaaaaaatgccagcctttttaactggggggagataaaaaaagaaagggcccagtggtcccgttttaagggtcctttttttttatgaagccaataaaattttgggtttttgttcccca

SEQ ID NO: 587026 - DNA, 278 bp, Homo sapiens
  misc_feature (58)..(58): n is a, c, g, or t
tcttgtactgtcgcccaggctggagtgcagtggcgtgatcttggctcactgcaacctncgcctcccgggttcacaccattctcttgcctcagcctcccgagtagctggaactacaggcgcccgccaccatgcccggctaattttttgtatttttagtagagacggggtttcaccatgttccccaggatggtctcgatctcctgacctcgtgagctgacagttttaaaccttttgttgtatgcctactctagttgtttcccttcagtcctgtctataaa

SEQ ID NO: 587027 - DNA, 649 bp, Homo sapiens
gggaacttttgaatggttgttccaaaaggggtcccctgaaggggatctgtgagagaacgtgttcccacagtatttccacgaacctgagtcgcctgaagctgctccacggagggagaactggaacgcgaagcgcgcgaaggtctaaagggcgccacactgggctgaacaaacctcgctgaagcggttctcttcgaagacctgttggaaacaggctcacgcaaaccgtcaacacaagggctccccgagcgagtgagcaccactgcaccgcctggagaccaagctgtggtggctctctgtcacgggacccacttatcgggtaactccttctggggcttctcagcctccactcgccacctgggggctcatcactggcctccctcgcgtccactggtcctctgtctgtctcctcctgtgataacctgggagaccacgagtcccctttagggtttcccggagcttccgggaaggacccgcccactcccacggactccacagatgccacggggccctgctgcccaacaagcaaggaccagcatttcctcgagaggacacctgggcttacctggggggcaggatgcctggggacagttcaggacacacacacatggcccgcaactaaagcaacaccccttcaaaaaaaaaaataaaa

SEQ ID NO: 587028 - DNA, 130 bp, Homo sapiens
gcaacatgaaattacagttgcacaattttccttacgcagatcagctgtgtgtcacgaaatagtcatgcatccaaggccttcccttacagttcctctcctcctgtccctctccagctggtatactgctcgt

SEQ ID NO: 587029 - DNA, 762 bp, Homo sapiens
  misc_feature (244)..(244): n is a, c, g, or t
  misc_feature (301)..(301): n is a, c, g, or t
gggcgcccggttgcagcgtggacgccggatgagatgcttttaggcttgctggcccgcggggctgtccaggcacgcgaggcccctcagcaacaaaatgcttcaacaagttccagaaaacataaattttcctgctgaagaagagaaaatcttggagtttgggactgacatttaatgtgttttcacggaatgcttaaatgcaatccaaaacatagaacccaaaatttacccttctatgactggtccntcctttgtgcaacgtggatctgccctcactatggaccataatactttgcggggtacnaattaacagatattagttacagagatatgcgtcaccagaagtgaggtttcatggttgacgagaagatttggactgggattgccatgggcttacctgtgcgaatatcgaaatggatcaagacacttgggcaatcagcaggaccacgaggatgtgggccaaaattgggagattaccagagtattaacaatcagtgcctgagcaaattggtgatgagatatttctgctggagtggaacgaaattacagcaagacatccccagtgaagactttgaatcatgaagacttgtgtactgtaactgtggttaccaacaaacagcagacttctaggcatgtacttatcaaaggtggtacggtcagaccttccctaattacacctatcccctacaacttacatgcacatagacacacacatgaacacactgaagatatttccttcaggtgtgtgtacacatatgctggctg

SEQ ID NO: 587030 - DNA, 1030 bp, Homo sapiens
taataggctgatgctctgaatgcctagggagttcaagctggtgttctgtctgactgtcactgaatgcctttgtagtagctggctgagatgcgagagcacgatcactctaacctacaatgggcagaataggcaatggttcggctcctggctgatcccagctgctggcctatagctgtacaggactacagatatctatctactaatatgatttcatctcgccgttgtcccattctttgtttgcggtaaatcagtaagcggttccctactcaagtagggatattctcctcaatgtggttgggattactaagtgaattagcgtcaatgaaactcgcaaaagagcactcttgaatacctaaggttgtgcatatccaagaattagtgcctaacatgcgactctttctacccttagactagaccctagtgactcacctaacatttaatgctattcctccgacctacgacttctgcagtaagtccctggcgtgtagcaattcagtttgtccaagcgccgtcccgtaattttatctgttcttagcctctgttgctgggaggcacttgcgacaccgggacatagtgggacacgatttctgcaattacaacaccttgtgtagttcgaagcggcaattcggacgaatatcagagtattcaatcctcgccttagcatgattatatcctacactccaactcaatgagacccacaagcaagagtagcccttctaaacgctaatccaagcctcaccccacatagctaggcctcctcctagcatgcatgcaggcaaatcagcccaattaggttcttccaccccggacttcccgcgtcagccatagaaaggcggcaaccctagtctagaggcctactccactcgaggcgacgtataagattgtaggagggagtcttcttaaagcattcggttcaccccccctagaaaattaattagccataggtccaataattcttgacaatgcttaaagagctatcagcactctggaacgcagacagtttggggccttttacagaagacttttaagg

SEQ ID NO: 587031 - DNA, 791 bp, Homo sapiens
ctcagcacgtactgtgcctgcccccccgcaacgtgacccttctgcaggagagggcaaataagttggtgaaatacctgatgattactggactacaagaagatccccatcaagcgcgcagacatgctgaaggatgtcatcatgagaatatgatgaacattccctgagatcattgaacgagcaacgtacaccctggaacaggaagtttgggatccacctgaaggagatcgacaaggtaagaacacctgtatattcttgtctgcacactgggactcctcaggtcgtcctccttgcaaaaaaccgaagggacagctcccaggctgagtctcctcttggtgattctgggcgtcatcttcatgaatggcaaccgtgccagacgaggctgtacctctgggaggcagctacggcaagatgggagctggccctggggtgaggcacccattcctcggcgatctgaggaagctcatcacagatgactttgtgaagcagaagtacctggaatacaagaagatccccaattagcaaaaccatcctgtagtatgaattcctctggggcctgcgagcccgtcgatgaagaccagtcaaggatgagggtcctgagattcatcgtccataatcagaaccgatatccccgggaatggaaggctcatttcttggaggctgtggatgatgctttcaaggacaattggatgtggatatggccgatgaacatgccatggccctagcatgaggggcccagatgaaatatcggggatgaagcgctgattggacggtggagctgggatgacatacag

SEQ ID NO: 587032 - DNA, 122 bp, Homo sapiens
caggttcacgtgatacctttggtctgggtatcaggaaatcctcttgctccttttttgcctctggtccttcactgccaactccgtctctcccgaactcccgaccccaggtgatccacccacct

SEQ ID NO: 587033 - DNA, 496 bp, Homo sapiens
agctgcacacgccgtgccgttaacccactgccaggtgcaaagtggaagggggcaagaagtcaagggtggcctgccggaggtgggcgcgcagggcaaggagaaacgaagggcgaacccgaggcctcgccgccttccgcggtgtagcccgtcagcatctgatcctggacggcgcgcacaggtgaacacaccttgctgtgccgagaccatgccgagagagacaaggggcgaggaaaacgcagggaactgggggtggggccggtaactgcgcttcagaggctacacaggagagtggaagaagagctggggttgcccggactaggcagaggtcatcttcctcgcccccggagcgaacagacccgtgtggcgggaggaagagcaacgggaagaggtccgcgctgcggcgaagcctggcgggagcgcctccgcgccgcagaagtgcattcgggccccgctacggcccaagggcacccctctctccccgcttttctgcggccgc

SEQ ID NO: 587034 - DNA, 156 bp, Homo sapiens
agagatagccggactcgccattcggcaaggtcgaacggaggagtcgagtatggtctctgcatattgtgagatcaatcatattatggccaagggtcatgatggcaggagctattcagaggtgtggtgcggattcaacccgtcgatggttcaaacgca

SEQ ID NO: 587035 - DNA, 445 bp, Homo sapiens
ccaccacacctagcctcttttagtttttagttttttgttttttgagacagagtcatgctctatcatccaggttggagttcaatggcacgatctcagctccctgcaacctctgcctcccgggttcaggcaattttcctgcctcagcctcctgagtagctggaattacagtcacgcaccaccacacccagctaatttttgtatttttttaatgaagacggcgtttcaccatgttggccagactggtcttgaactcctgacctcaagtgatccacccgtcttggtctcccaaagtgctgggattacaggcaagagccaccacacccagcctcttttattttaaaatgtacaattaagttattattgattatagttaccctgttgtgctatcaaatagtaggtcttacttattctttttgactggggcctgggtgatagggaggtcgac

SEQ ID NO: 587036 - DNA, 134 bp, Homo sapiens
gccccttttttcccggggggccccccccctttgggggcccccggggttttttttcccccccccccccccccccccctgggttttttttttgttttgggggggggggggggattaaaaaaggggtttttttccca

SEQ ID NO: 587037 - DNA, 733 bp, Homo sapiens
tggtctcgatctcctgacctcgtgatccgcctgcctcggcctcccaaagtgctgggattacaggcttgagacaccgcacccggccaatttggtatttttagtagaggcaaggtgtcaccacattgagcaggctggtctcaagctccgtggcctcaagtgatccacctgccttggctcccaaagtgcagtgattacaggcatgagtgagccactgcacccagctgtcaaagatgttatgggttagaaattactgccgtgcgcgatgactcacgccctctcatcccagcacttgtgagagaccgaagcgggtggattacgaggtcacggagactgagaccatctgtggccaacatggtgaaaccccgctctactaaaatacaaacaaattagccaggtgtggtggtacgtgcctgtaatcccagctactggggagactgaggcaggggaatgtgcttgaacccgggaggcggaaggttgcagggaagctgagaatcggcggcccacctgcaatttccaagcctggtgaacagaaggcaagatttcttcttcaaaaaacacacaacacaaggacgggcctggggttggggggggctcccaccctttgtatatcccccaagccttttgggagcccccggaggcagggactagattttgtgacccccaggggtttcacaacccggtctgggcaaatattagagagcccctctttttccaaaacatacaatcaaacctt

SEQ ID NO: 587038 - DNA, 151 bp, Homo sapiens
gatgcgtatattgagtggcatgtgagctgtgccttttgtaatgcctttatcaggttcaggaaattccttatagacgaaggacaaactgttctccactcacaacatttctgacacccactgtgtgggtttcccacgaccattacagttctcc

SEQ ID NO: 587039 - DNA, 114 bp, Homo sapiens
  misc_feature (3)..(3): n is a, c, g, or t
acnagttaagaatttagaacgaattatttaaattatttaaataacttaagtttcctattttcccaactgccccatatatgaatccatgacatccacttgacatttttctgtttg

SEQ ID NO: 587040 - DNA, 665 bp, Homo sapiens
  misc_feature (20)..(20): n is a, c, g, or t
tgagtgtacccctcgagtantggatacgtcgaccacgcccgctatctctacagaccacaaagatttggaacactatgcgatcattcggcgcatgagctggagtcctaggcacagctctaagcctccttattcgagccgagctgggccagccaggcaaactatctaggtaacgaccacatctacaacgtttatcgtcacagcccatgcattgtaataatcttcgtgcatagtaatacccatcataatcggaggcttatggcaactgacatagtcccctaataatctgtgtgcccccgatattgtgctgtttccccgcataaacaacataagcttctgactctataccccccctctcatcctactcctgcatctgcatctgctatatgttgggagtgcctgtgagcagcaacatttgttgaacagtctataccatccccttagcaatggaactactctcacccttgggagaccataccgatatgacactaacccattctatcttacctatacagcctagccaggtactcttcctcctatccttaagcggtgcccactcaaattatcatcaacaaaccaaatttatccaatattcaaaaacccaccccttgaccaatctaaccccaataaccaaaaactgcccccattacttctgacacttgaaatcc

SEQ ID NO: 587041 - DNA, 615 bp, Homo sapiens
  misc_feature (56)..(56): n is a, c, g, or t
  misc_feature (61)..(61): n is a, c, g, or t
  misc_feature (66)..(66): n is a, c, g, or t
  misc_feature (73)..(73): n is a, c, g, or t
  misc_feature (96)..(96): n is a, c, g, or t
  misc_feature (104)..(104): n is a, c, g, or t
  misc_feature (142)..(142): n is a, c, g, or t
  misc_feature (207)..(207): n is a, c, g, or t
  misc_feature (211)..(211): n is a, c, g, or t
cacgtcggggcccaaccagccctccattagggcaagcccgacaagtacatggcggnctggncgagnttttttntcaggtggatgaaagaggaaaanccagacanccccacctacttgtgtggcaagatcagcttttgagctnatgcgggaaccgtgcatcacgcccagtggcatcacctacgaccgcaaggacattaggagcacctncagngtgtgggtcattttgaccccgtgacccggagccccctgacccaggaacagcttatccccaacttggctatgaaggaggttattgacgcattcatttttgagaatggctgggtggaggactaattaggttccctgccctacctggggttctggtccaggggagccctgggcaaaagcccccggcccctataaatagtttatgtttttggcccccccgaccgcttcccccaagttttgctgttggactttggactgtttcccctttcagcatcgcttttgttgggccgtgattgtccccctttgtgggctggaaaaacaggtgagggtggggtgggctgaggccatttccccccctatttgtgtaataaaatccgtgagcccgaggtgggacgtgctggtgtgtga

SEQ ID NO: 587042 - DNA, 260 bp, Homo sapiens
  misc_feature (2)..(2): n is a, c, g, or t
cngtattataggcgctgccccacgcccagttgatttatgtagtaatagtagagatggagtttcaccatgttagccaggctcatcttgaactcttgactcaaatgatccgtctgcctcggccttccaaagtgctgggattacagacgcaaaaatggcgatctttgtgaagaacctctatgggaaaaacaatcaaccttgaggtcgagccccgtgacaccattgagaatgtgcaagtctttcatccaggacaaggaggctat

SEQ ID NO: 587043 - DNA, 741 bp, Homo sapiens
tcaccttcacctgctcatgcgccccgcagctgcgcccgctcccacgccctgcgtagctgagtgacccagactcgccagtgaaatggctagtgatgtgctggtgtgccctgtgtgctgtgtgccctgtgcctgggcctggtgtcatgtggtgatgtgtgtgcctgtgctgtgcatgtggtgctgtggtgccttcatgcttaaatgtgctgctggatgcaccctggctgccgatgatgctgcttgagtagagctggcgccctgctcgagagaagttggtggcctgagatctgctgcctgtcccagccctgccctgcgtgcgtctgcgctgctcctggctgcccttacccctgcttgtgcccttgcaatgtgctgtgacctgtgctgtgccatgcatgccccgtgtgtgcttgatgtgcctgccccattggcaaatgccttgtgcgtgtcccctgtgcgactgacggcgcattggatgaacttcctgtaagtgttgctgcatcctgaatgatgtgctgaccatgctgtgtgtgtgctgtggtgcctgagtgtgatgtgctggcccctggtgctcccggccccttctgcagacctggctgccgtggcgcggtgcacatgcgggtcaaggaagtgcagcaatgatccggaacctgatggccttctgccacctgccaagcattgcgcatgccagccactgcggcgccatctgtcttcagctggcttgctggctggggccaccaccaa

SEQ ID NO: 587044 - DNA, 273 bp, Homo sapiens
atatataatatctatatgatgttccactttgaactcttctttcaaaagattaaaacagtttgagggcagcctgggcagcatagtgagaccccatctctacagaaaaattaaaaaaaaaaattagccaagcatggtggcacacatctgtagttctagctacttgggaggctgagatggaaggatcacttgagtccaggaggttgaggcaaggctgcagtgagccatgatcacctcaccgtattccagtttgggtgacagagtgagaccctgtct

SEQ ID NO: 587045 - DNA, 250 bp, Homo sapiens
ctcagtcacactagccacatgagctcaacagacactgtattacaggacatttccattattgcagaaagttctattggacaacgctgctctaaaaacttcctaagcatatgacctgccaccaactcattaccattttgagggtagtttgcagcaaagacagaattcttcagtgtcagtaacagaaagtacttacacagtccacggttcatctccaaacactttttgatatttggctttaaaaggaaaattc

SEQ ID NO: 587046 - DNA, 627 bp, Homo sapiens
  misc_feature (189)..(189): n is a, c, g, or t
  misc_feature (492)..(492): n is a, c, g, or t
gacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgntttgaggaggaggagctgcagcgtgtgaggctggtggacagcataaagaactaccgctcccgggcgactatctttgagatcaacgcctccagccgagacctgtgcagccaggtgatgcgcgccaagcggcagaaggacctgcaaggcccatcgcccggttccagcagtgacagcaggggcggttaggagcatgcatggatgggcccagtgtggcccagccccgagcctgtccagcactgcatggagaagcagtctgagaaggcggacggaggaggatggcgggcagacgagtgtggaggacanttctcagaggtcggtgggccggaagcggcagcggtcaggacccaacaggggagccaagaggcggagggagggaggccctggaagcgggaccaggaaattctacatcccctacgggcccaggacttttgacagcga

SEQ ID NO: 587047 - DNA, 132 bp, Homo sapiens
  misc_feature (41)..(41): n is a, c, g, or t
ctgacacggtatatgtaatacgtccatattttccattcaantttttctctaaagcctaaaactacacacacacacacacacacacacacacacacagagtgcagcacgacacatgtgcagcacgacagagtg

SEQ ID NO: 587048 - DNA, 168 bp, Homo sapiens
ctctagcggatccttagcgcagctatggcatttggctgcagaagtttaaacacggtacatggcatagggtaagtgctctacaaactttaactgctattattagtagtactattattaattaagaaacaccaatgaaagcaatacttacaaggggcacacattatggag

SEQ ID NO: 587049 - DNA, 285 bp, Homo sapiens
  misc_feature (31)..(31): n is a, c, g, or t
  misc_feature (64)..(64): n is a, c, g, or t
  misc_feature (79)..(79): n is a, c, g, or t
  misc_feature (89)..(89): n is a, c, g, or t
  misc_feature (104)..(104): n is a, c, g, or t
gaggaaagaagaaaggttgattaataggtanaaatatacagtttatagaagaaataagacctanggcttgaaagatcangtaacatganctatagttaacaatnaatgtattgtatatttcaaagtcaccagaagaaaataatttgaatattcctagcagaatgaaaagacaaatatttaaggcaatggatcacccaatcacactgatttgatttttatacattatatgaatgtgttaaaatgtcccatgtacccccaaaatatgtacatctgttatgtatgaat

SEQ ID NO: 587050 - DNA, 329 bp, Homo sapiens
  misc_feature (24)..(24): n is a, c, g, or t
  misc_feature (90)..(90): n is a, c, g, or t
  misc_feature (244)..(244): n is a, c, g, or t
ggcaaccctactagggtagaagtnatgaacatcagatgcttcctttagaaaggtgatttgaggagggccctaagggaggagacacttggnttctggaaagctgaaatgaaagtttattctggccaggcccagtggctcacgcctgtaaatcccagcagtttgggaggccaaggcaggcagatcatgaggccaggagttcgagaccagcctggccaacatggcgaaatcccgtctctactaaaantacaaaaattagccgggcgttgtggtgggcacctttaaccccagctactttgggaggcgaaggcaggaggatcgctttgattcct

SEQ ID NO: 587051 - DNA, 681 bp, Homo sapiens
gcgccccctcccgactcgccgcagcacaacaagaacccgcccacacgcggcgtccccccccgcgccggcggcaggaacagctgcggcaggaaggtgtggcccggccacaagcgagccgctagcaggatccaacgtgctagattttgaagagcacccccgctctgcggaagggcagcgccccccgacagtcgggccgcccccgacacctccgcggcagcagcggtctggagagcagagtattacaacatgttcgcccaccgctgctcaccgtccctctcctccctcacccttattgggaccccacaccccccccaatagcaacgacaggtttctcctcacatatacctcccatcgacacctcacaccactaacacatatatcatacatagacacacacatatacatatatacagacacacacacacataatagatatacagacacacaacatatgcacactctgtgggatacaaggtctcacatgactgcacacagagaggtggcgccccacgagatttagccctctcctcactgccctaccagggattctgcaagacaacatgacgtcgctcgctcgacccgtagagcttctgtccacgcacacaccagagaggttggccgcttggagcatttgtattcaatagagcaagatataactggcagcaatcaatagtacagaac

SEQ ID NO: 587052 - DNA, 398 bp, Homo sapiens
  misc_feature (366)..(366): n is a, c, g, or t
  misc_feature (385)..(385): n is a, c, g, or t
  misc_feature (394)..(394): n is a, c, g, or t
gccattataaagtttagattcagacttgctctttgacatagaaagtgaagattcatctttattttgagaaatatcttccttccctctttcaaaaccctggctatgaggacttgctggactaagagatggctgatgcaaatctttggttggcgttggataagcttcttttccttggcgctgactcatctttcctggtgtcagaagctgagattcgtcactgtttgcgaagttcgatcaggttctccatctggccaaacctccctccataatggaaagaagataggtttaatgcttctctttccattaatggtgcagccattctgtaaatctgcaaatcccgtgcggagtccccagggaggcgggacnaaaggaagcccggttcctncgaggtcgnccgc

SEQ ID NO: 587053 - DNA, 209 bp, Homo sapiens
  misc_feature (110)..(110): n is a, c, g, or t
cgccttgactatgacgctcgtgtgtggattgccagcgtaagcttgcattaaggacgccgtgagcacagccactcggcctagtgtagactactcaacgcgtatatctgagngctcccctatgtcaaggtgagagtgatataactatgtacgggaggcatgtgcgcgttacagtcattggtcactagctgcttcctggtgccgacagagtt

SEQ ID NO: 587054 - DNA, 210 bp, Homo sapiens
aggaaggtgaaggaaatgaagagaaggtctgaactagcacggtaacattaaggtccacggttcctgaggtactgaacgcacagaggcgagaacgtcccgtcaaatgggcgtaccacgaaagggtgtattctcatgcacaaacgcagctcggaattacagcccacacacatcccatctttaaagtctgtgttatcaaggcccctttggcca

SEQ ID NO: 587055 - DNA, 165 bp, Homo sapiens
ctgatgtgtatatacataaacatctcaatgccttaaagagcagtattgcctccagcatgtctcacctccagccctaaggcggttttctcctatctcagtatatggaatatacaattgggttttaacacccagaacattccagttgcccagggcatgacgcgggag

SEQ ID NO: 587056 - DNA, 363 bp, Homo sapiens
cccctccagtcagcgattctcctgcctcagactcctgagtagctggaattaaaggcactcaccaccatgccttgctaatttttgtatttttagtagagacagggtttcgctatgttgaccaggctggtctcgaacacctgacctcaggtgatccatccacctcggcctcccaatatgctgggattacaggtgtgagccactgcgcccagcctgcagaaatatattttagtactaactctctggtgtcttctaaagctatagattttgaaaaaatgtgtttttctaaatgtattacatttgcagagtttttctcccatacagattcactgatgttgaaaaaactttgagcaactgcttcaggga

SEQ ID NO: 587057 - DNA, 353 bp, Homo sapiens
aagggacttgccttgtctcggatgagactttggactttggactgtggacttttgagttaacactgaaatgaattaatgctgaaatgaattaagactttgggagatggttgagaagccatgactcattttaaaatgtgagacatgcctttcaccttctgccatgattgtgaggcctctccagccatgtggaactgtgaacacacagtgttcatcccctcaggaggacacagcttttgaggtaccatcttggaagcagagaccagccctcactagacacaaacttcctggcacgttgattttggacttcatagcctctagaactgtgagaaataaatttttattatttataaaaa

SEQ ID NO: 587058 - DNA, 428 bp, Homo sapiens
cacgaggctgacgccgccgcgcatcgtcaccgagtgcgggcgcgcgatgaccgcgcaccacgcggtgctgatcgccaacgtgtcggaagtcgaacgcgcgccggaaggccgcgtgccgccggaacaggccgacgagccggcggtgatccggcatctgcgcgagatccacgccgagctgccttcgcggccggcggtggagctgttccacgaggcgcagcatttccacagcgagggcatcgccggctacgccctggggcaactggatctgctgcagcgcgcgcggctggacgatctgttctatgcgatcgcgcacgccgtgcggcagcgcctcacctacgacgagaagagccaccgcgatctgctcgacgagctcaacgagcggctggtcgacaagtatttcgtcaacttcagcgtgttcgaatcgctgc

SEQ ID NO: 587059 - DNA, 768 bp, Homo sapiens
  misc_feature (70)..(71): n is a, c, g, or t
  misc_feature (124)..(124): n is a, c, g, or t
  misc_feature (145)..(146): n is a, c, g, or t
  misc_feature (148)..(148): n is a, c, g, or t
  misc_feature (178)..(179): n is a, c, g, or t
  misc_feature (186)..(187): n is a, c, g, or t
  misc_feature (191)..(191): n is a, c, g, or t
  misc_feature (194)..(194): n is a, c, g, or t
  misc_feature (201)..(202): n is a, c, g, or t
  misc_feature (205)..(205): n is a, c, g, or t
  misc_feature (232)..(232): n is a, c, g, or t
ggagcgccaggaaggtagcgaggccagcgtcgccccgggactcgctgctcaagtctgtctattgcctgcnncacatccatcctagcagggcccgtcgcccaccaggcggacaaaagcggtccgntgaacaccatgcggccgctcnngngtgccgcccaggctctgctggtgagcgccnncaccccnntgcncanggtcccnncgngcccgcctgcgcgcacctctgccctgntcccagctctactccaggccccgtcctgcccgggggctgccgcccaccgcgcctcgctcgtggccgtttgccgtctgcgatccacgaccctgagtctgccttgccgccggcccactggaggtggcgccggagcatgcgacgctggatggcgcaccacggccgtgctgaatgcgccagaaacccgactcaaacccacccgggcctggctgcacaaactacatggaacccgcgcagcatgcttgctccagacagaggttggacgtcttcttcaatcaccttcgactcggaggggcaacccctaactatgacctaaccccccgcttcacgccggccgggcagccgcagtcatcactaacagtcacacgtggctaaagccctgcttggacccggaggggccagattgttgacagcgcccaacacttggtgggacaagaccccgaggattgggccctgggctgggaacaggggggcaaaaaagaaagaccctctcttgcccggtggacggacccaccaacctacaaacccttgagaccgtg

SEQ ID NO: 587060 - DNA, 223 bp, Homo sapiens
agtcctaatttttagagtgtaattatggagagcctttatttttattgaaagccttttctgctttttttgagattatcactttggttttattctttagttttgtttatgggatgaatctcgattaattgacggttttttttgacggcaaccttggcttcctggggatttacagctatggggatcctcttagatttcgactttgcaggctttgcaagtctttggc

SEQ ID NO: 587061 - DNA, 304 bp, Homo sapiens
gtatagcacctttgcagtgctttggcatcaagactattcatccattttgcattgctataaaggaatacgggaggctgtgtaatttacaaagtaaagaggtttatttggcttatggttctgcaggctgtacaagaagcagatacttatggtgccagtatctgcttctgataagcacctcaggaaactttcaatcatggcagaaggtgaaggaagtgctccattcttttctgttttttgaaggagttcgagtaggattggggttaattctttgaatatttgataggatttgccaatgcagccatga

SEQ ID NO: 587062 - DNA, 447 bp, Homo sapiens
  misc_feature (6)..(6): n is a, c, g, or t
acgtancaggccataaatctcctgcagtttcagcaataggtaaaaacacgtgctcaatgtttttttttttccctttaaattttggcatccagacttgtgtaccctccatctgtaaatcgggccccccctcccaccgccggggaaaaaatatggccaccttgtgtgtgttgtaaagcaacattccaggtgtaaatataaagctgggaaaatttaaatttaccttttaaataatttcctgactaacggggactattttaagcagatgagagctaagagattcagtgaaattatgtggtcataccggcaattgccagattagagtggtgggtagtcaagaattgtatcagatattaggtccctcatcagggggcatggcttccctaggtgatatgtggaattttgggcccagggatgatggagggtgtgggctagtgtgatcaccaccat

SEQ ID NO: 587063 - DNA, 874 bp, Homo sapiens
gagacgtgcttcgccgtctctccttagtcgccgacatgacgaccgcgtccacctcgcaggtgcgacttgaatttagccatcaggactcaaaggccgccatcatccgcctagatcaaccctgtggacgctctacgcctccgtacggttttacgcgtgtccaatgctcttactatgtttgcgcaccgcgtatggattgtggtctttgaagcagacttgtgccgagatatacgttccttcaccaattcttcaatgaggcgagggaacaattgctgagaaattgactggaagctgcaggatccacatgatgtggccgaagtcttcctttcaggatatcacagttcacctcagactgtgatggactgtgagaagcgggtctgaaatgcaagtgaagatgtgcccttaccttttgtagactatatctgtgaatcaggtcccttactgggatactgctcggaactgggcaattgtcaataatgacccccatttgtgtcatgttctttgagattgtcgtacctgcttgagcaggtctacatccatcagagattctgttgtgccactgtgtgcccacgttgcgtctggatggggcgcgccctgattctggcttgggacagtatctgctggtgacagtgcactccctgcggagaacgggattattgaagggctactccctcgggccgtaatttccccatcaagggcgggcgcgctgattaccggtgtcactaggctggggatgcatggtggggctttccttacctttgctgatgctgtccaaactctgttagtgcttgattggtccttcttcactggggtgttggttccccaacgggagatgcgacaggtatgggcggacgtccccggagtgttacaccctggg

SEQ ID NO: 587064 - DNA, 379 bp, Homo sapiens
cccaagccttggcagctttccacatggtgttgggcctgtggtgtgcagaaggcaagagttggagttttggagcctttgcctagatttcataggatgtacagaaacacctgcatatccaggtagaaatctgctgcagggtggagacctcatgaagaacctctactagggcagtgcagaggggaaatgtgaggttggagcctccatgcagactcccactgggcagtgctagtagagctgtgagaagagagccactgtccttcagattcctgaatgatggttcaccaacagcttgcactatgtgtctggaaagcatacgcaccgacacatcctgtgaagcagctgtggtggctgtacctgagagcataggggagagctgcca

SEQ ID NO: 587065 - DNA, 927 bp, Homo sapiens
  misc_feature (1)..(1): n is a, c, g, or t
  misc_feature (5)..(6): n is a, c, g, or t
  misc_feature (15)..(15): n is a, c, g, or t
ngggnnaactgtgcngtccgcgccgcatttggtcgcgtcgcccacagactcttctcaccattttgtttccttgtggcttcgtcccaggttccgtcaaggtggcggagaaggagagggctgaaacacgcgagtccgtcttagtggcggtaacctcataacatgcaataatggcatcgtagaatctctctcgtggaagaataggaacacagtatctttcattcgactcatacgtatccaacaacgatattaaaaaccgatagacatcacatccttcgtatcccgccagcaccccctcacttccccctatgtttatatcagggcgacaaaaactcctagtcgcgtttaaagtacctataatgtaagtttctttatatgcatttcatattttatcctatagtactctttaacgctagcattccaagtgttgatctatcttctcatccttttcctttcactcacaggtttttcgtgtcgtggcgtttctatgttgtctacctcccgctatcgttcaaatgtctcatcctcctaccgcaatactacgccatcccaatgctgttgtacctggtcgtctacgtgcctaccttatcagccattccaaatatacgacacagtctcacagatccataccatcaaactcgcttcacatcccgtgtctcttgccattgttctctattctctggtattccattttgtccttcgctagttcttgttcagtgccgccccctccagactcccgtccactcacactccatgcctgcccgggacactcttagcgtacgctccttcactatcagtatcttcctcttctcacgtcacgcccgcacccctctccttaccaccccagaatatccgtaattcacgatgttatgcgattacgatctggcagaggaggagggtggcgcaacctacattcatctactataactg

SEQ ID NO: 587066 - DNA, 1061 bp, Homo sapiens
ggcatgggagagggtcgcgtcggacagcgacagagggcagcgcagcggcagcggtggcggaaccaagcatcaccgttcgtagcccgagccgaccggcccgcgaccaggctagcgcgccgggcggcggccgaggactcggcacggaggccggcgggagcgggccgaaggaaggaagcgcagcagggatcgcgctaggcaagtgggtccatctgcatctcgaggcgaccttcccagaagccaagcatctcggtcaccattcacagagatccatttggactccttgtggtccttggagcgggagttgccctgcatgaacgtaggagccggaggcgtaaagcgtgcaggttccccggattcccattcccttttgcttgggaagacccattttgcgggtcattcggggttccgttggcccccttcggggcaggcccggttccccccgtggggggcgcttttcccccggggggaattcccctgtgttcgtgggccttgtagctcggggaaggacgttgaattcccccaccttttttggagttttgttcccctgttttggtttgggtcccccccccctgggtgggtgtggcctccccgaaggcccattttgccccccccggtgggggaacacgcaaacgcccccccccgcggtgtgtttgtcctcccttccgcctgaagagacccctaagggggaaaccagtaacagcaactccaattggcaaaggcccccaagacgtaccgtgaattggtgacacagcctttgaacttgcccacgcggcacatggaaaaacgtgggaatagactttcttggccgcggggacactggcgggtggacactgtgtgacccccaaccaattatgtgcccatgtggagcggcggcacattttccccccttttgttgtaaaaagtttggccacattttggtggccgcaaatgtttcccaaaaatttttctccccagtatatgatgtcccccaatataagcagtattgtgtgattagatacaacccacaaggaaaacgataatgttttctccccacatattttgtgtgggccccccggagcagt

SEQ ID NO: 587067 - DNA, 1016 bp, Homo sapiens
  misc_feature (359)..(359): n is a, c, g, or t
  misc_feature (454)..(454): n is a, c, g, or t
  misc_feature (464)..(464): n is a, c, g, or t
  misc_feature (466)..(466): n is a, c, g, or t
  misc_feature (560)..(560): n is a, c, g, or t
  misc_feature (568)..(568): n is a, c, g, or t
gctgctgcttcatggatttccagaattctggtattcttggcgttaccaactgagagaatttaaaagtgaatatcgagttgtagcactggatttgagaggttatggacgcaaacagatgctcccattcatcgacagaattataaattggattgtctaattacagatataaaggatattttagacttctttaggtaggttagtttgaaacaaaacaactctttttaagggacaaacattcaacaaattgtgaatcaatgacttcttttcttgggaggatgcatattccatctacccaaattatctggatcctgtcactatggtttcaggtagtcagcccaaaatatctgtacaggaaattnaaaatgatgcatctagagcaactattctgtctaccagccaagaatgacttttcagatttgtttttaaacatagacctaatggcccgggtgctgtngttgcgcctntnatcccagcactttgagaggctgaggcgggcagatcacctgaggtcagagtttaagaccagcctgaccaacatgttgaaaccctgtctctactanaaatacanaaattagccaggcgtgaacccgggagatggaggttgcagtgagctaagactgtggcttgcactccaacctgggcaacaagaatgagactctgtttaaaacaactcccctcaacactatcgacctatgttttaccggcttatacattccggcagacctctctttgtgcacgcgctatcctcgtcacggctgtttacttctctggaccaccccaatatcctgtttcaccaggttttctgactgtgcccgcctgtattccggtgggggctcccctctgtgacaccccatttttgttgtgcgagacacccccccatagatgcggatgccgtggtacccatcattgtctcggccagtctctgtgcctacccgatgctgtgcgctcctcattggtcgtcgtcgtcaggcgcgcgtgtgatggtgtcctttctatcgtgtggggcgctgcacacg

SEQ ID NO: 587068 - DNA, 704 bp, Homo sapiens
  misc_feature (101)..(101): n is a, c, g, or t
cgtggtggcgcatgcctgtaatcccagctacttgggaggctggggcaggagaatgcttgaacccaggaggcagaggttgcagtgggccaagatcgtgccantggactccagcctgggcaacaagagcgaaactccgtttcaaaaaaatagaaatcaggatacagtggactatcctttaacgtggaggaacatattcagttgccgtctaatctacagaggatattccacgttcttgagtctacctcaatcagggtcataaaacgttggagctctttaaaggcattttggagcaggttaatctctagcagtgaaaaccgtgtaaagctttcaaaagatagtttaaggacattttttaagcaagtgattctcgatgtggtggtgggcatataagtaccacgatatagaaagatagattgagtctatactttttagtaccgtgccatcttaagacaaagcaggacgtagccagaaaatgtagaaccatatgcaagtagaataacaaggtgagcaaatgtgtttgaaaagtatatagtatggggcagggcagggtggtcatgcctgtaatcccagaaccttaggaggccgaggcagggggatcatgaggtccagcagttcaagaccagcctgggcaatatggtgaaaccctggcttccagtaaaagtacaagaaattagcgaggcttggggggctcgcctgtagtccag

SEQ ID NO: 587069 - DNA, 295 bp, Homo sapiens
gctgggcctacttgattcttttgccataacttttattttttttgcaagataatatattttacttaacgaaaacttaaataattatagccatgcaacagcagagatgaagcttagaaatataatattgaaagataaaagcaagtcccagaacactaaatgcagttggatatgttataaagcttaaaataagcaaaactaaacaatacattatttctgcatctatatctatcatattattagaaagtattgtattattaaaaagtaaggtagtgagaaaagcccagaagatgaacaa

SEQ ID NO: 587070 - DNA, 206 bp, Homo sapiens
gcagctcgctgtgctgggactacaggcacctgccaccacgcccagctaactttgtatttttagtagagacgggatgtcaccatattggccaggctggtctcgaactcctgatctcaagtgatccacctgccttggcctcccaaagattacaggtatgagcccccgggcccagcctgctcttctttttataatgcagcgacagcgag

SEQ ID NO: 587071 - DNA, 307 bp, Homo sapiens
  misc_feature (261)..(261): n is a, c, g, or t
  misc_feature (297)..(297): n is a, c, g, or t
  misc_feature (304)..(304): n is a, c, g, or t
ctacatatacatcctccaccaagatagagtcatgggtaaattaattaaggttaagagacaatttcaatgtcttatgccaagctgttaaagtttttttttttcccccttttttatttatttttgagacagagtcttgctgtcacctaggctggagtgcagtggcgcaatcttggctcactgcaacttccgctccccagggttcaagcaattctcctgcctcagcctctcaagtagctgggggttacagccacccgccatcgngccacttgggttttttggaattttttgggaggaagnagggggnttt

SEQ ID NO: 587072 - DNA, 1267 bp, Homo sapiens
  misc_feature (584)..(584): n is a, c, g, or t
cggaagccacgctcacttctgcttgcacttaggcgactcgggagctcggactcctacgcagtcaccgggaagaggccagcggcctgtgccgcatcaattagcaacccagggagacgacttatcacctatcgaagaaatatatcaatatactcgacattgaaggtactctaacgaatgccgagatgacccagatgggacagaaatcccaagattcatatagccatcgggcgggccttgtcgggtttttcacctatggagtcagcgtgaggctcagctaaacacccggctttcgcctttgggaacctagggtttccctaggaagtaagattatttaaatataggcgaatgctccaacaaaagaatcttgacagacaatacgactaactctctaacgatggaaaaatcataccaaatctagataataccctataaatggatgaacgaaataatgaccattataaaaaaatgatcatagcaagcatcaactaatatctcacaaaaccgtgagacctagaggaacaggcaacaggtggaataccaacatatgctaaatcaaaggaaacctatgatgtacgaagtagatnaacgagagagagacacagctctatgagcgaaagagagagcataacgaagacaaaaaccatgggagaacaaaatcgaaaaatatagattagaataataattcatgcaaaaaaattcttaaaaccaaagtataggctcatggcccctgaaagagacgtgaaaggtatccgaacctgacgataaaaagatcgaaaagaaaagaatgctaatactccgaaaacgctaatataagaaaggataatggcccaatgggattaacgccttacgaattacaatgaataacctaaaaatgaatatttcacgcgataaaaaaaggggcaaaatttaaaaattaaccttattacattgatcccaaaaactgatttaacatttacaccacgatatattaaacccctaaaagctctgaaggaagttaatcggaaactccatagatcactaaagtgggtaagacgtaaaatgccgagaagaaatcccaaaataagctgagaaaagaagccgaaaatttagtaggatgaagccccaaggtgcggaaagtagggccgtgactgttgtggacacaaaccctaatttgggctgtgattggaacacgaggaagccccctcagtagtgagtaagaggtgcccgaggtcgaacggtggaggcgtagatgcagcctcagtggtcctctagggcggtgagtacctca

SEQ ID NO: 587073 - DNA, 685 bp, Homo sapiens
gttggccacagatgttgcagcccgtggtctggacagttccattcaatataatgactgtcattaagcgtatgatgtggcacgagacattgatacccacacgcataggattggccgcacaggaagagcgggtgagaaaggtgtgtgacctataccctatctcatctcccaaggacagcaactttatgctggtgacctggtccggaagcttggaagggagccacactcaacacgtttctaaggaactcctagatctgtcaatgcagaatgtcgctggtttcgtgaaatctcgattcacaggagggagaggaaaaaagctgaacattggtgtgtgaggaggtccgctagtgctacagggagcgtgcctggcctgtggctctgagaacatggatcgaggaaatagcaatgtgaatgagcaattatgaggcctacaagccttccacaggagctatgggaggatcgactagacggcggatgagaagcagctttccagtcacagtacaagagtcactttgttgcagcacagtttaagtaaatcatgaaggctggaagtactgctgctggggcaacgtgggtggactagtgcaggaagcttgaattctgttccaactaacttcagggcaacagggccataacaggcctgagaggcccgttaccagtgccgcaaggcatccccaggttggaaaac

SEQ ID NO: 587074 - DNA, 204 bp, Homo sapiens
cccgtcgatggcccatgcagctgagggggtgtctaggtaatcatttggatctcggaggcagagtctgccattactaccagaactagcaatttgggggcttactcatgctaggcttgcggaagaatgaaaaacgcttcgggattctcctataggacttatctgcttgtagatttggctgatccaattaacgatgggccatcgaga

SEQ ID NO: 587075 - DNA, 336 bp, Homo sapiens
  misc_feature (7)..(7): n is a, c, g, or t
  misc_feature (31)..(31): n is a, c, g, or t
  misc_feature (45)..(45): n is a, c, g, or t
  misc_feature (57)..(57): n is a, c, g, or t
  misc_feature (130)..(130): n is a, c, g, or t
  misc_feature (168)..(168): n is a, c, g, or t
  misc_feature (265)..(265): n is a, c, g, or t
  misc_feature (299)..(299): n is a, c, g, or t
  misc_feature (317)..(318): n is a, c, g, or t
cttatanagttgttcagataaatcccgggcnccataataacaatnacaacaacaggncataatactaatattaaatttttataaaatcatgcttggtgacaactctgtgcttttggcctcactgggtganaggattttctattatggtcgtggggactgcatttgttncttaaagtctatttggtaagtgtatggaatctttggctgaagattattccttggtcacataactataaacaagttactttcttcactaggtgcttcnggaatacgatgctatgggttgaattacgtatttncccccatataattgtggnncttacttctcccataggt

SEQ ID NO: 587076 - DNA, 176 bp, Homo sapiens
cacgtcatatcaggcaagcactcttagctcattccaacatactgaagctgttgcagcgcacaatatcctcccatgttgaggtctgccgccaggttaacattgtagctactaagctgaagaagtgtcttcgtaaacgaagtggggttgttcacatagttttgtccattccgtgacct

SEQ ID NO: 587077 - DNA, 515 bp, Homo sapiens
tgacttaaaacgaagtatgtcccaataaatccattatacatagaaaatatcttaagacaaaaatgcatttagggccaggtgcagtggctcacgaatctgtcttaaaacaatttttaaaagtacaattcctactgaacacatatcactttcataccatcgtaaagtcaaaaattgtagtcacaccatcataatcggtgactatctgtatgaggataagtaggagggttcagagaaggttattctctggctggtccagtggctcacgcctgtaatcccagtgttttggcaggctgaggtggtggatctcttgagcccaggagttccagaccagcctgggcaacgtgacaaaactctgtcactaccaaaaatttaaagattagccaggcgtggtgttgtgtgcctgtagtcccagctactggagaggctgaggcataaggatcacctgagctcaggtggttgagactgcagtgaggcatgatcgtgccactgtactccaacctgcaacagagtaagac

SEQ ID NO: 587078 - DNA, 771 bp, Homo sapiens
tgcctccagctctcggggtcggctccagtgaggcgccctcaggagagtgtgcgggcgctctattccatgagacctgatgtggcatgggctggcactgtggctggggctctttccccgtttcgcctcagctacccctcagctcctggtagtctgccagtcctggggtctgtctgccgtttgggtgctgtggagcttgctctggcccctgcctgccgtcccctgtctgcctgcttcctggtgtccagtgcccctcgtggccgactgcctgctgtcattgaggctgctgggtgcggcttctgaagctggacctggccctgctggatgtgttgccctgagaacggagcctgactggcttgtgggcattattgctgctcgacacctgagtgcatgtcccttgcttgttgcaccatgggggggtacagtttactaaataccgcgatttacaaattaacattttgaactaacaaggatacccctcaacttgggaggattgaaggagcacctatggcttcatattggggatttgtttcttggggcacctttgataatagtactgaaaacttacacagattgacaattccaggtgcctaaatataacctttcaatccacagatttcaagagcattctttcacttccgagaagtaattgagcaaaccctcttttggcaaccagctccaatcagaataaccatgcaggattgaacaaccaaagtgatccattccaagggcagggcagccaagactggtgtatggactgacgacagattgtag

SEQ ID NO: 587079 - DNA, 807 bp, Homo sapiens
taaaaaggtagttagctttaaaggaaactccctcaagggggtttcaagccaccaggacaagggcccccccaaaattcttaatcttctcctcgagttcttcggctgaaaaattgggcctttcagcgaagtaacggggtgtgctttggggaagccttttctccctttttccacgaaaaactttgggtagtatagccccgcgaattggcacaccacatctcaatgtgagtggagagtcaaggccccacgagattgttggtgttttaatagagccaaggacatatctacaccacgcggtgtctcgtggtcacaagtgtggaccccaaacgaggtctccccaaccaaatgtgtgggggctcaaaggggtggaacgaggctgggggacaagaaaaagctccctccgggagagttctccactcttcctgttgtacaggagggtggggctagagggggctctccaactaacccaaaatgtttgtcccgacaacaggaaggtgatgaagcccccgtggggggggggtgggggcatcaacctgtgggggctcacagcacgaaacatgttgtggaatcctccgcgcgggtgggtgtggtatgttggccacacgaaccgcgaagccacgtagcgactttgttcttcaccgcgcggggcggggctccccgcgccgccggggggtggctgtgtcccttcttctgcgggggtgtgtgggttcttggtgggctctatctggtggggcgggggccgccggggtgcggacctccggggtggggggtctctctttccactgctgtggtgggtgcccccccctctta

SEQ ID NO: 587080 - DNA, 185 bp, Homo sapiens
aaattatatagcagtcatcccgtctactatatgcggtagccgaggtcagcaacaacctatggtagctgtaccccgagcagtgacctccgaccccctaacaaccccacacctaatactaactacctgactcctacccctcacaatcatggcaagccaacgccacttatccagtggaccgtaagaca

SEQ ID NO: 587081 - DNA, 343 bp, Homo sapiens
cagccacataaatgatactgtgttaggcagtgggaggttgctgcgtaataagtagttaatgatgacaagtcctagatcttccgattataaggctagtatttagaacctatagtatggtggaatttaaagccattattgtcttctgaacatttacaaatgtatcatgaaaataaatttgatagaaagttgaccagtcttactgtttcccatcgtgacttattaaaaatcatatttgtgttttctgcttttgcttccacctcagacctcaatggaaataacttttcagactttacatctattcaaaatgtaattataggttaaacagggcagacatcaggtagag

SEQ ID NO: 587082 - DNA, 577 bp, Homo sapiens
ggggtggggtttggtttttggagtctttttttttaaaggaaatttatggaggaaaaaatgggaaggccttccctttaagatgttatatttttcttaaaaagtaactcctagtagggggtccccctgaatctgtacagacccgtaaaaactgaagttctgcctctgatgtattttgagagtttgtttctttgaattttcatttcacagttacttttcctggcaaccaaacaagcatataaaatggcaccaaacggcacatgatttcccaaatattaaaaagttttttaaaaagtattgcccaccattaatgttgatttctagttatttattctgggaaggtaaagtatttgaaaccaaaaattgggcccttgcccccatcatttgtaagcggtttggttttaaaaaacggtagataattacccaaggtagaatgcccttgtaaggtaacggcttttgggcaaaattttttgtacaaattagcgccaacagattggattttatgttgacatttgtttggttaaagggcaaaatattttgtatgcaagcagtttcaaaaaagtttgtttttcctttgcta

SEQ ID NO: 587083 - DNA, 342 bp, Homo sapiens
ggctaatgacagtgcatgtccagtgatagcggatataggaatgggcagccagaggacagtgacgtgaggtgcgggattgaatcaagcagggctgctcccgtcaggtacagcctggaggtgccggcaccgatgtcggttacctcccagatgctgctcagaatgtgcagtgctgctgtgcgaacacggcctgtgacttgtctcatgttccttccactgcagggcagggctgctgagctagagggtgactggagggcaggttcttgctctgggagtgcatcttgaagaggggacagctgcacacacaacacacacacacacctccatatgcacatgtgtaccgag

SEQ ID NO: 587084 - DNA, 604 bp, Homo sapiens
  misc_feature (10)..(10): n is a, c, g, or t
  misc_feature (68)..(69): n is a, c, g, or t
  misc_feature (72)..(72): n is a, c, g, or t
  misc_feature (84)..(84): n is a, c, g, or t
  misc_feature (95)..(95): n is a, c, g, or t
  misc_feature (100)..(100): n is a, c, g, or t
  misc_feature (111)..(111): n is a, c, g, or t
  misc_feature (114)..(114): n is a, c, g, or t
  misc_feature (140)..(140): n is a, c, g, or t
  misc_feature (144)..(144): n is a, c, g, or t
  misc_feature (160)..(160): n is a, c, g, or t
  misc_feature (188)..(188): n is a, c, g, or t
  misc_feature (203)..(203): n is a, c, g, or t
  misc_feature (205)..(205): n is a, c, g, or t
  misc_feature (213)..(213): n is a, c, g, or t
  misc_feature (266)..(266): n is a, c, g, or t
  misc_feature (287)..(287): n is a, c, g, or t
  misc_feature (290)..(290): n is a, c, g, or t
  misc_feature (296)..(296): n is a, c, g, or t
  misc_feature (323)..(323): n is a, c, g, or t
  misc_feature (326)..(326): n is a, c, g, or t
  misc_feature (370)..(370): n is a, c, g, or t
  misc_feature (376)..(376): n is a, c, g, or t
  misc_feature (382)..(382): n is a, c, g, or t
  misc_feature (396)..(396): n is a, c, g, or t
  misc_feature (411)..(411): n is a, c, g, or t
  misc_feature (427)..(427): n is a, c, g, or t
  misc_feature (456)..(456): n is a, c, g, or t
  misc_feature (466)..(466): n is a, c, g, or t
  misc_feature (482)..(482): n is a, c, g, or t
  misc_feature (500)..(500): n is a, c, g, or t
  misc_feature (509)..(509): n is a, c, g, or t
  misc_feature (527)..(527): n is a, c, g, or t
  misc_feature (533)..(533): n is a, c, g, or t
  misc_feature (593)..(593): n is a, c, g, or t
aagtgttatnaagtgaaatgaaaaaataagtaaaaagtgaggaaaaaataaataatgaaaaggtatanntgnggaaactgttanaatgataaatnggaanaggtaatgaanttngaatgtaagaataaagggaaatcttntatnttcagaagtaatctanatggaaggttaaataatctaccccagangtaaggtaagatggnantaattggngtagaggtatgggatgtgggaaggtggaggtgaagggggtgggatatgatatnggacaaagggtatatatcagncangttatntgttaggggctcccatacactgttggntcnagaaagggctgggctttccttcctgagctgggggatcggggganagggtntgggcngtcaggggccaaancgcagcagggccggnagcaggctcattttcngcccggtacccatcagggtgatgctttcncgcagcccgntatctgccgcacttanattgcacatatagctctngcagcagcngatgcccatggaagccanaacaanattgacgccttctgggtatggggcaggtcggggaacaggttttgctcaggctgttgccanatgttacgaga

SEQ ID NO: 587085 - DNA, 124 bp, Homo sapiens
ggcgaggaatagttttttttattagtatgtaccacgtgacatttttctgaactgctaaaaaataacttgatccagaaaaacacaacaaaatcagaaggcactgatgcagggcgggtaaatgcca

SEQ ID NO: 587086 - DNA, 312 bp, Homo sapiens
  misc_feature (52)..(52): n is a, c, g, or t
aactattattttagggcatctgggcttcattatgaattgttttgaagccggncgtggcgggtcatgcctttagggctaggactttgcgaggctgaggcaggtggatcacctgaggtcaggagttcaagaacagcttggccaacatgacgaaaccccgtctctactaaaaatgcaaaaattagccaggcatggtggcgagtgcctgtaatcccagctacttgggaggctgagacaggagaattgcttgaacttgggaggcagaggttgcagtgagctgagatcatgccattgcactccagcctggcaacagag

SEQ ID NO: 587087 - DNA, 358 bp, Homo sapiens
atccataatcatctgtactcgggtgttggacgccgttggtatgcgcgtgtgctatcagcattctggtaggagtctctggcgtgatgaacttgctcctgtggatgtatagggagataagctgaaaagagcaatgatggatctgcagcatgggagcttatttcttcaagacacctaggattgtggcatagtcacgataattctagtcgtaccgccaagtctaagattagtgctcgtgtctctagtctggagtccgtcggcatacaaggggctgagtctgctcagtctggtgcagagaactgttattgtcttcaaattcatgattcctcagatcgtctagaacatgacctgtattgcatca

SEQ ID NO: 587088 - DNA, 316 bp, Homo sapiens
tctcctgcctccagctcctgcgtagctgggactacagcacgccgacacacaccccactaatttttgtatttttagtcgagacagggtttttgccgtgttggtcacggctgatctcaaacactgtactccagtgatttggcccctttcaggctccaaaagtgctgggattacagatgtgagccacctgtgcccagcttagtaattactttgtattggacttatattgaaatatgtagctggggtgtcctctagagatcataaagggcaggatacagaacccgaaactggacgggtagaaaactcggtcgcaaaaact

SEQ ID NO: 587089 - DNA, 424 bp, Homo sapiens
cagcgcggaggccgcacgagtgcctggagttactgtacaagatgtgaaccatcaggagttcgtcagagctctggcagccttcctcaaaaagtgcgggaagctgaaagtccccgcaagtggtgtggataccgtctaacgactggtcaacgcacaaacgagcttgttccctactgatagaagaacttgtgttactacgacgcgagactagctttccacaagctgcggcatcctgtacctaccggggtggcgcttgggagttaggatccattgaccaaagattctattgtggggacgtcctgagaaagcggcgtcattgcccagggcacttcagccgaaggctccaacgagtgtggtcccgccgtgtgtcctccaaggccctggaggggtctgaaatagtggttggttacacatccggaccatgatg

SEQ ID NO: 587090 - DNA, 126 bp, Homo sapiens
  misc_feature (67)..(67): n is a, c, g, or t
gggtgctctagacgatcccgtgtcatcccccttcgtccacaacacggctaggcaggtgtgctcaggnggtctgaggtttcacggatgttaatgtatgtcagaaaagagtctctcctcagagttcac

SEQ ID NO: 587091 - DNA, 296 bp, Homo sapiens
  misc_feature (67)..(67): n is a, c, g, or t
  misc_feature (135)..(135): n is a, c, g, or t
  misc_feature (192)..(192): n is a, c, g, or t
  misc_feature (231)..(231): n is a, c, g, or t
  misc_feature (251)..(251): n is a, c, g, or t
cccccatctttttttgacagtgttgctctgttactcaggctagagtgtagtggcacaatcatagctngctgcatcattgaacgcctgggctctagtgatcctcctgcctcagcctcctgattagctgggactatngacacacatgcactaccatgcccagctaattttatttttttgtggagacagggtctngccaaattgcccaggctggtctaatgaactcctggcctnaagcaatcatcccacctcancctcccgtgctggttacaggcattagcccattgcacctgcccctc

SEQ ID NO: 587092 - DNA, 248 bp, Homo sapiens
ggtgtaccgtgactgcgagctaaagtcactcaggaaacacaaactcagcatgtttctcagtctccccttagacactcttctcctccttcacatgaggtcctgtcaccatagcctgcagagaactttctggccaggctgtgctccaggagcccagccccacagctccctcctatggccacctggacctctgtccctgagtcaggcttgaagcagcaaagtcatgatgtggaaattgacaatatctgggg

SEQ ID NO: 587093 - DNA, 168 bp, Homo sapiens
tctgatccttacattgtctcttggccttgctctaacgtggttgcttcagctgtgattttccggttctgtgatatgaatcgctctctgtgcagcagagagggcggtacacctggcagtgccgctgcgagggatctggcttctgttaagaacacttactgtcggggttag

SEQ ID NO: 587094 - DNA, 278 bp, Homo sapiens
tcgtccaggtccgctcctggtgtgactgaagcacaaccacatccgtataattacgccttggaccagagctctctgtaagcctatttgaagcacaagaaaaataaacagccatctttggtttgcctggtatttagctgagataaagataagatatggctgcaggctttgacttgttcctttcaagaaatgtcacaaggcctttaaagttgcccagagaatctttcggctttttaattgatttactgacttggggccatggggtctgagtggacgactca

SEQ ID NO: 587095 - DNA, 204 bp, Homo sapiens
caggaaccacagcagccaagtcctatactatgcccgcccctgctgcagcagcagccatttttggctcagccctgctgcagtcccagatgaaagccaggacggcaaggacaagatggcaaaggacttttaaaatggaaactcttaacaaaaataacaatgaagcaagcatcataaaaaatgttgcaataatgagggggtttgtgg

SEQ ID NO: 587096 - DNA, 136 bp, Homo sapiens
ctcagacatgaaaacattggagaatcttatcgagactatgacctgatccatacagatatcgtattgcttagatatgcttattgatttcatccaattttgtgagggtgtgcgtgtgtgtagcgcactgtgtgtgtgc

SEQ ID NO: 587097 - DNA, 391 bp, Homo sapiens
  misc_feature (190)..(190): n is a, c, g, or t
  misc_feature (256)..(256): n is a, c, g, or t
  misc_feature (259)..(259): n is a, c, g, or t
acccacgaaagatgccccacacattcccattaaaggcagaaactaacccagggccagctattattcaacagtggcccggcacttctaacccctggcaccagccagatgagggacattagggagaattattattggcattatttggagaccataaaactggctacctgtaaaacctaagaatcaactgggnaaaaaaaaaaaaaaaaaaaaaaaaaaaaaaaaaaaaaaaaaaaaaaaaaaaaaaaaaaaaaaaaanaanaaaaaaaaaaaaaaaaaaaaaaaaaaaaaaaagggggggggggccggggcttttttctgttaacctctaattggggggggggggcttttttctgggggatcctttaaagtaacccggcgggattccaacttg

SEQ ID NO: 587098 - DNA, 1002 bp, Homo sapiens
ggttggtcgcttccctgcgccaaagtgagcagtagccgacatgtcaggctgggagtcaatattacaggagaaccgagggcgagtgaacgaacgcagaggaagaacaagaagagaagcttgaagcaagtggatgactatagaatattcaggaagagatagttgatttatctggttgatgcctccaaggctatgtttgaatctcagagtgaagatgcagttgagaccttgttgacgatgagcatccagtgtatgcacaagtgtgtagcatcagtaagatcgataagcagtgatcgagatctcttggctgtggtgtgctatggtcaccgagaaagacacagaatttcagtgaatggttccaaaatattgacgtcttacaggagctgtgataatccacggtgcggaaacgaattctagagcttgaccgaagtttcaaaggtggcagcagggacgataaaagactgtttccaagacatgatgggcgcacggatcttgactacatcgactctagtgaaagtgatgtgggtcctgtgccgaggcctcttaagtgatgtccaattcaagatgagtcataacgaggatcatgcgttgttcaccaattgatacgacaagcccctatggcaagtgatctgggtcaaagccacgtcgggtcaggacatgagcggtgatcatccgagatactaggcatcttacttgagtggatgcatcctgaagaaagctggggggcttgacatatcctgttctagcgagatttcatcaggcatagcagaggatgaggactccgggttcacttgaggaatccagtagctagagactgtggaagttcggccaggagacaggagggggatcagcggtaagtgagttaacggggatatggacccggggcttaagggcgaagttcacccaaaagctttgggaaatgacggaacgacggcttaaaaagggggttgcgaccagtcatgggccttcaaggagacacgggctggcttcgtgaaacgccccgtg

SEQ ID NO: 587099 - DNA, 120 bp, Homo sapiens
tggcacacagcgatggtacacgtccagtggtttaagaataaaagcatcctggggcacaaggccaagtacttttcataggcgtgttcgtagatagaccagtggactgatgtcctcattatg

SEQ ID NO: 587100 - DNA, 178 bp, Homo sapiens
  misc_feature (25)..(25): n is a, c, g, or t
  misc_feature (63)..(63): n is a, c, g, or t
  misc_feature (83)..(83): n is a, c, g, or t
  misc_feature (95)..(95): n is a, c, g, or t
tcacccccccccccccccccccccngaagcccctcgaaccagtatgtgttttaggctttgctnggccaaatgggtctctgccngcgactactcangctctgccattgtggctgcagagtgaccatagaccttctgaaagtgaatgagtatgactgtgttccaataaaactttattgac

SEQ ID NO: 587101 - DNA, 128 bp, Homo sapiens
gcccggctatgggcatggtgactcatgtctatactccctgcactttgggaggcacggtgggaggactgcttgacctccagagttccagtccagccttgtgcaacatagctgaaaacccgtctctacag

SEQ ID NO: 587102 - DNA, 390 bp, Homo sapiens
  misc_feature (15)..(15): n is a, c, g, or t
  misc_feature (28)..(28): n is a, c, g, or t
  misc_feature (131)..(131): n is a, c, g, or t
  misc_feature (235)..(235): n is a, c, g, or t
  misc_feature (329)..(329): n is a, c, g, or t
  misc_feature (338)..(338): n is a, c, g, or t
  misc_feature (369)..(369): n is a, c, g, or t
  misc_feature (383)..(383): n is a, c, g, or t
gcttgaccaaaaaanaatcgggagcttntttacccaaatgggagagaggcctgaaatcagcaaaccctcgggatggcaccggttacactggctgggcaggaattgctgggctttacttacatctttatganggatttggggaccctgcctacctacagttagcacatggctatgttaaagcaaagtctgaactgcttaaccaagcgctccatcacctttctttgtggggatgcangccccctggcaagtggccgctgtgcttattatcacaaggatggaaccaatgagaagcaggcccgaaaaatgcattacacggggtaattcacctnaataaagantgatccctcatgctccaaaaggaaaagcttntatgggcgaaaaangctacat

SEQ ID NO: 587103 - DNA, 428 bp, Homo sapiens
  misc_feature (84)..(84): n is a, c, g, or t
  misc_feature (90)..(90): n is a, c, g, or t
  misc_feature (92)..(92): n is a, c, g, or t
  misc_feature (95)..(95): n is a, c, g, or t
  misc_feature (105)..(105): n is a, c, g, or t
  misc_feature (115)..(116): n is a, c, g, or t
  misc_feature (134)..(134): n is a, c, g, or t
  misc_feature (140)..(141): n is a, c, g, or t
  misc_feature (211)..(211): n is a, c, g, or t
  misc_feature (254)..(254): n is a, c, g, or t
  misc_feature (267)..(267): n is a, c, g, or t
  misc_feature (279)..(279): n is a, c, g, or t
  misc_feature (283)..(283): n is a, c, g, or t
  misc_feature (321)..(321): n is a, c, g, or t
  misc_feature (341)..(341): n is a, c, g, or t
  misc_feature (367)..(367): n is a, c, g, or t
  misc_feature (374)..(374): n is a, c, g, or t
  misc_feature (389)..(389): n is a, c, g, or t
gccaggagtggacatgtggccagaccggcgggtcagggttcagctgccaatacttttacgggacatatgggccttgagcagacntcaagncnggntcgaataggngcaggttggnnagcagggcacgtttatcngccccnncaagtgcagagaagccctgaaggtggaggagaagaaacaattccctcagtggggtttttcctccgatttntggggagagaagcccaacctcagttacatcatcgggaaggacncttgggtggagcnttggcccgaggnggangaatgccaagacgaagagaaccagaaacaatgccaggncctgggggccttccccgagngcatggttgtctttgggggccccaantggcccnccccccattcccccnctccagataaaggttcagttatatctcaaaaaaaaaaaa

SEQ ID NO: 587104 - DNA, 101 bp, Homo sapiens
  misc_feature (68)..(68): n is a, c, g, or t
catgttcagcatagttttacagtgctaacaggactgtatgttttcctaatcttgataaatctataatntgtatgcagcaataatctatatttctattcccc

SEQ ID NO: 587105 - DNA, 168 bp, Homo sapiens
accgataaagtcatcatagcaccatccggtgccctccgtaaagtcactataacaccacacggtcccctaccgtataagtcagtttagcacacacagtgccctccgttaagtccctgccctttgtacacaccgcccgtcgctactaccgattggacggtgcgttggccc

SEQ ID NO: 587106 - DNA, 1025 bp, Homo sapiens
  misc_feature (218)..(218): n is a, c, g, or t
gggacagagccctgggaggccgggccgggctcgggggccagcccgggggcccggggccatggatgtgcgccgatctgagaggtgaactgaacgttcgctgaggatgctgcagtcgccgcgtggctgtgacactcgaggtcgcgtcaaggcctggagctatgcattgatggcgggcgtgacaggctgtgctgatttggagggcctggaggcagtcgcgntgacggagcgaggacgggcagcgtcgactgcctgacgagcgaaccggggtggacccgggcgcatcaacgaggagatgcgcatggacaatatattaccgaggcagtaaccaattctacgatagccaagtcatcaaaccaaggaagagcgagtcaggctacgagacggagaccactggaagtggagcagcagcaggcctatcgtccagaaatgaagacggagatgaagcaaggaggcgacccagcagcttcctcccgcctgcaagcttctcaactcgagccagacaggcaggaattccatgagtcgaagagaggccttatgagagaaaaccggggacgggggtactttgagcaccgagaggatacggaggggccgctctcctcagcctcctgctgaagaggatgaggatgactttgatgatagccttgtggctattgacacctataactgcgacctccgacttcaaggtggcccgagatcggagtagtggctatgcgtcacgcgttgcgggctttgcgtacctgtggtcaggaggccgtgccaggtatggggtccgaggggccggggatgcgccgcgatgaagacccacggggggcagctccgggggaagaacctccgggccagagaagccgtgaaccccaaggtgggccggataccaggggcccgcgacccgtgtggacccggattggtgaagagaccctgtccaagggacagtaggcgaggggaacacagtcccacacccgggggggaaacaccgggaaacagggggaacacgcgaggacgggccgaacactaaatgggaaaagacc

SEQ ID NO: 587107 - DNA, 349 bp, Homo sapiens
aggctgtacacttcttatcgtccattagaaaagcattcattccttcaataacttttcctttacattcacaatgtaggctaactggtgcaagagacctaccttcagtctatcttggctcttcgactatgccttcctccctaagcttaatcatctcgagcttctgatttaaattgacaaacttgcaacttttcctctcacttgaacacttagagatcattgcatattaactggcctaatttaaatattgctgtgtctcagggaatatggagacccaagtagaggaagagagatgaagggaatgctagttggtgaaacagtcagaacaaacacaacatgtattaagttcact

SEQ ID NO: 587108 - DNA, 858 bp, Homo sapiens
ccgttactccgaggagataccagtacggtagaggagaagtcgaggcttagagggaactgggaggccactatgctgtctgcaatcgaagttgagggtgcgaaaaatgcagagctaataaaacttttaacttggagaagcaaaaccatactccaagcaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcaaccaacgaagccgtctcttgtgggaaatcttcctcccgacatcactgaggcaagcaaatgcaggaaactatttgagcaacatcatggcaaaggcaggcgcaagtcttcattcataaggcatcacaaggcatttggactttatccagcttggcaaacccgataccctagacggagatagccaaagtggagctgcgacactatgccaactccgtggcaaaaggcagactgcgtgtgcgctttgcctgccatagtgcatcccttacaagtaacgaaacccattccatcagtatgtgtaccaacgaactgctggaagaagccttaactggagtaggacaggtagacaagggcctggaagtccacaagacggcatcgatcagaggcgaaaggaccctcaaggaaacagggcctaggacgaagtacccagggacagccagctggcccggaaagcacgggacagatgaagtgaaaggcacctcaagggtaaacacaaataccacggacccgggaccggggaaccacaaggccaagaagataagggaaca

SEQ ID NO: 587109 - DNA, 1072 bp, Homo sapiens
gcaaccgacgaccctggttgcggcctcatactcagcaccatccgcctgcggccgacgccaggtgctcatgtgagaaagtgctaagagcacgctgagccccccggaggctagccccgggaccccagccgctgcccagggcccgcaggaggctggcgcagcgtgacctggacagggagactccagacacagccgtgagtgagccgagagaacgtgtctgagcccacaggaattgcggcacaaccaggccaggagggagcaacgagtggcatgattggcgcagatggagggacatgggacaccgtgaccgaatgcaggtcccagaggaaatccctggtcataaaggaatcatccacttaccagggagcggcaccaagaggacacagggtgacagacgggtgggattcaaggtattcacgcacatacgaacgacagctaggcacacgactcctctgtaggcagacaccattatcagatcgcaccaggatagtgaacgcccgcaagggaacgaacatagcagacagaggaacgacccgagacggttgacttggaaacctgaagacagttcccgacggggagaagtcgtggtccgttttaacctttgtgcagagcggagcccatgcgaggggccagtacgcaatcgagaccggagtaggtatggtgtgaagctttggaaacgcatggcggcattggtgtaggtcgtggaccgggtgcgcagcggtgtgaagcttggacacggcagaggacacattaaagagagatcaccgtgcgggtttgaagagtcgcggccatgcacggattgattgggcggtgtagaccatgcatgtaaacacaccggaaggccccctgtagtggatacgccgtgggagcaccgaagacattgtgatgagctgctgaaagcacattaaacaggggggataacaccttgtcagtggtggagatcatgctcccaaccacggggcggccccttgtagactactgcagtgagagcccatgaactagtacgtaggggatggcatggaacagacatgatactttcgactgagtacaggatacgggggcttgcaggcgaact

SEQ ID NO: 587110 - DNA, 415 bp, Homo sapiens
  misc_feature (6)..(6): n is a, c, g, or t
  misc_feature (18)..(18): n is a, c, g, or t
  misc_feature (205)..(205): n is a, c, g, or t
aagtanctttagaagggncctaaattgtaaaaataaattttttaaaaagaacaaaagaaataacgggtttccccccccccatagagggaaaggccccatagaaatgaaattttactataaaaatgcaacaactggcccaggcgcaatggctcattcctgaaatccccagcactttgggaacccgaggcaggtggatcacttgagncccaggagtttgagacaaccctggccaacatggcgaaaccccgtctctactgaaaataaaaaaaattagctgggcatggtggtgcttgcctgtactcccagctactggagaggcagtggtaccggaatcacttgaacctgggaggcagaggttgcagtgagccgagattgttccactgcactccagcctgtgcagcaaagtaagagtctg

SEQ ID NO: 587111 - DNA, 369 bp, Homo sapiens
ggtgatgctgatggtgatctagaggatcccggtgcttatcgatgcacactgtgccattggtggcatcgtttggtttattggggagttggctaagggcagtattttgctgtcaagactattcaagaaggcattattggagattccggttcattctgggtgtgtctctaacagatacagtatgtatacattggtataattgtggttgttgaaagtccagcttttgggaggtatatttgaaatgttttagggatgcttctaaggatcagtagtaatttttttagttcgcacctagagatgattacatggacctccccggagtgcttaccaaattaaaatgtgtccacgaagtggcatcgataaacaccgggt

SEQ ID NO: 587112 - DNA, 449 bp, Homo sapiens
gacttgccttgtttgtccagcaattcgatctgcgcaaccacggcctggagattgtccggctccaggcgcatggcttgctccagggcgttttgcgcatccggcagcagggcactgtggatgtacaggcgcgccagttgaatccagttttcggcggtttcgggctgggccttgattttcttcacgaactcatcgagcacttgctgcaacggcccgaagtacagccccagggtgtccggggacaagccgagcaaggcattggcagcggcaaaccgtacgctttgttcagggtcatccagccccaaaccagcaacagggtgcgctgaccggaaggcaccaggccggcgatgctgtggatcgcggcttcgcgcaccaacggcaagtcgctggtcaggtctttgtcggcaagcttcaaggcttgggggctggggtagttaggcagttcggcatgc

SEQ ID NO: 587113 - DNA, 299 bp, Homo sapiens
  misc_feature (162)..(163): n is a, c, g, or t
  misc_feature (214)..(215): n is a, c, g, or t
  misc_feature (239)..(239): n is a, c, g, or t
  misc_feature (268)..(268): n is a, c, g, or t
gcaggatctaccgtagtcgctctggtagggagacttggtgaatacagtctccttccagaggtcgggggtcaggtagctgtaggtcttagaaatggcatcaaaggtggccttggcgaaagttgcccagtggtggcatgtgcagccccgtggctgatggtgtanngcagtcatcgataccatgccatcatgatgcagcttcttagtgcacatggtnngcggagacgatgccatgtgccctnctggtgtgcatgggatgaggcgtaccatngcacagagccgcagctggcccctgtcacctt

SEQ ID NO: 587114 - DNA, 484 bp, Homo sapiens
ataaatgtatgagcatatcacatcacaggaggagctatacagtataagaagtacaaaaacacactagacgtcagaagaggtcaaatcctcctaaactctagtttatcttaacatctggctgctaactttggggaacaaggaagacattgccatctctagttggctgcagggagtattcactaggagaataaggtaaccatcttcatcacgtagcaggctgaaaacttcgagatataaggtgctgagtcgtaatatcagtaggtgaaggcttttggcattttcgccttatgctttgaggcagttcatctttttcatctttcaaatgatctggatcttgctctagttctactatattttccagttatctttttctgcaattctgagcagccactttattcttacccctccgacgtatatcccgaatgtatgcaagttgagattcattgaactggtctttggacctcatttcggttaagtccacaac

SEQ ID NO: 587115 - DNA, 360 bp, Homo sapiens
gaagtgatctaagatccataagcgtcagctcaggaggcatgtgggtcagtaagtacggcttctcttggtatcacaggaatctgatcgcaggtcaagttactggacctctcaaaatgggaataaggacattccattcatctgtgtttatataaggtcgagccagaatgtcaaaatagtaggaccaagtcaatgttggcaaccagcatcttgcttgtctgatttggtttgatcccaggtcctcggaaccaacaggtggaactttgatatcaaactcatacagctgtctcttggctattggcaaggaaaactgtcctgtgtgatagccattggtctgaggtatagaagatgtaagtgttgttg

SEQ ID NO: 587116 - DNA, 101 bp, Homo sapiens
cagaactggctattctagtccctatacagttttaaaggcaagtgctgtaagattatgtttgtgtggaacgtatttttgagaaagataattgagattctgca

SEQ ID NO: 587117 - DNA, 322 bp, Homo sapiens
taatttaacagtggaaatgcacagttaaaaatgagtattgactgggcacagtggctcacacctgtaatcccagcactttgaggggctgagtcgggcagatcacttgagtccaagagttcaagatcagcctgggcaacatggcaaaaccctgtttctagtaaaaatacaaaaattagccaggcgtggttgcatgagcctgtagtcccagctactcaggaggctgaggtggcagaataacctgagctcgggaggtcaaggctacagtgagctaagacggtgtcactgtactccagcctgagcaactggagagagaccctgtctc

SEQ ID NO: 587118 - DNA, 274 bp, Homo sapiens
ttgcgtgagccgagatcacaccactgcactccagcctgggcaacagagcaagactccctctaaacacaaacaaacaaacaaacaaaaaaaaaaccagatcttgactcaataacctaactctgaaaacttaagaaactagaaaagcaaactaaacccaaagctagcagaagaaaatacataacacttaacagcagcacaatgaatagagaatagaaaaacaatagagaagccaaaagtttgtttctttaaaaattttcaacaaaattggaccaca

SEQ ID NO: 587119 - DNA, 239 bp, Homo sapiens
gtgtctctgcctgtggacaagagtacgggaaacagagaactagattcactatcatctaactgacaaggtgccgctttcgagcaaggtaagacattgacacgtatggtccaggacgctgaaaagtacaaagctgaagatgataagcggagggccacgttgtcatccatgaattcgcttgcattcctatgccttcaacatgaaagctcactgtagaagatgatcaaacttcaaggctcatg

SEQ ID NO: 587120 - DNA, 337 bp, Homo sapiens
acagctgttctctaccagacaattgaataatctattaacatcttggaagaagaggaggttgactttatctattgtgcctgtcccatagttgtgcagatgtgatcctgccaacatagttcatgactttcgcaagatacttacagcctatgtagatcttgaactggattagtgctatctgatccctctaaacacttccatttgtttatgccagctcagaaatcgactggtagctttctgttattaacatcatggcatggatcatatttgcctcattcctattttattcattaccactctgtttttactgatcgccttgaatacattgatcacctggctt

SEQ ID NO: 587121 - DNA, 813 bp, Homo sapiens
ttcacactccggatcagatgttccgtgtgccgtgtgtagctgagaggtctgctctccgagctcgctcgtcgctgtgacctcttggcttgccattgagactcctctgatcctggggtcttcgggatccccaggtctcagtgaggactgaaccaagacttacccgtaagttgccgcggggcctttccgattcccctaggccattgcccaagttcttggccaggctgatgggactcagcgaggatgtctctgcaccttgtagattcagaaagctgaatggagtacgagggacatgctggaccaatggagatctcccagttcgtatctgaaggtctacagtgtggatgaactgagtgaccacatacccagcttcacgatgtacaatgacttcaaggatgtggggcagatgctgatgggcaaactagctgtgatccgaggtgtcaccacccaaagagttgtatccagagtttgggctggacatgaatgactgagcaggctcatcgccctttgtgcacagctcccaggacagaagggtgtggcccatgataaacatgagagcccaacagcatacctactgagtttccagcgtagacgatgccagaagcactttgctagagaggccaagcccaatcaggaggaggctagagaacaggcgggcatgcaggacaggggtgttcccagctcctaggttcctgaaatgtcgcagtgatacttgtgtaggggtaatgtacttcatttgcatagggttctcggccgggagctaaaccaaaactgggggttttttcgtgcccaccgtttcatgcctggggtggcggc

SEQ ID NO: 587122 - DNA, 135 bp, Homo sapiens
cacgagggggttcacaatgatggacaccttggtcacgaactcctgatatcatgggatacacccacatcggactcccaggatgcagggactgcacgagtagggcaatgtcaccaagctcgttgttcttttttccgc

SEQ ID NO: 587123 - DNA, 331 bp, Homo sapiens
ataagcttatagtgttgaagctgggcatggtgttcttgcctgtaaacctggcactttgggaggccaaggcaggcagatcgcttgggcccaggagttggagaccagcccgggcaacccggcgagatcccgtctctacaaaacacaaaaatcagctgggtgtgatggtgtgcacctgtagttccagctactcgggagaccaaggcgggcagatggcttgagcccaggaggtcaaggctgcagtgagcagtgatcatgccactgcactccagcatgggcaacagagcaagaccctgtctcaaaaaaaaaaagaagggaggggcagggcaatgtg

SEQ ID NO: 587124 - DNA, 311 bp, Homo sapiens
cccccccccccccccccccctttttgggggggcccctgggtaaaaaaaaaaaaaagggccccccaaaaaagggttttttcccgggggcccccccccccgttttcctgggttaaaattttattggtttttgaaagggggttttttttttaaacccaaattgggcccaaacccaaaacttttttccaaaccctttgggggcctttcccaaaggtcccccccctttgggggttttgggggcccctttttttccccaaaagggaggccggtgtgtttctttttttttttaatttttaattttttttggggggtga

SEQ ID NO: 587125 - DNA, 248 bp, Homo sapiens
gaaaagggctttattttcaaaaattaacttcaaataagggtataaatgcactgttgctttcctcaacatggctcacaaattctatcccagatctttctgaagatgaagagtttagttttaaaactgcactgccaacaagttcacttcatatataagcatgatacttactctttcgaggtgcatatatttatatacaatgtagagctctgtatactaggattttcaggtctcacagtatcaagtataca

SEQ ID NO: 587126 - DNA, 178 bp, Homo sapiens
gaaacccgctgccgaccttactaccagacaaccttaggccaaaccatttacccaaataaaggtatagggcgatagaaattgaaacctcggcgaatagatatagtaccgcaaggaaagatgaaaaattataaccatgcataatatagcacggactaacccctataccttctgacataat

SEQ ID NO: 587127 - DNA, 239 bp, Homo sapiens
gaattcccccccccccccccccccccaaatttagattgcttgtgattccgaactccagttggggtttgggggttgggggaggggaaattaaagttgattgggaggtgggtttctgaattttcagagaggaaatggttgggaatttgtgtaaatctggggaaaaaaaaaatcctcaaaccttttaacttttttaactatggaaatttccaattggacccaaaaggatggtggaataatga

SEQ ID NO: 587128 - DNA, 350 bp, Homo sapiens
cctatggagtatacggtgggaggagcaacgccgtttctctttggagctgagaaaagtcaatctctcatttacctatgacaacaacagttcagttcctcatgcaaatacatagacaacccaaactgagattcatttagggagaaaaagcaatagagaagaccctttaggatgcatctcttgaactagaattaggatccttaaatcacagccccctagaagggagaaaaaaaaaaaacacagccaaaaccattcccgtgttaaacggtgctcagccaccccttcttgtgtaggttctcgatctgccattacacacgccaaggtcaattcctctcacagtggcgctcgtaaag

SEQ ID NO: 587129 - DNA, 101 bp, Homo sapiens
ttgctgctcaggattcagaacacctgacatatgacccttgaccactaaataccctccagaaagaagctgataacagagcggataccgacaattatggccag

SEQ ID NO: 587130 - DNA, 1548 bp, Homo sapiens
  misc_feature (155)..(155): n is a, c, g, or t
  misc_feature (913)..(913): n is a, c, g, or t
  misc_feature (1160)..(1160): n is a, c, g, or t
  misc_feature (1168)..(1168): n is a, c, g, or t
  misc_feature (1238)..(1238): n is a, c, g, or t
acgacggtccggttgcatcactgcatggcgcccactagtaggaacccgtcggggaaccaactacgcagtggcctcgttgctccaacaggtggtagacatttcacgcggtgcgaccacacgatgggactgcggtgcagcgaagcctctcggggggngtttacaccagcacggtgaacccccgtggtgtggcaccaagggggtctttccgactgttgtcacgcgcgcacaattgtggtgtgacccgcgtgcgacaccctgacaagggggccacaacacagcagcacgggggtgggaaaaaagccacaccccgttgggggcacccaccggtctcgggtcggggcacacagggggctttttcaaacgggaacacaccctgttgcgagacccctcgaaaaggatggggcaacccgtgcctctcggcacaatcaatacaaacaagaggggcaatttttgggtcgcccccgtagcacaaaaatggccgaaacagtgtttgttggccatttaagaaggcgccctgtctagacccccatgcggggcttggtgtttctctctggggaggttgcccccacccctcgtggaagggaaaaaattccccattgggggggtggccacgaccacggcccggtatatgcctcctaattataagggcaaactcgcgcggggaacaccaagccttttaaaacgctttttctcccgaaaagattctttcggggtatacacacggggcccccccacaccctaccgggaggggagaccctcgtgaatacactcggcaaacgctggaaacacacgtgggcccacataatccgcggcaacagactctcgcttttgtctcgccacaaaaaagagcactttctgtagagaaaaacttggggcacagcgcgctcttctctgccacagggggccaaacagnctgtgagacaaatcctctcgcgactcacacccacaggagagagatttataccccacagcccctcctgagagttgagaggagagtggagaggagagagaggagaagtggaaggagagaatagcgagaagggggatgagagacacacagaacgctggttcacacacacttgccccacacgctgaaggtgtctcaacgctgtggagtgttttttgcgtgtgtttccacgcctcttcctcccgacaccccnacactcgngctctctcttctctaaattatagagaagtggagaccacgtgtgtcacacctctctcgtggtgtcctcttnttgagagaacactgtcacgcacgttaagggtgccactcttccacaagagtttgtgcacatgtgccgcttatagtggagacgttcacgggccctcgtgaaacctcgtggttcctctgtctggcgcaagttgctcaacaattcacccacaagtttgttttcactgagtcctgagtggcccaaggaacacccgctgtgggagtttttttttcccccaaggagattttcaacacacaccggagaaggaagaggtaatttcttaagagagatcatcattttatggtgccttgaaataaaaatacttttaccttga

SEQ ID NO: 587131 - DNA, 263 bp, Homo sapiens
aacgggtgatgcggttgactgcagagaggaacgaggaccagagccaataggaccagtgatcagcagggtccggggtctcatgagatctgccattagccgtcacatggcgtcagggattacatagcgtcagagtcatgcagaacataggcttgatgagtagtagtggtgaagtccaggataactataatcgaggagtgaagggggtcgagtgatcacataagtttgcaggggatctcatgtagttcagggtcatatggtggtca

SEQ ID NO: 587132 - DNA, 1042 bp, Homo sapiens
ttggtgtgacgctgttgcatattattttctcttgttctttttttctttgtatcggctcttctatgtgctacttgtttctgttattgccgctttgcttccactgtgttttgggtctaatttactcttctctccgccttttctaaggagtctgcgtttctttgatttttatatttctctccctgcaacccgggtcttaggccccctgttggttgtttgtgagatatgtgtgttatgggagacgctcttgtgtgggtgaagttatactgcctttttctccaagtctttctgttatttgtttcacgttgcgcttggttttaaaatgtgtgcccctgagtatttttatgaacctcatgctagttttaaagggtataaattggttcaaatttatgagtccgatatatagtgataatgttaacaaggttgtaattgctcccgagtttaagggtatttttatctctgtgctttctttttcctggtgtttattaatatattgtgtataaacctcctagctactgatatctttattatagcccttagacttaattttaagttctttaaaattagcgtgtataacttggattaaggaagaccctgggtactgtgtactcgtgatagctattgactttagtagcccattatccatttttccctgtataaattcccactttttattgctgcaccataaattttttaatgtctttatattgtgatagctatgtcttttattgccagatttattggatgtttatgacacgattttactctaaggcttgtggtttttataacataatatatttagttgatagtttacctcataagatgggagtagattttcatctgcctgcccatgggataaatttccgtcttagctaaaaatggaaagttgaactggataaattctttgggtaccccttagacctctgattttaagtccaaagccaatggggtttaattaaatgagactacttccctttataaatatattttcatccttttgaaagtaagtgaaatgttaataaacttatttttttttaaaatgcca

SEQ ID NO: 587133 - DNA, 281 bp, Homo sapiens
tggaacctatttattatataaagaggttgccctataaatttacataaaaaaggccggttgggtcttttgttgtaaaaaaccagtgattttttcataagggtcttttaccattggaaaaaatgggcagcccgccgttttattttatttttgtaaggtttttaaaacatgggaaagcaaagaaaacccagcctgcccttttaaatgacgggtttgccccctttgttgggaaggactggatcctgggctggtagcattttccataaatctctctgtgaaagtga

SEQ ID NO: 587134 - DNA, 351 bp, Homo sapiens
  misc_feature (14)..(14): n is a, c, g, or t
  misc_feature (346)..(347): n is a, c, g, or t
atgtagactttagnaaaacaatatgtcaagtttcctataaaaaattctgggcctgggtgcaagttgtcacgccctgtaatccccagcactttgggaggccgaggtgggtggattacctgaggttaggagttcgagacctgccctggcccaacatggtgaaaccccatctctacttaaatacaaaaattaggtgggcgtggtggcgggcacatgtaatcccagctactcgggaggctgaggcaggagaatcgcttgaacccaggaggcggaaggtgaggtggcagtgagccgagattggccattgcactccagcctgggcaacaagagcgaaaccccatcttaaatnntctt

SEQ ID NO: 587135 - DNA, 355 bp, Homo sapiens
  misc_feature (97)..(97): n is a, c, g, or t
atctagaggatcccggcgagtgcatggctcatacctataatcccagcagttcatgaggctgaggcaggcaaattgcttgagcccaggagttcgagancagcctgagcaacatggggaaacacttggcttttacaaaaaatacaaaaattagcctggcgtggtggcgggtgcctgtaatcccagctacttgggaggctgaggcatgagaattgcttgaataccaagatcgtgccactgcactccagcctgggtgccagagcaagacttcgtctcaaaaaaaaaggaaagaaatggccaaacccattctaacctttgggcaactggcaacccttgatcactctatcagccaattgca

SEQ ID NO: 587136 - DNA, 875 bp, Homo sapiens
gccttacgtgcccgagctccgtctcggaggcgggggcagtctgcagtggtgacgaggaaatggtagacctcagtcttgcggatgcataaacaagaaccatgtccagacattgagggcgagatacacgcgggacttcattgccagagctagaggcagaggcctttgatgatgttgtgggagaacactgttggaacaaatagactatattcctctcctggatgtggatgagaaaaccgggaactcagagtcaacgaagaccccgtgctcagaaactagccagattgaagatactccatcttctaaaccaatactcctagccaatggtggtcatggcacgtatgaagggagcgatacctacagggtctccagctgaattccttgaagagagaatgggctaccaggaatacccaaatagtcagaactgccagaagatacccagagttggtgaccagactgagcaagtggtcgatcctatccagactgtccctttaggatgtaccacttgatgatgactgggggattagtctttccctccagtgcgacaggtgatacgttcaatatttgcagggacaagatgatcccttgaagagacgagggacggatgtctcccctgaagcacaggtggtgggaactcagcgcgtggctggggaggcctgaggagtctcaaggatcggagttctagtttccccagaggtcgtggagcaccttcctgggcaagggacttcctttagagactagccacgagaacaagggatcagaggaggcagagcccagcttggacaacgggtgtggacacggtggccgccagaaggatggctccccggggtcagaaaacgggtggcgcagattgaccaaaaggcaggaggggacggaca

SEQ ID NO: 587137 - DNA, 927 bp, Homo sapiens
tgtatggcctcgatagtatgattgtcctctagtcacggattgctgatgttattgcaagaagtgtatctgagtattatatcaatcttgcgaattgttaatacgattcgttgtatgcaatacgtcaagtgagccagtctgccctctgttcggggaggctcttcccggtgacacgagtccccgatgagtggacgacatcaattactttgcacagcccacactgaaagcaggatccacagactgagggcccagggtatttcaccatactgctgatggaaaaacctgacgtccttgctggacctggtttcgcccatggttgaacatgctgggaccgtcgcgtatcattcctatgcctacgttgtgcattcgcgttgaacgtaattgacctgatcagggccccatggatttgtgaaactctgtggaatatggcctggtcaatgctgaagagggcatcccctgagacccacagtaggcaagctcagacgaaacatttgtgcccagaatatcctgtaactcttagcagaatccgtgagcataagtaaaatgcccggttgagcgtcatcacacaggtttcagagaggtaatgcgttggatgtacccaactgaatgtgagtgcttataaactcaccaagatctgccttatgatgagtcttcccattcgcttacgaaggcattataacaactcatggaatactgggtcgctctctacagcacgtctgtccatgacgacttcgctttttatgacccgttaaggtcacgcactccattcattgtgaggttcacctttggcatgacttcagttgtccttggaatgagcgcttgtcgaccggttctgacacccccctaattcgtttgcactcttcccgtcaaattcctataagtcttgctcttccaaaattttttttcaggcgtctgtccccctgaatggcc

SEQ ID NO: 587138 - DNA, 512 bp, Homo sapiens
gtcaagtaggtattttaattttatgcagtattgaagaaaaactatgattatattttcctatcagagtagcctttaattccaagttttggtggctttcataagaacagacaccctcaggcccagaaaaagtgacatgcatgcatacctctttagtaacttaccatgttgtccccgtgaagcagcaccagtcatgtcccagtgaccaaggagcacataggaggggacttggggagcgtgtgagcctcagtgtggccccttctcgtctcctgcagaattgatccttttgtttctcaggggagggagcatatctggcatgcattgaaatacttcttctatggaagtgccttttatatgataaattgagaagcacttattaattatctgaatatgatacactattgattgaaacataatctatgtattttaatatatagaattcaatgtatgtattccttactcttaaggaactaacaaaataaaatatcacaaacacggaagagataaaatataaa

SEQ ID NO: 587139 - DNA, 282 bp, Homo sapiens
atcgctttatcttcaatttttttctttaaaaggagtagttgtgtcagggggttaatgctttatgacaagaaaaaaaaaactgcggctagaaccaacttattcatcatcatcatcttcttcttcatcttcatcttcttcatcttcctcctccttcctcattcctcttcattcttccttcattctttccttccttctttcctttttcttttctcttgggcttttttcaggcctttgaccaacttcgcgctttttttgcttgcattcgagggcttttccttttag

SEQ ID NO: 587140 - DNA, 387 bp, Homo sapiens
gtgttggtggttatattaaaagtccttgagtattttgcttttcatgatcttgctcactgcaacttccgcctcccaggttcaggcgattttcctgcctcagcctcccaagtagctgcgactacaggcgtgtagccccacccctggctaatttttgtatttttagtaaaaatgaggtttccccatattggccaggctgttctcaactcctgacctcgtgatccgcccacctcagcctcctaaagtgctgggattacagctgtgagcccccctgcccggccacttttgtatgatttttaatgtatttgtaatttacctaacaaattgcctaatttgctatgttaatgtatttatgaattaaaataaatacggctgcatgtttgtggttca

SEQ ID NO: 587141 - DNA, 404 bp, Homo sapiens
cagaggtgccaggggtaacttagaagtaggagccttttattttcttatttatttatttatttatttatttattttttgagacagagtctcgccctgtcatccaggctggagtacagtggtgcaatctcagctcactgcaacctctgcccaccgggttcaagcaattctcctgtgtcagcctcccaggtagctgagattatgggtgcctgccaccacgcccagctcatttttgtagttttagtagagatggggttttgccatgttggccaggctggtctcgaactcctgacctcaggtgatctgcccgcctcggcctcccaaagtgctgggattacaggcgtgagccaccgcacctggccagtaggagccttttctacgataaagctaaaataacatttttaaaa

SEQ ID NO: 587142 - DNA, 139 bp, Homo sapiens
ctatacctagtgcagcgtacagaatgctatcgttatgacatttacgtatcataacataatgtagctcataaagcttatataaaaattcctggtcacgtgtctgtgaatctttaccatagagtgacattgatgtaccttc

SEQ ID NO: 587143 - DNA, 266 bp, Homo sapiens
ggtccccttttttaaaagtgggggaatattgggtttaagccccccggaaaaattctgctttttgaaaatcccaacttaaaccccccccccttttggtcctaggacagttaaaaacccgggtttttcccccctttaaatttttgcctttattaaaaccaaaattttaaaagccggttaaaaggggggggaaatttttttctaaaaaatttttaaataaaggcccaacttgtttggggaaaattttgggaacaaaaccctttttccta

SEQ ID NO: 587144 - DNA, 124 bp, Homo sapiens
gatctttgagcgacaggaccaccaacaatacatgcagatattgtgtgtgtggacagaaggtactttagacattcagttttgctatatagaaacagaatgaataaatgaactatattattctata

SEQ ID NO: 587145 - DNA, 172 bp, Homo sapiens
gagtctagaaggatcccccttgcggatctcagtaagtgcatgtggactataggtccaaggtctccagagtggtgcaagctggcgtctgtcaatgtcctactgagacagcacagaccaacctagactagcaaacatttgtgttattagtctagaacaagtctatactatatag

SEQ ID NO: 587146 - DNA, 228 bp, Homo sapiens
ggggggctgcacctgcctgcctcttgcctaaggcgcgatttgaatctctttctctcccttcagaatcttatctggcttggatcttaaagaatcactaccaagacgagactcatgatgagcagtgttggacaatggactggttgagcccatccctattataaaaatgtctcaagcaaccgggagctgtggttgacttctctcctacaagctttcccagaaaggatacag

SEQ ID NO: 587147 - DNA, 1814 bp, Homo sapiens
gccgggaaagggatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 587148 - DNA, 1177 bp, Homo sapiens
  misc_feature (656)..(656): n is a, c, g, or t
ggccaatgtggggctatgaacagcactgagtatccccctaagtgaccttggggtgctctgtgaccctcagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtgatgccatgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccaaaaaaaaaaaaaaaaaaaaaaaaacaaaaaanaaaaaaaacaaaaaaaaaaaaacaacaacacaacaaacaacaaccaaacacggggggggggagcacaacgaaaaatacccaggggggggacgccaagatacgacccacacagcttcttgaacacaaagaggcccacataggaggagagcccaataaaacccacaagagcaaagcgcggcggccgagaatataaaaaagccagcggatagtacggggaaaaacccgtgaccaacaggggataccctatgagggagaggcgagccacccactccgaggggggggggggagcaaaccaactcagcgggggaccccaacacaccaaccaccgcagcagaatgataataaaacagccgaccccaggagcggggacactaaaacaacaacataacgggcagaggaacaccaagaggcgggcgagcaccacacacacggcagaaaaaagcgcgaggacggcaggacaaaaaacaagtacggcgcaaccaaagaaacaaatactaggcaggaccacacatatattcacg

SEQ ID NO: 587149 - DNA, 1008 bp, Homo sapiens
  misc_feature (890)..(890): n is a, c, g, or t
  misc_feature (915)..(915): n is a, c, g, or t
aattcggcagacttgatattatatgagaattttaggaacaaggaagagctgaaaataacttacggtgttaacctgaccaagagaatggttaggttaacatgaacataaatgaacttaccagcaagtgtggagtttttctgaaagaacaatacgaatctgattttatcattacagggtggaagccacatgtgctgttattaagtggaaatgtctcgtgaacatgtggaaagtgatgactggaacttcagatgaaagtcaaagctggagataggagattcagaagtcaccccaccaaagaaggaatggttaaagctataagaactaatgagatcctatttatttgcttattcaatcaacatatgtagaactaaatgctaagaatgtaatgataaataagacagaaagggaccttgcccatatggtatttacaatctactgccagttcataatctcctaaaaaataatgtagaagaacaataacagaatcaaagaaatcttgaacgtctatatttaaggcgttgaatgtaccagaaaaggccttaaaggaggcagaaaaatagcaatgagacaagtttgcgaattctaaaaccaagacaggatttcagaggaagaaaacgcatgtaatatatgggcaaagcttcacacacagaggtgatgcatcctggtgaccaatattacaaggacgagagatgatgactgaagacaggctggaggacttggattgaggtcaacgggatgaggataatttcacccatggtgcgatggactgaacagcaggtgcgtcataattgggttaagctttgagaaaggggagactttagatgcctacactcattccggaatcgggcttcctaaccatgaaaaagcccaggatggccgggtatctgccngggtcaaccaagccattttttttancacgggtaataaggtaacccggattctttaagccccttggcttaggaaccccccaaggggaggccttatctcgagggcataggcacttttccg

SEQ ID NO: 587150 - DNA, 2105 bp, Homo sapiens
  misc_feature (1104)..(1104): n is a, c, g, or t
  misc_feature (1264)..(1264): n is a, c, g, or t
gccgggaaagggatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtgagtnaggggctatgatgggtgtccttcgtgtgccatgaaaatctctggcaagggtcacgatgtggaggacacctggggctgggtttcctgtcaagcccacttggcggagggtggccccagggctgcccattccttcctgtaccagggaccaggcctctatgctnactgagcctgggttgtgcgagaaggtggcagagctctccctcgtgccctggggactgtcctgggcccatgagctgatgagagcagagtctgagctgcactgccttatcatttcttcctgcccaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 587151 - DNA, 1605 bp, Homo sapiens
gccgggaaagggatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 587152 - DNA, 2356 bp, Homo sapiens
  misc_feature (1835)..(1835): n is a, c, g, or t
gccgggaaagggatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgagaaaaaaaaaaaaacaaaaaanaaaaaaaacaaaaaaaaaaaaacaacaacacaacaaacaacaaccaaacacggggggggggagcacaacgaaaaatacccaggggggggacgccaagatacgacccacacagcttcttgaacacaaagaggcccacataggaggagagcccaataaaacccacaagagcaaagcgcggcggccgagaatataaaaaagccagcggatagtacggggaaaaacccgtgaccaacaggggataccctatgagggagaggcgagccacccactccgaggggggggggggagcaaaccaactcagcgggggaccccaacacaccaaccaccgcagcagaatgataataaaacagccgaccccaggagcggggacactaaaacaacaacataacgggcagaggaacaccaagaggcgggcgagcaccacacacacggcagaaaaaagcgcgaggacggcaggacaaaaaacaagtacggcgcaaccaaagaaacaaatactaggcaggaccacacatatattcacg

SEQ ID NO: 587153 - DNA, 2222 bp, Homo sapiens
  misc_feature (2042)..(2042): n is a, c, g, or t
  misc_feature (2169)..(2169): n is a, c, g, or t
  misc_feature (2204)..(2204): n is a, c, g, or t
gccgggaaagggatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgaggctgtggggtaatgagcactcagcctttggggtacctgttcctaaagtgggccaaaagagccctccctacatgatgccccagtttttgctttattcctatttcatacagcttctcgggggagtgagcaggctacactccagaacaccggtatgggaaggagtgggagaggaagccagctttggcctcacaggcacagcttgcaagcaggccttgggtctcccagaggnacagcttgcaagagccctacagagaaggtgactcaaaggatacaccagtcaccagtgcaagactcttcgctcctgtttttctcttattttttttttgagacggattcgagtactgtagcccaggctngagtgcagtggcagatctcggctcattgcaagctncgcctcccgggttcacgc

SEQ ID NO: 587154 - DNA, 2263 bp, Homo sapiens
gggtgccaagttatgataggtcgagccgggtgttaatcgtgcacgtggcctggccgctccgctgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgccccttccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 587155 - DNA, 276 bp, Homo sapiens
  misc_feature (240)..(240): n is a, c, g, or t
cagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaatttgagagcaatcattgaactacatgaaaaattacagaagaactcagcgttgnctattctacgggtcattagggtcgttcagcatttcg

SEQ ID NO: 587156 - DNA, 1903 bp, Homo sapiens
gccgggaaagggatacgtgcttaatcctggtgcagggggcgagcatggccgcagtgagcacccccagctcttgcctggtttcccgggacactagggtggggcctgaggagtggagtggcagctgaccctgtctgtgccccttccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 587157 - DNA, 1279 bp, Homo sapiens
gccgggaaagggatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtgatgccatgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccaaaaaaaaaaaa

SEQ ID NO: 587158 - DNA, 174 bp, Homo sapiens
  misc_feature (161)..(161): n is a, c, g, or t
ttccccgagtgcacagtcgaagccccccggtcgtagcccctgcaccgaaggcctccggctcaggtggccgccagggcagtgtctggaggttcgctctcgctgaggcgcaaacttgggtgaggagtctggcgtccctgcagctccccagcccgcccggtacntacccagcggccg

SEQ ID NO: 587159 - DNA, 543 bp, Homo sapiens
ttggatggtgcgcggctcggagggggacgtccctggccgacaaggacatgatggccaaagacagcaagttcaaaatgcccaagttcaagatgccgtcgttcggggtgtctgccccaggcaagtccatggaggcatcagtggatgtgaccgcgccaaaggtggaggccgacgtgagcctcccttccatgcagggggacctcaaggccactgacctcagcgttcagcccccttccgctgacctgggggtccaggctggccaagtggacgtgaaactcccagagggccccgtgcccgagggagccagcctcaaagggcacctgcccaaggtgcagatgcccagtttcaagatgcccaaagtggacctcaagggcccccagatagatgttaagggccccaagctggacctgaaaggccccaaggcggaagtgacagcccctgatgtgaagatgtctctgtccagcatggaggtggacgtccaggccccgagagcaaagctagatggtgtgcagctggagggggacctgtccccggccgacaaggatg

SEQ ID NO: 587160 - DNA, 1555 bp, Homo sapiens
gggtgccaagttatgataggtcgagccgggtgttaatcgtgcacgtggcctggccgctccgctgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 587161 - DNA, 252 bp, Homo sapiens
tgcatagtcttccaactaaccaccttgagtgagacagcaggaaaaaaaaaaagaaaaaaaaaaaacagggaaagagagggccaattaaaatcagactcatccctacaaaacttaaaattaaaataaaatgaatcaaactcagaggctccaaagttggattaaaatccttaatccaaaggtccggggtgaaatatgttaaagatgtgtaaggggtgcatgaatggcacaaggccaacagctgaaaaattggcc

SEQ ID NO: 587162 - DNA, 648 bp, Homo sapiens
  misc_feature (1)..(1): n is a, c, g, or t
naaactcacctgaggaacatgtgggcatgccctatgagatgtcccaatgtaatgatatgatgatatatgctatgtcatccagaacgttaagtttgtcccatgtaatagacagattctatgcgagtatatggcctatccatgtggtcatatagttcaaaacacattatctctgagcatctctcataaggaggtgttaacttcttgtctcatcataaggaccacatcttataatggatccaatagaaccggtaatgtgatatcctatggcatatcaacaagatatggcataccttcatagttataagcggtaagattaaatctaagttcgccatccagtattcttgcccatagaaaaggagtcttatagggagcagggatatagttctttctcttatgatgtagatacaaccttgactttgagtaagcctctatgatagagatcgggctactcagtaagcatgcagtcagtgtgccccattagtgtagagaggaaggcctgagtagtgttgatgagagcctcaggttccatataggcttggcatatatcttgggcaagtcggccaatctatgatcttatattgacgtgtctatgcatgagctctcttcgctccacatactgggagaatatttggacaactccccgataag

SEQ ID NO: 587163 - DNA, 193 bp, Homo sapiens
tatatggttattttctctgccctgtgtatcgataaacatttcagtctgccttcatgatttctcctggagcaccatctcatacttagagagactttccaaaatagccatattggaatatgataccattcgtcaggaaacaaccacaaaatcaaaaaaaagcaagaaacgagacctccgagaccgctgaaaaatg

SEQ ID NO: 587164 - DNA, 402 bp, Homo sapiens
  misc_feature (163)..(163): n is a, c, g, or t
ggggaaagccaaaaatcaagttggtatggaaatccccaagttccccccatgtttccctccctacccatccctgccctctcctattaaatggggttaaatagttcacctgagggtggtggcttatgcctgtaatccccggcattttgggaggctgaggcgggantattgcttgaggccagttcgagacccagcatgggcaacatgacaagatcctgtctctacagaagtaaaaaaaaaaaagaaaaaaattatctgggtgtggtagcaaatacttgtagcctccctcagccggaaggcttaggcaggaggatcacttgagcccaggagtttaaggttacagtgagctataattttaccacctcactccagcctggctgacagagggagaccctgtcactttaa

SEQ ID NO: 587165 - DNA, 380 bp, Homo sapiens
ttatggcaggtctcgtttttgttttgttttgttttgtttttgagatgcagtctcgctccgtcacccaggctggagttcagtggcgtgatctcaacatcactgcaaggctccgcctcctgggttcaagcagttcttctgcctcagcctcccaagtagctgggattacaggcacaagccaccacacccagctaatttttgtgtttttttagtagagacagggtttcgccatgttggccaggctgggctcgaactcctgacctcaagtgatccacccaccttggtctccgaaagtgttgggattacaggcatgagccactgagcctggccagtggtagttttcattgccatgcgtggattgccagagacctgagcaagccagg

SEQ ID NO: 587166 - DNA, 151 bp, Homo sapiens
  misc_feature (56)..(56): n is a, c, g, or t
  misc_feature (89)..(89): n is a, c, g, or t
  misc_feature (130)..(130): n is a, c, g, or t
gtccccttctcttttacagcctggaacaaacttgtatccaaatctaaaccactttngatactagaggtagctccaaatacaggtgatgncactcgagtatcaagagaggtcccagatgtgcatacaagantgtccgtttctgttttgtccg

SEQ ID NO: 587167 - DNA, 262 bp, Homo sapiens
ttccgtgcccagctagtttttttgtatttttagtggaggcggggtttcaccacattggccggactggtctcgaactcttgatctcaaatgatcagtccacctcagtctcccaaagtgttgggattacaggcgtgagccaccagaattagctctttcaagcctcataatatccctagaaagtaaggactgcttgtatctccattttcagattagggagcatgaagtccaaggaggctaagtgactctagggcacggaagatca

SEQ ID NO: 587168 - DNA, 462 bp, Homo sapiens
  misc_feature (265)..(265): n is a, c, g, or t
tacttttcaaaaacaaagacataactgggcacaggggctcacaatgtaatcccagctactccggagcctaggcaaaaggatctcttgagcccaggagttcaagaccagcctgggcaacatggcaagatcctacctccacaaaaaatttaaaaattaggcatggcggtgcatgccagtagtcccagctacttgggaggctgaagcaggagggtcacttgagcctacaagttcaaggctgcaataagctattatcacatgattacanttccattcttgggcaacagagcaagaccctgttcctagagggggcgggggaggtggggaaccacgcacacacaaagacacaagcaaacacattagcctaggcctacacagagtcaggatcattagatgtcactagacaataggaatttttcgctccattataaagtgaccactattgtacatatgattatcattgac

SEQ ID NO: 587169 - DNA, 402 bp, Homo sapiens
agcatgccccttaacctcacaacgccatatcatatgcgctaacgggtatttaagcttccatccttatgcctattaattcactcccctgtccgccgggaatgaatcaaatgtctgccaccaccgccctccaaaccttcgacatccaccccttccccggcagtgtcggcgccgagatcatcggcctggacttatcccgcccagtcaacgagcaggacttcgcccgcatccatcgcgcgcacttggactaccacgtcatcgtgttccgcgaccaacgcatcacccccgaacaacagatcgccttcagtcgccgtttcggcgtgttgcagatccatgtgctcaaacagttcctgttggccaaccaccccgagatcctgatcgtttccaacatcatcgagaacggcc

SEQ ID NO: 587170 - DNA, 406 bp, Homo sapiens
agacttaagttagatgtcaaagcaaccttataaagccaaactttcactaccgtactctttttaaatgatactcatatatcccagatctcttaacttgttaatgttacacctttcattactaaatattcgtccagctaattaggaccatatcatccccacattgcatttaatcaatattcatccgtcaaatcatggctatatttagttctacctgtccaattccactcttcttattatggtttgtctgcttataacacgctaatactacaatgttataaatagcataatagtatataccttcttaactactgtaatggcccgtcactcctttcctctctagcatcctttttctactcccttttcacgtaccatcatatttgcctttcctctacctttgttccatacc

SEQ ID NO: 587171 - DNA, 1428 bp, Homo sapiens
aagaaagaaaaagaaagaaattaatttaaaagccacctaaatggtgacaaaaattccagttgttctcttgagtatcactgtgggctcatggatttcacagattcagtattcccaggagccacgagtaattcttttttttttttttttttggagagatgcgcgagtctcggctcgggcgggtcagactgggaggtggaaggggggtggaacatcgggctcacgtgggaacctctccgcgcttccccggggttcaaggcggatttctttgggcgctctcagcctctcccagaggtagctgggagatggcggggcggcccacaaccattggcccggggaataaatttttttgggatgattttagaggtgagaagaagagggggtctcgcgcccaatctgtggggcccacgcgcgggctcgtggagacactctcgcgggaccctgcggggaccaaccggtggccctgcggcttccccaaggggtgcgtgggaagtgtacgagggggtggaggcgctattccacaaagccggggtcgtgggcgcaaaaggtgcattctgcttttgatatatgggctccaagagaacaaggtgcaccaaactttggggggcgctatttcaaagagaacctcttttcatataccggggggactcctatatggtgccttttattaaaaggagaactcttggatgagatcatcttttttaagagcacgcgaggactttgggcgtttctgcacggggggtgacacaagggggggggcgccccaattatttaatattttcgcacaactgttttccctggtggcgcttacaaagggctcttgtgggagaccccaaagcacaatttttgttcacacaaagggggagggcccttgggggccaccgctattaagcgaagcggcggcaaggacatgggaccacctgggggcacaactcagaacagtcctgagggatcccccaaggggggccctcaacgtggggacttcttgtgcgggggacacatacctcttacaaaaacaaaaggggtgccaaaggggtaaaaacccaaggggacaactagggctttggggggccccaaaaaagatgggcgctgtgaaagccgggcccctatataccgcgagaccccggacaaagcctttgtagtgaacgggagattgcctgtggggggacaaaagtgtgcgagggagagcggtaataacgcgtggaggagacactaggggggccagcacgattaaaggggagcggacaacagggcgaggaggctcacacaagcacaacgagatagagcagcgccaccaagcgaaggtgatggagacgagggcacgacggcagccaccactgagttagaaagcacgcagaaacaggaggcatgtacagtgaagaggaagagaggcatgaactcacgtgcagcagagaagggtagaagttgtca

SEQ ID NO: 587172 - DNA, 540 bp, Homo sapiens
taaggcaccccgcttccttgcttgcatcccacaagaaattccctcctcctatttatagcagcgaatctttccctaggtgaggagacggggtttatctcccctttaaaccccacctatcctggaaggggggtcaatgtgggcctttaaaatccttcctctttcttcctcctctattctctaaataatgatgggggtaagttataccccaagctccctttccaaaatatttcctcagtgctttgcagaaaacccccaaccaaaatgcccttttaaaaaagggggatttttttttttagaatgtaagctcctccaaagcaggggcaatgttttttgtatgttttattgggcccaggaccctggaaaagctccataaaaattttattatgggaggccgtgagtttttattataagggggagaaactgaaatccccaaccctgttttgttgcttgttttattatgccccccgatttaattggggaaaattggcccctttgaataattgtccccaatattacattcaaataaaagggccatgggga

SEQ ID NO: 587173 - DNA, 898 bp, Homo sapiens
ggtttttattttatttattttggtccaaaaagttacaaagttaatatgattgtaccatataaaaatgcagccttttccctagggcaagggaaggaagggcagtaaacataagggcacaggaatcgcagcaagcaccagtctgaaggcagggcccaaagtggggaaacggactgttgggcactgggggtaccccctgacagctggtagagatgggggagtgtaagagacccctctcaaagtggccagggtctgaggttgaactctaatgggggccaagagcacaaatagctaaggacagacgggcgagaggggaggcgggatagctaataaatcccaacgcgtatttgggatgacagtatggaccttataccaacagccccaagacccttctgtgctacaaaaccccagaagtaccgggggtatcaccaagatggcccatcacatatggagacgacaagatgagccactgagagaaagggagggtggcgagaaagacagaacgggggaaatggcggagacaccgggtggacaggacaaagagagtgagacataaagaagccaggaagagaacagacaaagaagaggaggaaaaatagcaagaggaaaacaaggacgagatagagaagagactacaaaacaagaaaaaaaaccaaggaaacacgaatccaaagataaaaaaactaacgcggacaataaccatgagaagacaaaaccaacaaagagaggaagaacacgaagagggacaccagaaaaaaagcaaaagaagaaaaaagagaacagaggaggggcccacaaccacactaacaggagacacccaccacgagcaaaacaaaggaaacacagaggagaaagagaaaaaacggaggaggaagaaagcaccaacacaaaaagacgagca

SEQ ID NO: 587174 - DNA, 109 bp, Homo sapiens
ttgtgccacactacactaggctaattttttaaatttttatttggtagagacaggtgcttgctatgttgcccagggcagttttgaactcctggcctcaagcaatcccctg

SEQ ID NO: 587175 - DNA, 423 bp, Homo sapiens
  misc_feature (209)..(209): n is a, c, g, or t
  misc_feature (272)..(272): n is a, c, g, or t
  misc_feature (277)..(277): n is a, c, g, or t
  misc_feature (283)..(283): n is a, c, g, or t
agctcacaaatttgtcatccagacataaaggaggcttcagaatttattgactcaggagttgaatgttggtatcaaggacctagatttttctcatcactctgcacttcaattctcaatgccctattgaacatcaggctgtagtaagatggctagagtgattcagggataacatctagagataaaaagagactccttttcttatgattttntctaagagaacggatttccaaagccccagcaagcatgcttcacatccatggcagagtgctcanatgtntacctnagctagcctcagaaggatggatcgctgtggcctcagagaccacctggatcttgggaaggtgtcagctctacctgtggcacttggctgagtgggaaagggatggaaacatgaataaagtaagaattaggaaggaaaaggag

SEQ ID NO: 587176 - DNA, 456 bp, Homo sapiens
ccacacgcctagggcacaatggagagggtaaccgctatttgcctactgttgctatttagctaggcttattccagcggtgtgttgcgtcgtgatgcacacatgagagaggttgctcatcggattcctgatttgggagaagcatgtgaagatcatgtgaaattagtgactgatgtaactgatttcgcactaacatgtgacgctgatgagtcagatgataattgtgacagattacttgataccctcttcggagacagattatgcacagatgcaactctacgtgaaacctatggcgaaatggctgactgttgtgcaagcacgatcctgagaggaatgcatgcttcttgtaacgcacagatggcatcccaaacctgactcgattggagagaccagaggatgatgcgatgtgcactagatttcatgacaatgaatagacattgatgcacatcttattggtgc

SEQ ID NO: 587177 - DNA, 376 bp, Homo sapiens
ttttgggggtttttttttaaaaaaaggggtttttaaaaaggcccccccttttagggggaaaaaagcccccccccccccccgggaagggccccttaaaaccttttttaaaaatttttttaaaaaggggaaaaaaaaaacccccccttttcccctttcccgggggggggggtttttggggggggcccccccccccccggggcccctttctgggggggttttttggggccccccccccccccggggggggggggttttcaacccagcctctttttgaacaaggggggccccggggggggtcggggttttttttgggccccccgggggccaagggggggcccccgggcccaaaaaaaaaaaaaaaattttccttccttta

SEQ ID NO: 587178 - DNA, 695 bp, Homo sapiens
gcgtcgtcgccctgcggggtggctgtgtgccgaggcgctggagctgctggatgcactgcgtgcgtgtgcagagagcgcctgcgacccgagagggagcccctgcctgcgtgccctcgtttgcgactcgtgccctgtatgtgccttgcttagtgtgccctgctagccccctgcctgcctgccaacatgctctgtgtggtgactgtgctgtgtgtgctgtgctgtgtgctgactgtgcacctgtggtgtgacttgtccctgtgtgcaatgcaacatgtgcttctccaaatgacatctgttggagaattatttcattgctgttgatagttgtgcagcaatggcttgccacctgacgcccagtgatgctgaaccatgtgctgcactagctgtgaggataatgccccagccaccagctacttgtgtggagttgctctggagcctctgtgtgagacctgtgtagagtgcgcaccagcgggtgaatgtacaccaatggaccatacttgtgcgctctactggtgccagccaagtctcgggatggtgaacgtacttgtctattgcaactgtacacaagcatgaaccccttgtgctgttttggtgagagctgtgatactctcaccttgccgagacttgccagctcaatgccccacgatggaccaacagtaccagttcttagaggatgcagtgaggaaccagcgcaa

SEQ ID NO: 587179 - DNA, 254 bp, Homo sapiens
ttggtttgggggcccccctttttttcctattttttttaaggaaaaaaaaaaaattttttgggttttttcccgcccaaatttttttaaaagaattccccaaaatttttttcccccttttgcccccgtaaaaagctaataggtttacaacccttaaaaggggggggggaaaagcccctggggtttttttttaaaaaggaatcccctctttaaagggctccccccctacaggggtgtggcttttactttcttctctc

SEQ ID NO: 587180 - DNA, 225 bp, Homo sapiens
ttgcaccattctggggtggtggctcttctgggttgaaaagtctggagatacaatgagagggcttcatccacatggcttcctctgacttcctgaccctgcatggaggccactggttcagctccagtgcaggtgaacggggccttacatgcttacgctccttcatgcccagtacacgataccttggcttccccaggggcccactaagcgtgcagtgtccccgcctcc

SEQ ID NO: 587181 - DNA, 415 bp, Homo sapiens
  misc_feature (36)..(36): n is a, c, g, or t
cccgcgacagagtgtgcttggaccagaaggagcagncggctttcttctggttctgtcgattggggagcagctcactgaacgtgcttgttgttctctccaccagcacgccctacaaagtcaggccagggggttgcaaatgtgggtactttccgtgagaactcataagggtagttgggatttcctgatctgatgaagtgggaaaagtactgcatgattttcagcgacaggctcttctcctccagagaaaactgcccctcgtaggctgggtagaagggaagccccaaggcaaactgaacatccgccagcagctccaggctgccatggccgtagttttcaggagcatggtacatgaagacgtttccttgggccctctttgcccaggcacttgccatgtcgattatagggcagatgataa

SEQ ID NO: 587182 - DNA, 1541 bp, Homo sapiens
tctacagaccttcttttttgggacgccgcgccatgttctccccctggggtgaccccgctatcgccagcgcgtggtggtttgcgactcgcgccctttgtgtgagtccccccccgggggtcgccggtgtcctcataccccttccccgggaattgttttactcccttaaggtgccccccgggggagcccgggaagtgacgacccagaatgtgtgttcgaagccaagccacggggggagaccacagctttgtattgcgacccccattttaaggtctcccttatactttttgttaagggtggacacgcaccgcattaatttgggagacccacagagttgtttgtggacacccagaaaaaaatatcccagagcgcgtgggggttgaagcaccggcttcctcccggggaaattttgccccgcgcggcgggaattatttcggtgctgaaccccccaacgaccgtgttcccgcccgggaaccgcccttgtggacgcgaaccgcacgctgggggccccacacataggggccagagccggggccacacaagatagagggggagaatcccggcggcagcggcagtggcccgcggcgctgtggggaaccccgcgggggggaccacccaccccccattcggggtgataaaagaaaagcccgggaagaaaaagcgccaccgcctttcgttgtgagttccgaaactctccgtgagacacaccacagcagagggacacacagcgcgggcaacagtcgaccgcgagggagaccccccttcgggagtctcacagggagaggctctctctgggtggacaccctcgggggcacgacaaagtgcgagatatgcgcgcccacgcgggagcactctctcgaaggggtagagatataggaggctccccgcgccctcggtggagagtttcacagccctctcgacacggcctctgcgcttcacagagactctcgcgagagaacacgctctctcgagcacacagctgggacacggagatgagagtgggagacacatcttttgtggagagccacaacatatagaagatatatatagagaagagaaaagggagaataagcgccacagaggaaataatattagagagagaagagaagagggagacacccactcgagaagagaacacacgcggccacaccacaaaatctcgcctccctctccacaggggcacagtttccacagacgcacaagagaccacagtgttcacagcctcgagagagagctctcacaggcccccctctgagagagagagaggtgggagaagtgtgtccacagaactctctcgagacacagcacaccacaggtccctctctttccacgtgttcaagaattgcacagagacttcttcctcacgaagatgtaagaggttccactgaatggctatggaggaagagcctcactgggaagaatgaggagaagacaccgggcccctctggaacacagaatgacacagagaaaagagagaagagccagaactgttcacatcgcatagagaagagggaggtgttgtaaaagaagatttgaaatccaga

SEQ ID NO: 587183 - DNA, 834 bp, Homo sapiens
  misc_feature (1)..(1): n is a, c, g, or t
  misc_feature (131)..(131): n is a, c, g, or t
  misc_feature (165)..(165): n is a, c, g, or t
  misc_feature (167)..(167): n is a, c, g, or t
  misc_feature (181)..(181): n is a, c, g, or t
  misc_feature (190)..(191): n is a, c, g, or t
  misc_feature (194)..(195): n is a, c, g, or t
  misc_feature (220)..(220): n is a, c, g, or t
  misc_feature (249)..(249): n is a, c, g, or t
  misc_feature (257)..(257): n is a, c, g, or t
  misc_feature (261)..(261): n is a, c, g, or t
  misc_feature (290)..(290): n is a, c, g, or t
  misc_feature (316)..(316): n is a, c, g, or t
  misc_feature (329)..(329): n is a, c, g, or t
  misc_feature (345)..(345): n is a, c, g, or t
  misc_feature (349)..(349): n is a, c, g, or t
  misc_feature (358)..(359): n is a, c, g, or t
  misc_feature (377)..(377): n is a, c, g, or t
  misc_feature (384)..(384): n is a, c, g, or t
  misc_feature (401)..(401): n is a, c, g, or t
  misc_feature (413)..(413): n is a, c, g, or t
  misc_feature (432)..(432): n is a, c, g, or t
  misc_feature (480)..(480): n is a, c, g, or t
  misc_feature (500)..(500): n is a, c, g, or t
  misc_feature (506)..(506): n is a, c, g, or t
  misc_feature (512)..(512): n is a, c, g, or t
  misc_feature (538)..(538): n is a, c, g, or t
ntcttagggccagctaacaaaggggtctccacattgtcaagtttaaccaagagcaaacgggttttaaaacacacctttacatttttataatggggggatgaagagaagaaaattgtgcgtcaaatgttttngaatactcatatccatatgtgggaatagaaattnanatatcatcgtaagnggttataannggnntttgtgcagagccacaatattttgntactattcaaacaataatatctatcttanggtttganaganagtataacattaggcatcaggtttttttnctttctagtttatgattgggaattanaccacaatataanaccaaaaatattttcnaagngaatttagnngttatgttgatttatgcnagaggtnatgttatcatatttttnatacattaattnatacagctacatttggggncctgtgggcatgggtgtgcataccaatattttttctctttattaacanataggggggaattatatgcnactgtnaatctnatttcctgcttcacaaccctcttttnatttctgacatatgtttatgtctgagacagaagagcaaagcacttgcgaacacccctgggttaagcctaacacttcgggagctcttgaggatttgagcgactggtgtggagagactgtcagtatgcagtgccctctgctggccaaattattaaacatcgcgataaacaaaattcccaagtgttaatattacaatgtgggggaataaaactaagattattttggaattagccctataattccggagagtcaccattcactaccataattccttagtgaacagagatttacttttatg

SEQ ID NO: 587184 - DNA, 936 bp, Homo sapiens
gataaagtagacacaatgattgtccaggcgattatccttgttagatgacttggataaagaactaatcaactacgttatgcgatgtaaagaatggtatgagctggcattatcccatgtagtttaggaatagaattatttgatgataattgtaagatacgtgcaaggtgttgtacacgaattgttggtgatagggaagaacgtagtgcactctggctaagcgttttctgagtaagttgtcagaagaagttgatgcaagaagtgagagtagttggggaggatagtccatgggaacggaggtttcaggaagaacgatatgtagcgaatattctggatctttgcaatcgcaatggtggtcgagaatctctgagtatcggagcccagtctatgaaatatctacataaaatcgaatggaatgagtcattggcgtccctaaatgtgaccagtcgactggtatggggaattagtctcggagcacggtttatagctcatgctggtgtctcttccaatatttggacaatgcttgcagctactaccgttcagattcttggggctgaaaaggcagttgtcgagagcccgcaatttctagacgggatgccctaggtatggtccaatttgttcaatgcttcactccgtggtcagaacatgtccctcagacaaagggaagcaatgctcgactgctggaggcatatgcgttgggcatcggaatggtgctgggaggatccggtccgcctggagttgtgaacgagccgttaggccggtggacctggcgccgggttccacactggcccgggccttctaccgcatttcccgtgtggggtttctctggggcgtccctttacacactgttcgggtttttacccccctcttggagggcgggtcaaaacgcgctctcgcggcttcttctcctctctctgccctttcttctcctgggggggg

SEQ ID NO: 587185 - DNA, 351 bp, Homo sapiens
caggatcccccgattactgcgctgggatatccttctccctatggggcatcacagaccctcttccataagatcctgctcccaggcaaaacagccaagatcacagtcacatagcatttcgttccctgagaactgggggtccttgatggtagaataaaattgttttccttgatgtaggtatcagagggctagtgggggaattttttaaaaacccaaaacattttgcatgtgcacgccattgaggaagggacttcccagccattgaaatattataacatcccatggataagtgcttgcttaggccttgggtgttaagagttctgatggtctcaatcacttctttgtgttggagcc

SEQ ID NO: 587186 - DNA, 395 bp, Homo sapiens
cgatcaccgtgtcgtcgctgaatgcgcatttttcgacaacttccgccagacgttctgttcctgactgatgatcggcgcgcgtcatacatacttcaccgccagcggttcaacggcgcgggcaacatcctcatgatcggttgccacgatgatgcgctcggcacctgattcacgcgcgcgttcaagaacatgaacaatcatgggtttgccgttaatatcaaccaatggtttaccgggcagacgcgtggacggtaggcggcgggaataatgaccacaaaactcatgatttactctcatcagcagtcagcacgcgggcttccgtttccagcaacactggaatgccatcacgcagcgggaaagcgaggttgtccagtttgcaaataagctcttgtttttcc

SEQ ID NO: 587187 - DNA, 377 bp, Homo sapiens
tgaggtagagttttgctcttgtcatccaggctggagtgcactggtacgatctcggctcaccgcagtctccaccacccgggttcaagcaattctcctgcctcagcctcccaagtagctgggattacaggcacgagccaccctgtccggctaatttttgtattttttgtagagacagggtttcgccaagttggccaggctggtctcaaactcctggcctcaggtgatccgcccaccttggccttccaaagtgctgggattatgggcgtgagccactgcacccagccttttcattcagtatactttaatgggagcctccctgagtgctgccctaggcgtaggagtgcccagggctctgtcagccccttcagcaccgtgct

SEQ ID NO: 587188 - DNA, 603 bp, Homo sapiens
  misc_feature (164)..(164): n is a, c, g, or t
  misc_feature (175)..(175): n is a, c, g, or t
  misc_feature (184)..(184): n is a, c, g, or t
  misc_feature (194)..(194): n is a, c, g, or t
  misc_feature (198)..(198): n is a, c, g, or t
  misc_feature (210)..(210): n is a, c, g, or t
  misc_feature (382)..(382): n is a, c, g, or t
  misc_feature (423)..(423): n is a, c, g, or t
  misc_feature (430)..(430): n is a, c, g, or t
  misc_feature (456)..(456): n is a, c, g, or t
  misc_feature (459)..(460): n is a, c, g, or t
  misc_feature (476)..(476): n is a, c, g, or t
  misc_feature (508)..(508): n is a, c, g, or t
  misc_feature (531)..(531): n is a, c, g, or t
  misc_feature (546)..(546): n is a, c, g, or t
  misc_feature (568)..(568): n is a, c, g, or t
atctttgccagacaggagctcgtgcggtggccccaggccacagcccacagccatgggttgggacctgacggtgaagatgctggcgggcaacaaatcccaggtgtccctgagcagctccatgtcggtgtcaaagctgaaggcgcagatcacccaaaaatcggcgngcacgccttcnaacagcgtntggctgtccncccnaacggtgtggcnctgcaggacagggtccccctttccaaccagggcctgggccccggcagcacggtcctgctggtggtggacaaattcgacgaacctttgaacatcctggttaggaataacaagggccccaacagccccttcgaggtgcggcttacccagaccgtggccccccttaaacaacaantgaacgggctggagggtgtgcaggaccacctgttttggctnacctttnaggggaagcccctggaggaccagctnccnntgggggagtacggccncaagccccttagccccgtgttcattaatttgngccttcggggaggcggcccaaancctggcggggggagntaagggcctcccccagcatccnagcaggatcaagggccggaaataaaggctgttgta

SEQ ID NO: 587189 - DNA, 107 bp, Homo sapiens
gaacaggtcgctgcttcagtgagctgccttttccaactgcaatcaattcattgttatctcgtcaactccacctcgagaggcatcagcatcccacgctccttgaccaa

SEQ ID NO: 587190 - DNA, 344 bp, Homo sapiens
gggcagtggtgagatcatagctcactgcagcctctaactcctgggctcgggcgatcctcccacctcggtctcccgagtggctggaaccacagtggccacagatgtctttaattccaaaaacctggccgttcagggcaacaaacaagaagatctttgggcgtaacaaatggtgtggttccaaaaattcccaattcgggcccaacccaaacccgtgtaaaggtaaaggaaccggaacaaaccaaaagggttaagggtgggaagggggtttggggcctttggggggcactttggaaagcggccttttccttttaacccaacggcacgggtttgtggaaacccccaag

SEQ ID NO: 587191 - DNA, 434 bp, Homo sapiens
  misc_feature (22)..(22): n is a, c, g, or t
  misc_feature (149)..(149): n is a, c, g, or t
  misc_feature (167)..(167): n is a, c, g, or t
  misc_feature (287)..(287): n is a, c, g, or t
  misc_feature (389)..(389): n is a, c, g, or t
  misc_feature (393)..(393): n is a, c, g, or t
ggccccgcggtccctaaaaatngggccctatggaagaggaccctccctttacccccctggaaattccctagcccagcaacctggtcccggcaggggccccactgaaagcagaagggttttcctccggggggaaccctggcccagtggtngcctgcattggtggtagncctcccaaaggttgcccctatttttaaaatcaattatttttgtgacagtaattttgggtcctggaagagttcagatgcccatcttctgcagttcccaggaagagagattgttctgaagtnccctctgaaaaatattttgccctctgacttgatttctataaatgcttttaaaaacaagtgaagcccctctttatttcattttgtgttattgtgattgaaaanaagntaaaatgctgatagaaggagttgaaatctgatgacaaaaaa

SEQ ID NO: 587192 - DNA, 450 bp, Homo sapiens
ctaggttggggaggggcggtgtccagtgaggtcatctgtggtcggtgttggtggcctcaacccgcgcaggctcagtcccccacccacccccagtccccgtcctccccatgtccttgagacctcccctccagcggcctgggtcacccggcccatccacaagaccacctcccagacgggagtccctgggcactgggaagttctgggctctctctggtttggggagaattgtgggcctcctccacctccagctgcaggacccccaagcggcgcccggggcccacccacagctgcgggagagacacggttttaatgcgcgctcaggctggtctcgggcggcctcagtactcccaaagcgcggtcccggccggggcgtcggcatcggcccgcagcaggcccgagcgccgccgcgcaggtactgtgcgctccgggcgcggatgccaggcggccgca

SEQ ID NO: 587193 - DNA, 161 bp, Homo sapiens
ttgatgacgagctaatatcatgcgagtggatgttggagaagagatcgatggttctcaaggagtgagctgttctacatgaagaagaagcacgaagaggaagtaatagatggcctacaagcccagattgccagctctgggttgaccgtggattggacgagcat

SEQ ID NO: 587194 - DNA, 344 bp, Homo sapiens
ctcggtacccaggagagatgccccagacaaaaaaccaaaactcaatatccacaaaaataagttttaaaattagccaggcaaggtggcaagcaccggcagtgtggctcacgcctgtaatcccaggactttgggaggccgaggtgggcggatcacctgaggtcaggggtttgaaaccagcctggcaaacgtggcgaaaccccgtctctactaaaaatacaaaattagccaggaatggtggtgcgcacctgtaatcgcagctacttgggaggctgaggcaggagaatcacttgaacctgggaggcagaggatgtgctgacctgagatcgtgccattgcactccagcc

SEQ ID NO: 587195 - DNA, 788 bp, Homo sapiens
gtggacctcagttatccatctgtaaagttcttatatatttgtcctaaaataatctatgaagaatagattttggttggacagttagaaatgccttgttcagttggtgtattgaaagctctcctttaacattttcacctgctcattgtgatgtcctccttgttatgtctaatagtctttccaggtcatacttgtgtttaactcattaaactattttgcttacctggatttgtggagcactaagtctgataaagctttctttcgaaaagcttaagtcatgtgtacattgcttattttttgatacatttgactttcctaggaggtttaagaacagtgacaggtatagcttcgacaccttcaaatgatcttgaatgagggaaacaatcagtttgattccaaggatatttcttggccttacatggtctcaaactttgacatgtctgtacacctttcattattaggttctcgacattactttatgtaccagatattgatagtctatacacgatcttaatattctcgtgatcttatagcaatgtataaagtgttcaaataatagtcagggaacttagtatacctacttaagctcaggacttgttaccctctgaatagagtgcctttgagtgactcatgctaattagaaatttcacatcagttaaattgctaacctaactggcccagaaggaatgttaataatgggaggccttgatcgattgacgccattacatgttcacacatggaccactcattcaggtccaccacatgacgatgtacacttttccttgatgaat

SEQ ID NO: 587196 - DNA, 929 bp, Homo sapiens
gtgggtgagatccatgtgaagacattagaagaaattcttcttggaaaggagccagtcagaaacgtggagaattgctacactaaactcaagacagacggaccttgcaaaatactgatgatatctagcttcaggagcaggaatgctcctccactatccgtatcaaaaccttctctgaggtcctggctgaaaacaaacatcggcagtaggaagcagagagacaataaaatagcgaaatcaggatacaatgttgctagtcagacgtctaaagtattgtagtatctgagaattaaggaaaacagtattaatttgcctagcacagttgtagcgagcgagagtgacaatgagaggagccgtgctggttaaaacaaagtctatgccggaggtgcatggttatgacgctggttagaacttaaaactggtagaaggcagctgagggtgaagaaagagctctgacgagcaacaacaggtccccgatctcaaagatgaggtcactccagagggtgaagagcggctgatgcgggatcagccataagaacaggggatgcaaccgaagagaagaacctgcagagaaggacaatgcacagcccgattctccaaacacaggtcattaggaaacagaagcctataaagaagggttccaaagtggcagaccacccagggagattgacgtccactaaaaccttcccatgtccaagaagatggtcgcagagccgtgcaaagaagcagagcaacatgcgaggacaaccctgcagggagacggggactgtccagtcttctggacatgcacatgcggggcagaatgaagctctagccaagaacccaaggtggcagagaaaccagcgctcacatgacgaggccgagaaccacacaggacggccaggggtcccaacaaggcatccaaaggggcgctcgccccacggatggacccc

SEQ ID NO: 587197 - DNA, 371 bp, Homo sapiens
taagccaagacctaacaaacccgcaaggcttaaactaccaaacctagataaaaaatttcagtgaggacaactcggaacaaaaccaaactcggagcagtacatgctaagatgcaccagtcaaagcgaactaatatactcaatgaatccaataagttgaacaagggaagaagtgacgtaggaataacagaggcatccctattctagagtccatatcaacaagagggtttacggacctcgatgttagatcagagcatcgccgatggtgcagccggtattaaaggttccgtttagttcaacaattaaagtcctacattgatctgagtacagaccaggagtcctccaggtcgggttctatctaagttaaattcctc

SEQ ID NO: 587198 - DNA, 292 bp, Homo sapiens
  misc_feature (38)..(38): n is a, c, g, or t
ggaatacgagcaatgggcggaggggtgctctcctgagnctacagaaggaatgatctggtggttaagataaatagcacaagtcaaacttattcgagttgtccacagtctgcgatgttgatcttcttgctaggtcttgccattcctggacccagagtgctccaaggcatccagaatattcattccttcttatcactgtgccaaacaccacatgcttgccatcctacctactcagtcttggcactgcagatcaaaaactgtgaaccattggtgtcgggtccatcatttgccatag

SEQ ID NO: 587199 - DNA, 194 bp, Homo sapiens
atcccactcaaatatctcatcaacaaccgactaatcaccaccaacaatgactaatcaaactaacctcaaaacaaatgatagccatacacaacactaaagggacggaacctcgatctcttatactagtatcctcaatcatttttattgccacaactaacctcctcgggacttcctggcctcactcatttacacca

SEQ ID NO: 587200 - DNA, 137 bp, Homo sapiens
aagtatcgaaggatgaatcttcatggatctatgtataggggaggtaaaccacatggaaggaggtgtcggggcgccgtgggtcctcaagcttagggttcatgttgggctcatcccggtccctgaccattcaacgctgt

SEQ ID NO: 587201 - DNA, 134 bp, Homo sapiens
ccggtggagacgggtctcatgggggcgggtctggctcggtgcagggggacgtgctaatggaagcagccgacacgggggagagtgaccccaggaagggggtctctgagaatatcatggctggggccagcgggctc

SEQ ID NO: 587202 - DNA, 369 bp, Homo sapiens
ctctggatgcaaagtgctctggctgcaaagtgtccatcaatgaatgaatggataataaaatgtggtatgtacatcacatggaataatattctgcctgaaaaagaaagaaaactctgggctgggtgtggtagctcacccctgtaatcccaacactttgggaggccaaggtgggcagattgctttgagctcaggagttcgagaccagcctaggcaacatggtgaaaccttgtctctagaaaaatacaaaaatttgccaggcatctgtagtcccagctacttgggatgctgaagctggagaatcacctgggcccgagaaagcagaggttgcagtgagccaaaatcatgcccgccgacactttgcatccagag

SEQ ID NO: 587203 - DNA, 179 bp, Homo sapiens
ttagggctagagtatggggggaaatagggaaatggggagtgactgctaatgggtatagtggattcttttagggggtgatgaaaatgtcctgaagttgactgcagtgatggctgcccaactctgtgaattaacttaaaaccactgtattacagccgggtgcgctggctcacgcctgttac

SEQ ID NO: 587204 - DNA, 288 bp, Homo sapiens
ggacggatcatcaccaaaggtagcgttggtatcgtagctaaatgggaggaggtttcatcgttgataaatgtcgtgactaaagaaaccctggcgaagatagaggagacacctgctaggtgtaaggagaagatggttaagtctacggaagagctcccgggatgaggagtagttccctgactcaagggaaggagtaacactgatacaacctgatacctgactccggacctccgactaatagcagcatgcgcagccaggacagataaggcagcagcagggcaggataagagt

SEQ ID NO: 587205 - DNA, 367 bp, Homo sapiens
gtgtactcttgactacgagtgattaatccgttgtaatggagggacctataacagtgacagagggaggacaggacagcgaatgatgctgaattgaacttggatcgtactgactgtgcagcccttcaacaggtgtgtctttcagcaacatagatgaccagatgctgctattttccattaccgataagagacgacatgtgtgtcctttgcttccaggctgacattgagattcgaaatactggcttgaacacgcattgtgcattagtcaggtcacgcagtgaaggctatttttacaatgctgattattacttcctggcagggaatgacttcatggtgcctactgtatacgcacacctagccattgcttttg

SEQ ID NO: 587206 - DNA, 884 bp, Homo sapiens
  misc_feature (26)..(26): n is a, c, g, or t
  misc_feature (34)..(34): n is a, c, g, or t
  misc_feature (40)..(40): n is a, c, g, or t
  misc_feature (46)..(46): n is a, c, g, or t
  misc_feature (59)..(59): n is a, c, g, or t
  misc_feature (97)..(97): n is a, c, g, or t
  misc_feature (99)..(99): n is a, c, g, or t
  misc_feature (108)..(108): n is a, c, g, or t
  misc_feature (122)..(122): n is a, c, g, or t
  misc_feature (129)..(129): n is a, c, g, or t
  misc_feature (137)..(137): n is a, c, g, or t
  misc_feature (149)..(149): n is a, c, g, or t
  misc_feature (166)..(166): n is a, c, g, or t
tccccaggaggcgggacggcggcggngggggganaggaanaaaaanaagcgtctccagntgaagccattgcagccctccggtctctccgcaaaaaantncctggcccngatgagcccccgcnggtgcgntccccgantatccccgaggngggctgggggcacgggncccagcgccgacgatcgcgtgccgtttggccctgggagttaggttgtggtgacgggatggggcttctcccttagccggggctcacaagggccagagaagattccgtgaagtgtctgcgctgccgtgctctacgccctcaatcgtgctcttgggtaaatgtccatcagtgtgtgggcgagttccggctgggatgagggattacctaaatatggtcctcattttattgcagaaccgagggtaggcggaccgcagtcttttggatttacttccctgtggtccatccggtcatgatggcggttggctgtccttatcatgggggggatgtcggatctctgtgtcccaggtgacacgactctgtgcttcctggctggcacttggccaagtttgcttgcccttcctgtggacacactgccttggccgtggaccttgacccggaacctttggttccagccacgggcgactttggccgttgagcccgggtgccaccttttgggtcccaagtttggcgggtacctggctgggatttcccgcaaacgtcctggcgcgggagcttctccccggcggtcgcatgccccaatgtggcccccactgttcgtagttcttccttttgcctcatgcgtcgtcttcgcctccaggggcggccacttcctcctcccggctcgtcgtcctggtagtctttacctcgcgttgagcgcagccgcttgtctgcgtcttctcc

SEQ ID NO: 587207 - DNA, 112 bp, Homo sapiens
aaccatctatggaacccttaaagtttctaggagaattcagacatgttgtgaaaaatgtcccactctcaatgggctgaatgtattaccatatctcatactaaaattactcttc

SEQ ID NO: 587208 - DNA, 133 bp, Homo sapiens
acggatgctatcagatgtgattctgtggcggggaggtaatgtgtgtgattgtgtgtctgtgtgtgtgtctgtgtatgttgtgtgtgtgtgtatgtctgtgtatgtaacggtgtgtctctgtggcggggggtgt

SEQ ID NO: 587209 - DNA, 851 bp, Homo sapiens
  misc_feature (160)..(160): n is a, c, g, or t
  misc_feature (224)..(224): n is a, c, g, or t
cgaactagtgttagtagcaatgaatggtaacgacgtaagctaccacaagggggtgtgtgcataacataatgaagtaagtgttaaaatgagtagtccaccgcacaattcgttgatacacagcacagcgctggttttcatattgtgaaaatgcttacattcnggaagagaacacacttgtggtgtggagtcggtcactcattctgccctggtctctcctaaaaatngatgtgtgttgcttggcgtcgcacaggagcccggctcacccgtcctgactcttgctagaaaaaccgggtcggatgtcgagagcacaccacggggggtccgcacggaacgcgccgacacacacaaaaggggagaacaccttgttagtagatcaagatagcgcggggtagacaatcattctgcgatggccatttggcaggtagaacgccaccgcagaaaaagacagaacgtcgaatggcttgttattggttttcgaatagaagccactcatgttaatcatatatattggtgcgaggtatctctcagcaatatacttactgtcaggtacattagaagacggcacttttgtgtgtggttccacacacacatacgtccagggacacattctttttgtgtactactgcggaaatacgagagtagtagcaccgacccacaaagaggggggttatagagatgtgggtgtcgccgcccaccaccacgcggtggtttctactctgacaccgcgtgggacacttgcgtgccggccccttgttctacaaaagcgggggttcctgttagtacaacccctggggtagctcgatggttgtagaagaacttatgtgttgcccgacccccggcaaacaatgtcg

SEQ ID NO: 587210 - DNA, 419 bp, Homo sapiens
ttaattaaggaagaagaagaaaagcccccaataagcaaacctcttctcccgggggggtgggttttttaataaagcagggggcacaggttttttccctggtaaaaagggggcagggggccccaaacaaataatggggggttgctcccttagggggcccccccggttttactttttattcctgcgggtagtatgttggggggagttggggggggaaaactttttcccgcaggaaacaattttccccattattccccccaggtaaaaattcccccccaaaaaagggaaaaaaaggtggtgctcccccgggggggcggcctttttaaaaatagtggcccccccgggcagcaagaattcggcaggggggtaaactttggtgggcagttttaaaagccttcctccccacaattttggggaaagta

SEQ ID NO: 587211 - DNA, 207 bp, Homo sapiens
  misc_feature (123)..(123): n is a, c, g, or t
gtacgagataagagtttgtccttcttgaggtggctggtgagtattttcccaggcccctgcctgcgaggggatctgaaacagacctcccttccaggttggcagctgcaaacctgcacaagatanttggtgacactggtgtcagtccaaagcccactgccctgtcattcttccacagcttcagtgtgacaagagtagaaggagtgtctc

SEQ ID NO: 587212 - DNA, 468 bp, Homo sapiens
  misc_feature (38)..(38): n is a, c, g, or t
atatgtattacatatagagcattgtcttctatatgtanagagttcttataaaacaataagaaaaatatttcctaactagaggaaatggacacataattcataaaagaagaaacaaaggagcaattaagatataaatatatttggctttgttgattaaagagtaacaattaaaatgacaggtgacttctgggccggatgcagtggctcaagcctgtaatcctagcactttgggaggtagaggcaggcatatcacaaggtgaagagatcaagaccatcctggccaacatggtgaaaccctatctctactaaaaatacagaaattagctgggtgtggtgacgtgcacctgtagtcccagctactggggaggctgaggcaggagaatcacttgaacccaggaggcggaggttgcagtgagccaagagtgcgccactctactccagcctggtgacagagtgagactccatctc

SEQ ID NO: 587213 - DNA, 205 bp, Homo sapiens
tagaacacccacagcacactgagcacatagttgacgattgttccgagtgcaaaactgatcgtcccggccgtcagcacctcgacgtgaaggacgtgcgtcaacagcagaagcgcgccggtatcgacaaccgcggcgaccgctcccaccacgagataccggagcatctgcaggagcccgttctgtgtgcggtagaccaccagtcggc

SEQ ID NO: 587214 - DNA, 279 bp, Homo sapiens
  misc_feature (27)..(27): n is a, c, g, or t
  misc_feature (47)..(47): n is a, c, g, or t
  misc_feature (56)..(56): n is a, c, g, or t
  misc_feature (183)..(183): n is a, c, g, or t
  misc_feature (217)..(217): n is a, c, g, or t
gatcgccccggaccctcactcctggcngtcgtgagtctctggcgtcnagtgctgantgggcggctggtcctgggtctggtctccatggctggccgcgtttgtttgtgccagggcagcgcgggatccggggccatcggtccggtggaggccgccattcgcacgaagttggaggaggccctgagncccgaggtgctagagcttcgcaacgagagcggtngccacgctgtcccgctggcagtgagactcacttccgcgtggctgtggtgagctctcgtttcg

SEQ ID NO: 587215 - DNA, 319 bp, Homo sapiens
caggtggatcacctgaggtcaggagtttgagagatcctcccacaggactggcattacaagcctgagccaccacacccagcctagatgttttaattcccttctgaatgtttaaaatgtgagcactcctagtgttaaaaaaaaaagtttacatttatgaacataccctatcttttacaaggactatacctggtgtgttttttgggtttctgttagaaagttgtctcattctgttttgtttgcaaagtgtctgaatatgaagactagattcctgaacctaggggtgattaggcaaaggtaccagccaagaactgatgatgga

SEQ ID NO: 587216 - DNA, 799 bp, Homo sapiens
cccgtacacgccgtggtctatgtcccattcgagcccctgccgccctgcgcaactctgcccagatcagggcccgactggaaggaggaggtggtgaccctggagaacctgcacagagggctccactccaagcctcctgcctattacgggcagctcccccaggttccacggaccgcaggaccctcacccctgtaccacgggcccagtaccactccgtgcgttcaccctgggccgcccacccacttgggctctctattgggaaaggacccacgccacggaggccacgcccctcgggtggaccacatgggtgaaatgaccgcgccctgtgaaggaccctcccgcgctgccacaaatacgcttctcccctcagtttaccacccacacctattgtaggccgcggcccaggatgacactaatgttgaaggccacctgtcccgcggcacactgaagccctctttgagacccctcgctgtcccacgaacccacgggaggcccagaccttcacttgtgggagacccacgattctcctttgcctgaactaccacaccctggctggaacttgctgctgatccacatgaggtcctagcccctggctgcctggatgcgttccccctgctttcagcataatgtggggcccctcagcgccccggccccgctcaaggccttcctggcctcccctgagtaacgtgaacctccccactccatggccacgggaacccgatgagggttggggggactctgagccgggagcccgagtttgccttcccttctccccggacccataaaatttctaagagagcta

SEQ ID NO: 587217 - DNA, 274 bp, Homo sapiens
taagaaaacaaaagggcagctccacagaagacatccccgcctcgagaacaccaacagcttcaaccttgaccctgtaaggacgccaggattcccagcacctccttgttggcaccctccttcacgatggtgcttggaagccaaggttggtgtccttcgtgcttgagtttcccatccatggcgagaacccgcttctccccggtttgtcactgagcagtggggtatggtgtacaccttacagaatgtgaagctgggaaacctgcaaacttgtcgaatt

SEQ ID NO: 587218 - DNA, 237 bp, Homo sapiens
cacagtgctgggggggcgggatccgagatgctgtgatgtcacagtaactgtcagttcagagcgaagcttcccgtcctttgccgtgtgactttcccacactcctgtaaccatccctccctcccttcttcctctctctctctctcactcacgcatacgcaaatacacagacacactccattcagtgtctccatgactctggagtaaactaacgtctcgagttgccatggggccagcggg

SEQ ID NO: 587219 - DNA, 707 bp, Homo sapiens
agcggaagtggcgctgcactcaatgcggaaagcgcggtgagcgctggagcttcatccgggcacttcataagggatccgcagctgctcccgctcgtccaaaagagacagtgagaagcgagtatctttccggcattcaagcctacaggaatcctcctacctgggcaattacctgggagccattgagaagctgggtgaggttacaggatgaatatgactctgtattatacagcattgttgagctccatctcctattacgtttcccctctaagacaccagctgtccttcggatagagctatccgtagtgacatgactgctgttcttcttgcctgtggcataaagccggaaaataacatgcatccttttccaacaatctcaggtgtctgaactagtacgacaaggtagagttggatccttgtcctgctatggtcgagactatcctcgagttacaacattatacatcagtggaaggcaggagactaccaagaagaagcacgatggcacggtggggctgctcacatacccagtactccagggcagccgaccattctgattgtacaaggtccatgacacgttgccgtgtggggaggatcaaagtcctagcacatggaagctagttacaggatgctagcacaaggttacaagacagaacgtactggggagttcctttccagtgcccgagtccagtctcagtatgtagtgtgtaggt

SEQ ID NO: 587220 - DNA, 1135 bp, Homo sapiens
  misc_feature (872)..(872): n is a, c, g, or t
  misc_feature (955)..(955): n is a, c, g, or t
cggtcattgactgcggttcatgcgcgtctagcagtggtgactgcgggcagacgggtgtctcggaagagagtcggtgcttataaaccttcgccgtgtagttgtgaaccgaagcactgggcacgaaggccaaggtaggagtagcattcctaaagtatcaccgcgtggggagaggcgctcgcctcgagagtagcaggttgaacagggaggagccgggcgggcccaacgagctcacctcctattcggcgagggataaggaatcccgtcagtctctgtaccggcctcggagaaccgagagcgtcgtgtggacagaaatgcgctcgttaaatcagtaacatcgaccgagtcctggcgtcactccggaagccgtgcctctctatgaggtgttggataccgtgtagagtcaagtggggaatctcatctacataacagcagatgctgacgtctcccaagagaagcagacgtcgcgatggacgctacaggtaggctatgccaaaagcgtggctggcgggtctgatccgagatactgccaatcctgttgtgacaatccatcgtctaatgagacgtcacctgagtcatgtccctcgagactagaattacgttagacgtattggtgttccgacacgataatatactctggcaatataatcattacaattattgggctcatgtgagctcaggaatagaatgatgtactccagatgataggaacataatcaggtctacccgtgccggtcagagcaagagccccaggtacataataggagaaacccggtgcgcggctcgatgaaagaggaggtacgctcccgagaaggtatccccatcgtagggcggcaaaccctttattgccgtgcccagggtggttgccacaaggnggtcccataagagagtacggataagaacgtcaggaacggcgcggttgattgcacaccctggactgcgagaacctgtgggccgngccctggcgagggaccgtactactggggggggcacccaggcaaaaccgtcaggaaaaacagctcagggcgtaaaagttccactcttttgttgttccctcggacattcgccggcaaatcgacattaacaacaatacgccgaatcacatccccacacactctcattcataccactacccgca

SEQ ID NO: 587221 - DNA, 238 bp, Homo sapiens
atgcagaacgacgtagtcacctacctagatatgactgatgtatatattcttactactagaagccatgtacaagagtgggaagtgcttacataaaatggaggggcggcaggcggttgcgtgatattattttatttttttattttcctgaagggtggcaggtctctcagcaaagagaaaaagtgctttttgcacacggcttgcggggagtgatataagccagctgcaggctgccattgag

SEQ ID NO: 587222 - DNA, 342 bp, Homo sapiens
agtgtacatgttgtgtatgctcacaggttagataattcattcccccagatatgttttccaattcctgcattcggtcactgtttacattttccattcttttaaatctcaggaaacctgctagagctcagattttaaactacccgtcaagtctaaaaatccagctgtctactactgttttggcaaatgtaaaaactagacagatcaactttctactgctgctacccagtaccaagagattattttcagtcactatttacggctgggctatttgcacattcactgaatctcaaattaaaacagcacacaccatgtacaactcatagatcttaccttgctggaaat

SEQ ID NO: 587223 - DNA, 363 bp, Homo sapiens
  misc_feature (210)..(210): n is a, c, g, or t
tgggtgactctaaggatccttatcgccacacttatcgtctgattcaactcataggtctacatattcttgtacactgagagagtgagggtctgttgtcattgacagctgcagctggactgactggagctctgattatttacccaccacaggtaggttgtgttctgaatctcaggttcacaggttaaggctacacgatcctcatcctccacngggttggagttgttgctggtgatgacgggtttgcgtggctctgcatagactgtgatcgtcgtgactgtggtcctatatgaggcagtgtctgagttatgggcttggcacgtataggatccactattattcacagtggtgttggggataacatca

SEQ ID NO: 587224 - DNA, 850 bp, Homo sapiens
  misc_feature (275)..(275): n is a, c, g, or t
  misc_feature (280)..(280): n is a, c, g, or t
gcaggcgtgagccatcacgcccagccgagggtatcttccataccaacaagattagatgactgaggtgtaatggacaaatgcctatgcacaaagtgagggtatctgaatatgtgcgagcgggagtcgaaaaattccgagctagcttatagcacttaaaagtcaaagcctagacagctagcttcgaacacacagaccttctgcaatgatgctagctcatggcgccgtgctagtacggtgcgtcttgcgtcatcgtgttcgtgtaaccaaaccgaaangtgcncccgtggcccagagccgcaggtcgcggaagacgtgcatcggctaggctcgagctgtacaccatacgcaccgtcgccgcggttacacagtccgactctcctggtggtcaaggcctacctaaagttagactcgggactacagggcgacctcggcacgcacgcccatctaagtttggacattagtaacggagccgacggtcatcaccttgtccgcgccaaggctgggtcttggtccggccaaatgggtcgtactaagaactggctgtcaaaaagaggatagggctcaccatttgtctcggaatcaggggcatgagcctaaccggtacatccacctggtgtggagagagaagactcgcattccgacagctgttgggaactcgcatgacctgggccataacgttctgctggttctaccgtaatgagcctctgtcgaacgaattccacgtctcaagtgagcatgccgggagagagctgagcctcaggatgcccgtagaaccaggggggacgacactatggggcaccaattgggtcttccttgtaaaacttgggggccatgttcccttgaatgactg

SEQ ID NO: 587225 - DNA, 223 bp, Homo sapiens
taggctcaacggggtaggcgtgactagaagacaaggagacgggcatggccgggttgatggattcggttaaccagcgcacgcagctggtggggcaaaaccgcttggagctgttgctgtttcgcctggaaggcccgcagctatacggtatcaacgtattcaaggttgaaagaaggtgctgcagtgcccgaatctcaccatcatgcccaagtccagccaggtggtg

SEQ ID NO: 587226 - DNA, 470 bp, Homo sapiens
tcggtacctctactaggtatcctacaattactccaccaaaaacaaacaacacgctgatatttttctcgtgtgtgtctttttttttggaggcaggtctcactcggtcacccagggaggagtgcaggggcatgatcacagttgatggtagcctcaacctcccgagctcaagcaatcctcccacctcattttttttttaatttttggtaacgatgaggtgtcactatgtggccggggcgggtctgaactccggggctcaggtgatcctccgtgctctgcctcccaaagtgctgggattataggcatgagccacccacccgttcttctggggtgtcttatgtgcaatgttgtcaggccccaacggggaatctggacatctttcttcttccttccctacatcacccaatatgctctccctaaatcggcggtctcccctccatctcggcggctacggactgggccaaggtttacat

SEQ ID NO: 587227 - DNA, 893 bp, Homo sapiens
  misc_feature (22)..(22): n is a, c, g, or t
  misc_feature (123)..(123): n is a, c, g, or t
  misc_feature (236)..(236): n is a, c, g, or t
  misc_feature (300)..(300): n is a, c, g, or t
  misc_feature (515)..(515): n is a, c, g, or t
  misc_feature (654)..(654): n is a, c, g, or t
  misc_feature (674)..(674): n is a, c, g, or t
  misc_feature (719)..(719): n is a, c, g, or t
  misc_feature (734)..(734): n is a, c, g, or t
  misc_feature (750)..(750): n is a, c, g, or t
  misc_feature (786)..(786): n is a, c, g, or t
  misc_feature (801)..(801): n is a, c, g, or t
  misc_feature (809)..(809): n is a, c, g, or t
  misc_feature (865)..(865): n is a, c, g, or t
ggggggggggggggggggtgtnttggtggggccaggcgctgggtggcaggacaccgtgttggggggtgcccagtgggaggtggtgtggtctacacccagagaactaaaggggtgaccgcagtnacttgctccctaaagccctctgctctgcacctcccgccacagctgggtgggcagtcagtgtggcctctgtccaggtggtgggggcatccggggaccaggtgggggcgcacgcnggagcggtgcgtttcaggctgcaggtgccgtctgcccgtctcacttccggcctctccactgtgntggacaccctctctgagcagctttgctggaaagagcggagagcctgctgcaaaccaggcaccttgtaggcaggcaaggaggcagagtcctcaccagcccttccagagccaggccagttagagagggcggccctgcagagtcctatgttcaaacgcagaaggcgcagaagcagagcagggggagggccggccagggcctctgccaggttagaagtnaccatcgcgctcccccaggggctgtgccgcctgctgcctggcagcctccaggaaggccagctccttggcttccttcttctggtttcgcgcctcatactccaacctgttggtgatgatccgctggacgatgaggtctgtngtgaggttgctgccactgtnaatctgacggaagatgccccttctcttgggctcctggtatgggtnggagccatccctgtnagggataatttctgtnttgccgtgacacaccaggtccaccttgaagtgactnaggagctctgctgtnaccgcgtncggggctccaatcaccacttctgaaacgtaccggcaggacagcccgctcagagtcngtccatgcagattcatgaaggggtagtc

SEQ ID NO: 587228 - DNA, 100 bp, Homo sapiens
tttatttaaaattgtcagcggatctgctgtattatttaattgtattagtcttataagagaatacttgtaagatgaaaaagtggcatatgtgctctaaatg

SEQ ID NO: 587229 - DNA, 602 bp, Homo sapiens
gcatcatctgaggagtcgggagagcacatcatcgcgggcgccgtgcgagctgcacctgtgagatctgcctgaaggacctggaggaggaccatgcctgcatccccatcaagaaatctgacccggtctgtctcgtacctgcgagacgtgtcatcgtgaagagtcgaacgtgctctgcctctccaatgtcccccaagaagcatcaagcggctgttacagtgaacggcgcaggaccctttcccctgattggcctgggccgaggacatccgattacatacgtgcagacaggtggtaacaagaaccagatccagtgacgctccaaacgccaagctgggagacaagctgcctaacccccttagggcacaaaggaacgaacagcggtcaccgacagctcgagagaccccgatggagccttgaaggggcaccctggcaaactggacttcctcgggttggctatactggcgggccacccatagaaaccggtgctaccaccggggaacccccaaaaacgagtacccatacaaaccccgcacagaatttcaacacccaaaacggagctggctttggcccgcgttaacgctttcacaccaccgaagcaattcaaa

SEQ ID NO: 587230 - DNA, 153 bp, Homo sapiens
ggcatgtgctgtaggcagcgtatgatgttgcccagcaggaccagggtcacttgctgcatgtcaggcagaagatgtgagtagagcagctccactgccctgcagctgtgtgctccttcccgcgtctccttcagacagctccgttaatcagtgttg

SEQ ID NO: 587231 - DNA, 328 bp, Homo sapiens
gagatggggtcttgccctgtcacccaggctgaagtgcagtggcatgatcatcgctcactgcagccttgatctcctgggctcaggcagtcctcccacctcagccccccaagtaggtgggaccacaggcacacaccaccattcctggctaatttttttttttaacttttagtagagacaggctcttgctatgttgcccaagctggtcttgtactccttagctcaagtgatccacttcagcctcccaaagtgctgggattacaggcatgagccaccacgcccagcctatggaccttattcttaatccaggcttcccttctgtcgtcttctc

SEQ ID NO: 587232 - DNA, 392 bp, Homo sapiens
cggaacctcgagcagactgcggatgaagatgctgacaacaatgaggaggatccagaaggctcttccgaggaggttgttgatgaggacagattcctcgctgcacctttcttgaagatgaggtccgacgctcctgctggggagagtcgcacgttcctcaaaaagatggatgatgaagatgaggacgcataagattccgatgatgatgaagactgggacacaggttccacatcttccgattccgacttagaggaggaagaagggaaacaaaccgcgctggcctcaagatttcttaaaaaggcacccaccacagatgaggacatgacggcggccgagaggaaccgggaggacatagctaagaagatgcccgacaggaaatccaagcgcctggatca

SEQ ID NO: 587233 - DNA, 854 bp, Homo sapiens
  misc_feature (78)..(78): n is a, c, g, or t
  misc_feature (90)..(90): n is a, c, g, or t
  misc_feature (110)..(110): n is a, c, g, or t
  misc_feature (158)..(158): n is a, c, g, or t
  misc_feature (778)..(778): n is a, c, g, or t
agtcctcatcccagcgtagacatcccagctggagctcgcagtcagagactcagaagatcacatcactcccagagattntaaccacctganagcttctcattgcacttggnctgatgtccagactcttttctctggcgatccaaaccccccaagatctngcccttcccttcctccccaccctcgtttcttcccacatcccctcatctgccgtgcagcaaccatgcaggctttctcttgttcttcagatacaccaagcctggttccaccttatggttttgcatttgctgttccctatgtgtgcaatgctcgacctgagcccgggttccctggctcagggaacagaggctgacaccacactcataacacctgatgggatggaggagatggaggtgggcggaagaatgtgttccctggctcagggaacagaggctgacaccacactcataacacctgatgggatggaggagatggaggtgggcggaagaatgtgtaatccagacagcagcaagagtaagggagaagggaagcaagagagagatacataggctgcacatgcattactgagctgacccatcacttcttgagaaactctagccagttgctctgacacatgggaatctctggagtggcaatatggacacacttgtcccatatgcacatagtgttccccaatatccaccatataagatgccattacaaaccaggcgttttgggaaatgtgtaggctaccatggaaaaagaagtcttatttggcgaggttcctctgtgtgtatatatnggcgcggggtgttatcgagggttgattggagtcgtacatactagcgcacactcgcgggagaccgcgccactaatcg

SEQ ID NO: 587234 - DNA, 1118 bp, Homo sapiens
  misc_feature (342)..(342): n is a, c, g, or t
  misc_feature (354)..(354): n is a, c, g, or t
  misc_feature (374)..(374): n is a, c, g, or t
  misc_feature (422)..(422): n is a, c, g, or t
  misc_feature (1042)..(1042): n is a, c, g, or t
gaataagtctgggtgcaggcgcagtggctcacgcctgtaatcccaacactttaggaggccgaggcaggcggatcggctgaggtcaggagattgagaccatcctggccaacatggtgaaaacccgtctctactaaaaatacaaaaattacccaggtgtggtggtgcacacctgtaatcccagctactcaggagggtgaggtaggagaatcgcttgaacctgacaggtggaggttgcagtgagctgagatggcaccactatactccagcctgggtggcagagtgagactctgtccccaaaaaaacaaacaaacaaacaaaaaatcacatcactcccagagattntaaccacctganagcttctcattgcacttggnctgatgtccagactcttttctctggcgatccaaaccccccaagatctngcccttcccttcctccccaccctcgtttcttcccacatcccctcatctgccgtgcagcaaccatgcaggctttctcttgttcttcagatacaccaagcctggttccaccttatggttttgcatttgctgttccctatgtgtgcaatgctcgacctgagcccgggttccctggctcagggaacagaggctgacaccacactcataacacctgatgggatggaggagatggaggtgggcggaagaatgtgttccctggctcagggaacagaggctgacaccacactcataacacctgatgggatggaggagatggaggtgggcggaagaatgtgtaatccagacagcagcaagagtaagggagaagggaagcaagagagagatacataggctgcacatgcattactgagctgacccatcacttcttgagaaactctagccagttgctctgacacatgggaatctctggagtggcaatatggacacacttgtcccatatgcacatagtgttccccaatatccaccatataagatgccattacaaaccaggcgttttgggaaatgtgtaggctaccatggaaaaagaagtcttatttggcgaggttcctctgtgtgtatatatnggcgcggggtgttatcgagggttgattggagtcgtacatactagcgcacactcgcgggagaccgcgccactaatcg

SEQ ID NO: 587235 - DNA, 608 bp, Homo sapiens
  misc_feature (544)..(544): n is a, c, g, or t
tagtgccagtcctgcagtaggggggggcggaatagaaagataaggttttcgagaggagaagtgcgccaatgttgtcttttctttccacgttatactgtgtaaggtgatgttcccggccgctgttgcacctgatagtaagggacagatttttaatgaacattggctggcatgttgggggggacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgggatacttacaactcactagtatagatgtaacttattacaggatcatactaaaatttctggcatatgcatactgaagacattttaaaaaccagaatatgtagtctacggatatttattatcataaacccgacctttggctaaacacccaatttaactaaagacctactgtcgggtaggttcaattagaggaaatgtttattggcaatanttttggcttttaggcttgtgatccaacaaaataacccttaaacaatcaccacttaaattatgtg

SEQ ID NO: 587236 - DNA, 157 bp, Homo sapiens
actgaccaatatactatactccactgtgtaatactacaatcgatcagtcataaaaccaactctgtcctattttcccatcaaacacataacacctttccctctatgctgtgatacctcctcttcacacgcatacataaccattatcaccatataaaag

SEQ ID NO: 587237 - DNA, 223 bp, Homo sapiens
caggctcgctgtcgctgattacaggcacgcgcaacacacctggataatttttatattcttagtatagatgcggtttcaccatgttggccaggctggtctcgaacttctgaccccaggcaatccgcctgcctcgacctcccaaagtgctgggattacaggtgtgagccaccgctcccggccccaggagccctctcaatcagagtggtcatgccaggatcttata

SEQ ID NO: 587238 - DNA, 324 bp, Homo sapiens
gctcgacctttgaagctccagctcaaagggttttttgaatcctggttttgcttgtaggcagataatgcaccatgaactttcctctctattagtgaaaacctttcagttttggggtccatgttttcagacttcttaaggagcttgttggagtctgaagaagcttctgctaaacccatcactgtgagtattcttgggagttcttttttcccttctcctgcactttctttttctttacctcttcttcagctatgcactcctattccagttccaacagcaacccattagtcaattcatcaggaaccccctctaggaattactcaatgt

SEQ ID NO: 587239 - DNA, 102 bp, Homo sapiens
tgtatctcggctctaccttgtctctcggctctaccttgtttctcggctctaccttgtctctcggctctccctcggatacagtagggagacaaggtagagccg

SEQ ID NO: 587240 - DNA, 240 bp, Homo sapiens
  misc_feature (5)..(5): n is a, c, g, or t
gcttntgaggatcccatcgcgtgctgagcatgtatccgcctgcgagcatgtctttggttgtatcaaattctatgcaagatgttttctggattccttttattttttagacagggtctcactttgtcgcccaggctggtatgcagtggtgcaatcttggctcaatgcagcttccacctgctgggctcaggcgattcccctacctcagcctcctgagcagctgggactacaggcatgcaccac

SEQ ID NO: 587241 - DNA, 116 bp, Homo sapiens
cttctggaacaccacgtaggctacctggaaacccggaactggctttggatgaaaaaacttcgaccttgactcctttgggctctcagccaggtccggcttctgttgcaactccaaca

SEQ ID NO: 587242 - DNA, 1392 bp, Homo sapiens
gttctcaggacttcccctaggagcaagacctctgagcccgccagagcgcggtccgcagcggtccctcgcgcagcgatggcagctgaagagactacgtcgctagaagaaggaacaagggttaacgaacgattcgttcactaagaggttcttaccagggatcgatgaacgtcgggaagacagcagcttcgaacgtatgggaaccaagttggcttcggcttggcgtcatctggcgcacacaggatggctcatgatatgtggaccatggacgacgtagaccgtaggatgacctccgagtttggtagtgacatcaatctctgtgcagaactgccaaggcagcatacgctgaatggctctattgctgatgaccagtcacaacgtagactggctagcgctacaagataccaatacggagagcgagaaggtcggtaaactaacaaaggattgtccgctgggtaccgggtctacgattgtggatgcctagtcaggcttgatatgaatgggtatgcaggccaggggaggtcagcgcgaaccactgtggcactgtgctccccagcaaagacactcgcgatgtatacctacgtatctcgtggcctcgtgaacgtctattcgtccgacgagggaaattctgcaatggcataggtccactcttttggcaaccagtggacccccaatgaggtccaagcccgaaagccgaaaacgtcacttaccagctcgataggaatgctcgggggaagcatatggtgtgtcgggggaacttctgggaccttttccttggattgggggtgcagcgaaaaccgtggtgggcgtttggacacaccgtcgcgttgacccgtgtggggcacgcagtcgggagtgcaattgattaaccgactgcggtttcgcattccgtgggagagaagtgttctcccattaagggaaccactacatggtcatttgaggacgtggaagagcataggagacgcgccaaaccgtagaaaagctgtgccatgttggggtagtacagacccacgatgggttggtggggttgtccccagagagggcaaccgcgattgagctccccaaggtggctgggatctgtcgccgaggtgtgtccgttcctgccacttatccgatgttggccacaatgtggcgcgtgcgcgcggagaagtgtccagtctaggatggggccccaccagggggccctagggaggaaacggatgggcccaggaaaagggacaacaaacggcacggacactcaagaggggaaaggggagcgagagaggactgggggccaagaacacctacgcggaaggaacacgacctggggggcggccattgcccccaaggagatgtggccagtggcgaaagacatatgcggccaagcgggtaccgaaaagtggcgacaacggagag

SEQ ID NO: 587243 - DNA, 204 bp, Homo sapiens
  misc_feature (128)..(128): n is a, c, g, or t
  misc_feature (195)..(195): n is a, c, g, or t
gggccgcgtcgatacggctgcagacgacagaaggggctgtctcttggatataagccattttaactggggcgagatgatatctcattgtagttttgatttgcatttctctaatgatcaatgatgctgancaccttttaatatgcctgctgtcattgtttgtcttcttttgagacgtctattctcctgtggcctatntttgattgg

SEQ ID NO: 587244 - DNA, 232 bp, Homo sapiens
ctgtagaccatggagagaggacaaggtatgtacttcatgggatgtagaaggcagaaaatcatggtagacttcctgagtacttacagtgctgtcaaccaagggcatagtcaccccacagatagtgcactgctctgaagagtccagtggacaaatagaccttcacatctagagctttctatcataacgtacttggtgaatatgaggagtatattcctcacttaacaactaccac

SEQ ID NO: 587245 - DNA, 288 bp, Homo sapiens
cacctcgggaaccgaggtgataacgatacacacacctacaggatgaacctgatctcttatagtagtatcgcttcatcataactcttgccacacctaacctcctcggactcctgccacattcatttacaccaaccacccacatatctcataaacctagccatggcacatcacccattatgagcgggcgcagagctactaggctatcgaactaagatactccctgccctagcccacttctataccacaaggcccacctacaccccttatccccatactagttattatcga

SEQ ID NO: 587246 - DNA, 242 bp, Homo sapiens
gccccattttgcctgttgttccagttttggtcaaggcccttggggggtggccccccccccaggccttttaaaaaagccccagtttaagggccctgggaccagctgccctacttcccaggtttgtagccaggaaaagggggcatcccaaagttaatggtccaaaaaggggggtgtgagccccgcagggatgggcccgccccccccttggatgttttcagcaattaaatttttttaagggggca

SEQ ID NO: 587247 - DNA, 149 bp, Homo sapiens
gagacacgcacattcgataatcagtgggtcctagcgtatttcctgttgtaacacataggaaatatctccttttagacgtatagtatatttcctaggaaaacataaacccatggggaagatgacaacaagagacacgaggaatcccaaat

SEQ ID NO: 587248 - DNA, 102 bp, Homo sapiens
ttgttacccccggggcccggaactcggggggggggggtttcagtgacccaaaagggggggggtggggcccccccccctgggggtgggggaggggcgcgggca

SEQ ID NO: 587249 - DNA, 80 bp, Homo sapiens
gcggccgcctactactactactactattgctcgaattcaagcttctaacgatgtacggggacatgcaataaatgttctgg

SEQ ID NO: 587250 - DNA, 918 bp, Homo sapiens
gagctggtgatgatgccgctgctgggcgcggtgtctcatggaggcagacgtgcttttgatctctcggtccgtccttcttactcactatcctagaggtgctgtgctcagtcgccccggatggcatacgacttcgaatgtgacactggcacgagtgagcccccgtggaggtctcctcggagaaaatattctgtatggggttgcttgactatcagtgccgtgcaatcgtatcatcacgttgatacggtgggagtgcctgaatgtaatactgagtcaccagtcatcttgagaacggtcagtttagagggctggtgcaaaaggatgagttgcacattgttgaagcagaggcaactgaatttacgaaggcagtccaattaaagtaacactgtgcaaactttgaacaatgtctgtacagccaacggatttcccttgggggctcttgaaataacaccacccagtggtcttaacggtctgaactgtggttcaagggccagtgcctatagtggaaccagcactttagtacctgtgccaggaacgatgccgagtcagacgcatgacagaggaggacgatgtgacatcttagtatattcctgggaaacgcggctcttgccccctgggagggtggatacgcaagggttcgaaccgcagcaaccgtgacacttgctgcttgctgcacacgactgacgatgattattcaacagggtgatgcactgcagcgtactgatcactgctgcctctcgatgacgaggaagctactgcacaccgcccgtgcggccttatccgcatacccggcacaggctaagcaacacatggcattaatcaaacgtctaccccgatcacgtgcccaccccaaccgggaaccccagcacacagcagcctcggcgcattaccaccgtgctcatacgggatctacaggccccg

SEQ ID NO: 587251 - DNA, 720 bp, Homo sapiens
  misc_feature (7)..(7): n is a, c, g, or t
  misc_feature (720)..(720): n is a, c, g, or t
tggaaanaccggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtgtttcagtgacttcctgaggcactattcccgcctggagatctgtaacctgaccccagacactctaaccagcgatacctacaagaagtggaaactcaccccgaacacattctggatgaaccctcagtacctgatcaagctggaagaggacgatgaggacgaagaagatgcagagagcgtgtgaaccttactagggtgctcattcagaagcaccagacgcggcataggaagatgggcgatgacatgcacaccatcggctatggcatctatgaggttccagaggagttaagtgcgcagaccaacattgagctcagctgaaacttgttcctgacgaatctcgccagggagcgctcagacaccttcatgaagcttcgcgaggtgctgaaccagtataagctgccgccagtagagcacattctcgtgcctctcatcttcgaacccatcatggatggtgatttcagaatccgggctttcttggaaagaaagctgactgacacactgacgaagatgan

SEQ ID NO: 587252 - DNA, 218 bp, Homo sapiens
  misc_feature (212)..(212): n is a, c, g, or t
cagaaattctcccaccttggtcccccaaagtattgggattacgggcatactcactgtgcctggcctattgtcatgtttttttttaaaagaaagctccttgttttctgattacttgtggatacgtactcctggcttaatctgagacatgtacattttttactgtaatttgtttgttaaaatataaatatttctcttctaatttctggcccatntcagga

SEQ ID NO: 587253 - DNA, 536 bp, Homo sapiens
  misc_feature (452)..(452): n is a, c, g, or t
  misc_feature (457)..(458): n is a, c, g, or t
caattataaattgtgcctcaaagtgcacacaaactacacacacacacacagagcctcaaagtatgtgaatcaaaaacaacagaacaaaagcaggaaactgacatccaaaattatagctggtgaattaatactgctctctcagtaactgacggaacaaccagataaaaatataggaaaaatacggatctaaatgacaaaatcctgacccaaatggtacttggcagtgccaagatagactgtatgtcgatggattgagaaaaggttcaagcctgaaatagtatacaaaggatgttgtctgaacacttgaaattaaattagaaaccaacaacaaattgatatccagaaaagcctcaaatgtctgaaaaccaagtaataaactttgaaataccctgtgagtcaaaaaagtattcacaaggggaactggaatgtatttggaataaacttgttataanaatcnnatttctggtagactaaaggtgacaattctttcctgctcctctcttctgtgaggaaccattccccttaaaaccttggac

SEQ ID NO: 587254 - DNA, 757 bp, Homo sapiens
atcttcataatacatggaatagatatggtgcgttcacatgtggaacgacgaatgtggaatgcttacgacatgtaagaaacaagtcatgttgaatatttagcatatgggtaactccactagatggttatatagtaagagaaggatcttctggtcgtgcttgatatgatatagaagcatttcagcatgaattattaagttaatcaaatgaaacagttagtactatagggatgcttcgaataatacatatactttcacacggcgtaagatgttctttgctttaaaaacaaaactagaaaaacaaaaacatgtctccttcgtaagggaagtcttgtcttatggattgctgttcatcatttcctgattttgtatatttggctcacattagttcatacacttgtacttcccccttctgtgctaagctgagtactactttttatgacaagccaaatgtgagtagagattcctccactgggtgatgatattcccattctatgggctcttacaacattgatgtcaactccattcatttggcttatatatgttacatatttgcctttttatatgtttaacctagtctaatcaaattagcagcttcttaaggcagatactgtttctactcataatactttcatggttgccttatgaatcatgctcatttattttattcattcaatcacatattcgtaataggtatcgagttcactgtttgcacattgttctaagcaccgaatatctagtacgtgcattacacagacca

SEQ ID NO: 587255 - DNA, 847 bp, Homo sapiens
  misc_feature (614)..(614): n is a, c, g, or t
tgaaaggcaaggtatatgaagattctggcatcccccttccagtgtgagtcacccagagaaagggcccaagaaggtggcatctggtgtctagtcacctcgcctccagttgtccgccgtcactctccagtcaagtctcgcagttgtccctgatgggcggggggtccccggccataaagaaacataaggctgatgtcgacgactctagatgctcatgagactgaactccggtatgccacactaggtgacgtggtgtgatatggaagggctaggaggacaactcattccagctaagaatctctgacttactgcaacacatgtgcgcatgaaccattgagaatatcgtggatcttctgcatgacctctggctgatcctcctctcctcgcctgctgagcctttcacctctgacctctcactgttcatgccggcacctgtgtgatctcctgggatcgtccgaagcaaggtgcgtgctacgagagagaggctgaaaggctgctggggctgcagcctctgctattacccaggataatgcatctgacccctcgaccctttgacttcactcttgatgcgacatattttagtaccaggaaaaacaattaaagattttccctcctancaattatcgatctgaccccatcgaaaacacacactgttggcgcgcctgggcccccaaaaacattcccacaacccagcctgggggcggcgggccccggggcagcgcaaccctggcctcgttccccaagaactccgggcacgacagggtggtctcccccaaaaaacacgcggggcaccgcttttacaacccccgagggccgggccaccggcttccacgggcccacgagccgttac

SEQ ID NO: 587256 - DNA, 633 bp, Homo sapiens
gtgccgaaacacattcaactactccaagtaccccgcgggggtagacgcaagtcccccgccctttgatgaagttttcagaaccgtctttcccgcaaactgctcgttatgaaaaagttactagtgacaatctttcagcaccgggtcactagtagaattgaagaagtaatggcccacatacgagggcacaacagttgcaataaaccatatcggcgcgccacctgtctcccagcggcgccgctgaacatagctgcgcagcggaggacgcgcccacacagttgcgccactctgtctgcggtatttttattggggtggccatcaagaggggaattctctgctgtgtgtttctcgcacaaatgagcaaggagccccccctcttctctcgacgcgaaatctattattgtatagagagtgcacacaccgcactcagtcataaaaggatgggcggggcagcacacacaccaccaccggccgcacactaacacacgctcattatgtgggccttgtccacacgcggattcttcgagtgtgagcccatgtaggtgcaacaggagatatttcatagaatatatttgtcaatgcgcacgcagactataacaattaaacattttcctctgtggccacaataaacaagaa

SEQ ID NO: 587257 - DNA, 504 bp, Homo sapiens
  misc_feature (18)..(18): n is a, c, g, or t
  misc_feature (81)..(81): n is a, c, g, or t
  misc_feature (239)..(239): n is a, c, g, or t
cgggaaggcatgtaaccnccctaaacccatccccgagaacatcaagaggatcccacaacagttgaagagccttttgaacgnagtagccccgctcgtatcctatggtttcgctttcccacagtttgttaccctgcagtcaactgcagttcaaaaatattaaatggaaaattccagaaataaagaattttaagtctcaaatggtgtgcccttctgagtagcgtgatgaaatctctcgcctngtggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaaccccctcaactt

SEQ ID NO: 587258 - DNA, 179 bp, Homo sapiens
gcaacccactcaccttactaccagacaaccttagccaaaccacttaccaaataaagtatagcgatagaaatgaaaccttgcgcaatagatatagtaccccaagggaaagatgagaaaattatatacccagcatatatatatgcgcagggctctaccccctatatccctctgcatatatg

SEQ ID NO: 587259 - DNA, 326 bp, Homo sapiens
cccgatgggtcctgcggttccttgtcctgcacctgctgtttctggagtgagctcttgatttaggactactcacatttttccgtcaatgatctgtgacctctgagaggtcacaggggtaaaaataatacatggatgcatgaaaaccttccttagctcatgggaaagtatcctgagaatgggtatcaatttccctgcccaaatttttacatggagccaaactctgtacaaagcacatcgaagcctaatcacatcgagcattccaggagacactatgtctgatccgttctctcctgtatccccgagtcaaggcatggtaggcacgagga

SEQ ID NO: 587260 - DNA, 337 bp, Homo sapiens
  misc_feature (32)..(32): n is a, c, g, or t
  misc_feature (125)..(125): n is a, c, g, or t
  misc_feature (314)..(314): n is a, c, g, or t
  misc_feature (332)..(332): n is a, c, g, or t
cttttttcagcccttaccctccttctaccgtntattagtccccaatgttttttgttgccatctttatgtctgtgagtatccagtgtttagctcccacttataagtgagaatatgccatatttggntttctgttgctgcgttaattcacttaggataatggcttccagctgcatccatgttgctgcaaaggacataatttcgtccttttttatggctgtttagtattccatggtgtatatgtacatatttcctttatccaatccattactgataggcacttaggttgattccatatctttgctattgtggatagngctacaaaggacttatgnagtgc

SEQ ID NO: 587261 - DNA, 762 bp, Homo sapiens
gcctatgggggctgggcagatcttctgtctagatggtggtctctcgccatctatagatacactggatcatatcagagcacattgatcgcatacgaagaagttcggcccattgcaggggtccaatgtgtgacttgcatgtggtcagatccagatgaccgtgggggttggcggtcagttatctcctcgaggagcgtggtgtacacctgttggcgcaagtatattgccgtgcgacatgtgtaatcatgccgaagtggcctctacgttggtgtctagaagctcaggctagactaatgatggagggatataactggtgccatgatcggcaagtgtagtaacgatattgagtgctccaacacttatgtcagtcgttgtggtaactaaagctgcatagtcagtggagaagctgtgatgatactctaaagatactctttcttggagttttgacccagagacctcgtagaggcgagccacatgttactcgtcgtaccccagactacttcctgtaatgaaattttaaactttgtaacagtattgcagtgaaccatatatcgactaatggaaatgggaagagcaaagtaactccaaagtgtcagaaaatagttaaagcattcaaaaaactctgttttcacatggaccagagatggtgcttataaaatacaaggctctgtataaaagcgtgacagtttgaatgaccagtccatggtggtgaacgattgggggcaaaaccatttgggtaacgatggagacttggttttggaaggg

SEQ ID NO: 587262 - DNA, 628 bp, Homo sapiens
  misc_feature (402)..(402): n is a, c, g, or t
  misc_feature (482)..(482): n is a, c, g, or t
  misc_feature (487)..(487): n is a, c, g, or t
cacgatggctcacatctgtaatcccagcaatttgggaagacaaggcgggcaaatcacttcaggtcaggagtttgagaccagtctggccaacatggtgaaaccctctctctactaaaaatacaaaaagccggccatgatagcgcacacctataatcccagctactcgggtggctgaggcaggagaattgcttgaaaccaggagacaaaggttgcagtgagccaagattgtgccacagcactctagcctgggcaacagagcgaaactgtctccaccaaggtgggtggactgattgaggccagcagttcgagaccagtttggccaatgtgatgaaagcccatctctattaaaaatacaaaaattggccagtgcagtggctcacgcctgtaatcctagcactttgngaggccaaggtgagaagactgccttagttgaagagtttgagaccagcctgggcaacacagtgagaccctgtctctgctantacanttagccaaggtgtgtagggtgtgcctgtagtcccagcttacctggaggctgaggcaggagaatcactgggaacctgggaggctaatttttttgaattttagtagagaccgggtttaccatgtgggccgctggtctcgctcc

SEQ ID NO: 587263 - DNA, 198 bp, Homo sapiens
gtcgtaagggctgaggatttttggtccacgtctctctgactcaccgctgttcgctctcgccgaggaacaagtcggtcaggaagcccgcgcgcaacaaccatgcttttaaggataccggaaaacaccctgagccgagtggcattcaccaattcgaatcacctacaagccgcacgtaaatcttggaaagtgtgtctgctt

SEQ ID NO: 587264 - DNA, 382 bp, Homo sapiens
agcgcaatgtagtgcgagcttatctctagctacaagataaaaaataataaattcagcggagtgtgttgttgctgttcctattagtacctgcgaagtcacagaggctggagagggatgattgccttaccccaggaagtcacgcttgcagtgagctatgatcatgccgctgcattccagcctgggtgacgcagcaagaccctgtctaaaacaaactaacaaaaaactagggtgcgttgaaaaaaaaatcttggtgaacaacctctcttgtggattgtaatatactcaaagaaaaatatgatgtaaagattcttacatttactctcccttctgggtgtctaatcaaaaagcgtatatacctaagcttagttgacgctcgtaggag

SEQ ID NO: 587265 - DNA, 1340 bp, Homo sapiens
ggcgcgcgccgcactgccgcgccgtgtcagtcgggagggaggggagcgagcaggcgaagccgcggagtgacgtgggtgaagatggctggccttctccgagatgggtgtaatagcctgagattgcgacaatgctagtggaagagatggattggctcctcccaactgatatccaggctgaatctatcccattgatcttatggaggagtgtgatgtacttatggctgcagaaacaggcaccgtggcaaaattggtgctttgagtattccagttatccagatagtcttcatgaaacgtctgagagaccaatcaggacggcaaacaatggaaaaacaacaattaagactggtgcttcagtgctgaacaaatggcagatgaacccatatgacagaggatctgctatatgcaattgggctccacggatggtcttatgttcgctcaacacgcaggcgaatgctaacggcacctggcatgggctgtagagctactaccaggacttcatgacacaggagaacgagactacctaggacacgctatgcctgtcacatcgaacccacgggataagatagacagaagactcgcaggacgagaaccttacaccacctgccagcgcccactcgtctaggagaacacgaaagcgctaccgagcaccgaacacaacgcgggaccaaaagggaccaccagagcggagacaccacggcgcacacacacaaaccccacaagacaaacaacaacacacgagcctagcaacaacaggcaccaagcaacggcaacggaaactcaccaacccaaccgccacagaaaccacaccaacaggacacaatgaataaccacgaggagagataaattacgcattacacggggcgacgagatggagccaaacagcataggagacacgaaacacacacactgcgcgcaaccacgaacccgatctgcagcaccgctagggagaaccggacacgtgcacgacgcaaccccgagcgagcacgaagaatacgaacgaacaagacaacgtacgacaagacaagtgccattgtgcgctagacggaggttaatgaaaggaaagacgagtcggagagtacgatcaaaacagaaaacgttgcgaagcacggtaagagagaggaaacgaacgagggagggaccgacacacagaaagaaaagactgcgcgtagagaagagaaggtgtagacagaacgacagactaggaggtgacagagaataacacagcgggaaccgaacaacaggatgaggagaaggagcaaaaagcacacagagagccaaagaaacaaagaagaaaaagaaccaccacacagcaccagcggcacgaacatgagaataagaag

SEQ ID NO: 587266 - DNA, 173 bp, Homo sapiens
tctattccagtagagatggggttcacatgtggccaggctggtcttgaactcctgacctcaggtgatctgcctgcctcggctcccaaagtgctgggattacaggcgtgagccatggcacacagccttatctgcattttcaaacggaccagtatgatggtcgtggggtaggaggt

SEQ ID NO: 587267 - DNA, 213 bp, Homo sapiens
cacttggggaagggcccagtgataatgcctcttataacacccacagtgagcctcctgacgccaaagccactgcagcaactcgaggtgcctctgatcagtcgtgagacgtgtaactgcctgtacaacatacaacgccaagcctgaggagccgcactatatgtccaagaggacatggtgggtgctaggctatgtggaggggggcaaggacgcctg

SEQ ID NO: 587268 - DNA, 376 bp, Homo sapiens
ccggtccaatgtgttaattttgtagggttttttgtttttgtttttcattttttgagtcaaggtcttgctctgtcacccaggctggattgcagtggtatgatcttagctcactgtaaccttgaactcctaggctcaaacaaacctcccacctctgcctcctgagtagctgggactacaaacacacaccaccacacccagctaattttgtgtattttttgtagagatggggtctccgtacattacccaggctggtctcgaacttctggccccaagcaatcctcccaatttgacctccccaaattctgggattacaagcctgagcaaccacacccagcctcaatgttagttttttgtttttggtgttttttatatatat

SEQ ID NO: 587269 - DNA, 928 bp, Homo sapiens
acggtgcccatcagtaactattacgttggactcgctcatctctcacgacaagtgaagacctcggagcgtccagtgtttccggccaccggggcttcatcccgccgacgtcagatccagtcggtttggtgcctggactgtagtcgattgttcacgtcctgtagtcttcgcgcccaatgccggcagtgttcatcacgtcgtggcgcgcccgtgccctctcagtcgtccgtggtatatcacccgtacggcccccaggcccacacctcgtggcgccgtatcacgctgcatatcatgcaggacttggctcgagtccgctgtccggcgccgtctccttgccctcagcttcccgggccgggttggcctgtacactagcgtccctcatgtccggagctgcctagccccgggctggccgtgcggactgcggcccatgggacgtggccgcagctacccggtctagcgtgtacggctcgcccggggtagctgcgcagaccgcgccccgcagacactgccctcggcccgaggcgcgacgcgctcgccgagcatgcaagcacaaaagagcgagaagggctgatgctggacccctagcaatcccgatggtcaactggattcactgctccgctccacgaggaatgaagcgcgtgccccgtaccctcgaagtacctagacgcttggacactggatgaacgcgagttgctcttcaatactgtattaaaaccagggaccgtcggtatgaccgtggccgggtttctccagtcatcaccgaatcgggcaggatcaaaaatcctggtttccaggtaattcgaccgattgagattgagaccccgcatgcattacgaagactacccgcactatggagtagtcctaaacccctacccaagccttgctgcctcagcacaagccaaggcaaacccaaaatcccttaaattaccca

SEQ ID NO: 587270 - DNA, 788 bp, Homo sapiens
  misc_feature (27)..(27): n is a, c, g, or t
ttcaaggttcttgtcacccccgaatancgcgtgtagtgaaaggaccctcgcgcagcggtggattcaataaggattaaacttagatatagcactttaaaaaatggtcttaaagtccccaaccagtgtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaagcttatcccaggctggacaggaaggcctccaaggtgctttattcgtctgttggctcagtcatcacacaaaacagctggaagattgtaaagaactccccaaactttataaatcatttgaacgaacaggtcgaaaacttaaagtctaaagtaggggggaaccaaggcctgctggatagagtgacttaagagaagaaagtcttctgaatttcggctgcaaaattgctagttgccaccaccacggagcctctatccagacacaggacacagcgagagcctgtgagattcctaccttatgttctgcgtacccactgccagatgctgcaaagagaggttccaaggcacatcttgttcaacatgcattggcatgaattttctacaa

SEQ ID NO: 587271 - DNA, 118 bp, Homo sapiens
tcggtcacctgcttacttacccagtgtgtcaacacgacattgcaaatcaaggcaaaattaactccattacagtagataactgtaagaaacttggcctggtattcgatgacgtggtggg

SEQ ID NO: 587272 - DNA, 1082 bp, Homo sapiens
tatcagaagatcgtcccgagcattccaagtaatacagtgcatactacgcatctcaagcgcctggatagtagactatggtgcacgcaagagataagccatacgcgatacgggcactcatacccacgataacctggaccagagacagagcgtattatcacaaggaaccatagacagggcatagcaagacactcgcgagacggccaactgactgcatccacggtgaccccaatccccttagactttctcgacatcggggactcgactcacctctatcgtagtgcataaaactacaggataatcgacaggcccacaacatacttgggcagaccaccgagggccaactgaagaaaagaaggacaaatccaagccaacagaacaaacagcaaccatggcaacacacacataacacacgactataccacaaatgacgccacacgggaaaacgattcaccacacagcgagacgcgagaacacccaccaaaaagaaataggacgacaaaaccacacatgatcagcaccagacgtaatgagtgccaaaccgcacacccaatagagtagaacagacagcatacggggagcacaccacgaaacgcaccacaacactgacgaggggaaacaacctggtgacggaaccccgaccaaggaccacctaacggagtgaacgcgacgagaggaaaatcacaggggacccaacaacagaggaacaggagacagccaacccaaggttgaacgaaaaacgaacaactcgacaaacatctcgagtaatcaccacaaccagggggcgacattacaacacggagagcaaagaaacacacagcacccacagcaggcataacacggcgacaatcccagtaaaaaaaagatgagtcaccacgccctggaaagaaaggcaaaccgagacgaacataacgaaagaactacagagaaaatacaactacaacgaggcaaaagacacacccgacgaaaccaaccacaacccaagcaatcacacaggcacatctcacagaacaccacaacaggctacactataaacataaagacccgccactatcacgactgctacgcccgccccacgtaggcac

SEQ ID NO: 587273 - DNA, 395 bp, Homo sapiens
atggtcactgtgtggtagcaggtgcatatggggtaatagcctactagcccttattgagcggcaaacacatgggtgagtgctattatggggctgggaagtgggggcctggtgtcccctgtgatggctgtgctggcctctggctgcactggagaggggcacaggccaaggacatgacccccgtcaaacctgagccccctacagaaatttaaccagagcctgtacctcctttcttgcctgcccccaacatctcacattccctcctgtgatggccgatgtctccatctactctacagacacctgcaactatcattcccttgatccgtggtaattaggagggaactcctctgtgaagaactgcttctaccatcctcttatagaaactctttctccactgg

SEQ ID NO: 587274 - DNA, 699 bp, Homo sapiens
ggttttactgggatgataggacagagtgagtggattcgtcaccagcatgtttcctgtgactcttctctccacccttcttagggcgggaggagtggacatcatatctctaggatgactgtcccagaggagatgcacagtacttgggtctgccttactaggtgggacaggagagaggaagcccaatcagtctctatctagcattagagatgttcaactgtatccattccaccaccatcattcagaatctgtgggctctggaggcttgagctggcggggtggggatgcgtgaaggtcgcagtggatgtcgtcgtagggaggaagccagggggaaatcgcaagggcatcggggaaggggacaaggcacgtgaagtggtctccaaacaactcgaaacagatcacgtcatgggcaggtcccaaactacgcatgactgacgtcgagacgccaggtggtgtcgagagtcccctaggattggggggtcctcaacggggctgcacaacacaggcaacgcacgactacagactcgcataggcgagcggaaagaggacgagtggcgccgagtcgtggtgccttggcgcggtccaagcaggtcctcccctgagcgctctgatcccagctcacccgagggtcgggaccctgggcccaggggggcatcgaacagggggtgaatctctgagagtcgacgacgggaaagcgaaacg

SEQ ID NO: 587275 - DNA, 205 bp, Homo sapiens
ctggggagatagttcaagacggagttgcctcgagtagggaacgagtgcccctgctgacagccaggaaccacagcgtcgggctccgggtgcactgaacactccccacaaaagccaaaggcacaggcttgcagtgcaaaaggttctgattttccccactggcaaaaagcaaggctagcaacggcctctttcttcttcctttcttttc

SEQ ID NO: 587276 - DNA, 319 bp, Homo sapiens
gattcatcggagatgcatgcgaatgtgctcttggaatcaggtggaagtgatactggaattatggtcataggtgattccttatggatgatccatggtcaatcgagttcatgtagttatgtgggtatcgtacaagcctcattataaaacaactgcgcgcagtcggggtatcactgagatgttcctcgcaaccacttcccagaatgttacgtgacatggagcgtcgttataccttggatcatcatcaaaacaggagtcgcgaagcgaatctgtcagatcatccaaaattcatgcttcccgaacgctgatccccaattggcct

SEQ ID NO: 587277 - DNA, 744 bp, Homo sapiens
  misc_feature (231)..(231): n is a, c, g, or t
cacaggggctcatgcctgcaatcccagcactttaggaggccgaggcgggtggatcatgaggtcaggagatcgagaccatcctggccaacacggcgaaaccccgtctctactaaagataccaaaaacaaattagccaggcgtggtggtgggcgcctgcagtcccagccactcgggaggccgaggcaagagaatggtgtgaacccaggaggcggagctgcagtgagccgagantgcgccacggcactccagcctgggcaacagagcgagactccgtctcaaaaaaaaaaaaaaggaaaaaaaattggtagtatgcccagttggtttctacaagaggaggaactccgtggccgggggaaaacccagacacaggggccagaactccatatgagggaggtaaaagacaagatttgccttttattattccaaacgagaaaccatggggacgcgggaggtgggctacgtcaagcgttcataagaggaaagacggccactttggggaggcgccagggcagcggagggactcggttgttaggcccagagagctgaaagatcagccttggagcaagggtagcaaggatctccggcttggccataagtttttgctacgagaaggtttagaaatttagccggcacacaaaggcgtgggtgcagtggttcacgccttgtaatcccgagcacctgtgggaggccgaggcaggcagatcaccagggtcgggagtcccaagaccagcttggccaacatgg

SEQ ID NO: 587278 - DNA, 209 bp, Homo sapiens
agcctgggcgacagagtgagactctgtctcacgataaaagcaaaaacaaaaagaaggccaaatgtagatcccagcacttagggaggatgaggcgggcagatcacttgagatcaggagttcgagaccagtctggccagcatggcaaaaccccgtctctacaaaagaatacaaaaattagccaggagcggtggatcagccttgtggctacc

SEQ ID NO: 587279 - DNA, 1057 bp, Homo sapiens
cgcggtggctcacgcctgtaatcccagcactttaggaggccaaggtgggcggatcaggaggtcaggagatcgagaccatcctggccaacacggcgaaaccccgtctctactaaaaatacaaaaaattagccgggcgtggtggctcactttggaaggctgaggcaggcggattgcttgagcccagaagttcgagaccagcctgggcaacatagcaaaaccccatctcaatttaaagagaaagaattgttttttttccttttggagacagagtttcgatctttggcccaggctggagtgaagtggcgcgatctcggctcactgaacctctgcctcgccaggttcaagcgattctcctgtctcaacctcctgagtatctgggactacaggcacccaccagcatacccagccaatctctgtattttgagtagagacagggctccgcgtgccggccaaggctggtctcaaaactcccgacctcaacattgagccacctcaagtcaggagagtgaccaacttgggcaacacggtgaaaatcccattctctactaacaataccaaaaattggccgggcgcaggaggatcaacgcctgtaatccagcacttagggaggcccacggtgtgcgggatcaggagggtccggcgagatcgaagaacacagcctggaccaacattggtgaaaccacccatcctctactacagacctccacaactttagccacggcgtggtggcactgccggtcatcccagtcctataggaggcatcacggaggcagaactcgctaatcacgtgtgaaaccccagggagaggtggaaaggtaaccggcgtcgagctcaagaacgggccacccatggcaacccaggcgggggccaaaggacgagaacatttccgctgcaaaaagacaacccaacaacacgcacacaaaacacacaatgtgggcccgcatcactcacgaagtctatgacacaatgtgtgcaggggcgcccacaacgaaagacacgcagctcagtgaggccacacacagcaagaaagaaaagagcacaggaccccaacaacacc

SEQ ID NO: 587280 - DNA, 224 bp, Homo sapiens
cttcaaaggccagtttgggccttggccctgggggtttgaaactcacagagggaaactgggaccctctcccttccctggtgccttgcagggacccctttggaactcaggactcgattttaaggacccaggagggggggcaaaaaaaaggactgggggcctttaacgagagggggcctgcttcgggctataaagccaaagccattaaaaatagattttttttttga

SEQ ID NO: 587281 - DNA, 117 bp, Homo sapiens
  misc_feature (39)..(39): n is a, c, g, or t
aatatacaggaggctatcacacttgtgaaattctcttgnctaatctgaatttgcattcccatggtgttaacatggtatatgtattgttattaaagtaagtgcccatgtcaaaaaaaa

SEQ ID NO: 587282 - DNA, 742 bp, Homo sapiens
gctggcatctgtgcaggcgggctcatcagtgcgctaagctcgcactgattgtttagactgaataggacctaggaagtacaacagtgtcgtaggcttagatgccaggagctaagacagcggggaatccagcgctcgttccacagaagctgccatcaacgtatgagcccgtcacgcagcagtagcaatctgcctcgcataatcgcgttcgtaagtgaggcgtagtccgacgtgtgcgagacagagtatagctcgactcctggatcaagtggacaccgataagcccgattagcgaccggagtctcgaactactgcattatgtgattagactcagtaaagtggcttaatggcaagtagaaagataggacatgggcgcccgattgcgacttcgggaaggtcccaagacggttagcccaagggggagctcctctgagcagtccgggggcgtgcattcttgtcacggtgagaataaagcataggcgcgcaccgaatctcagatcgatatatcgcgaaaactctggctcgcgcgtgcacctcaagaacggtagaggccttgtctcgcgtgcatctcctctcaatacttatctcactcatacggcagggcacgttcgagggtggattaaacgcaaacccgagacgttacgcagaaatcttacgcatagcgtcctcaacttacccacggtaaggatgaactaatagcaggcgaccgtacaagcctagacataacccagtcttaatttaaggt

SEQ ID NO: 587283 - DNA, 223 bp, Homo sapiens
gcgagagaattgagctcggtaccgtcctgcctgctctccctatcgaggaatgccccgctacgcggcttttagcccaaatgggccattatcgaagaattcacaaaaagtcgaatagcctcatcatccccaccatcatagccacacatcaccctcctataacctcttacttctacctaacgccgtaatctactccaccgtcaatcagcactactccgccatactc

SEQ ID NO: 587284 - DNA, 109 bp, Homo sapiens
actgcgaacgcggttcttactgcgaaggcggcttcttactgcgaaggcggcttcttactgcgaaggcggttcttactgcgaaggcggttcttactgcgaagcggttctt

SEQ ID NO: 587285 - DNA, 872 bp, Homo sapiens
  misc_feature (56)..(56): n is a, c, g, or t
  misc_feature (67)..(67): n is a, c, g, or t
  misc_feature (305)..(305): n is a, c, g, or t
  misc_feature (500)..(500): n is a, c, g, or t
  misc_feature (872)..(872): n is a, c, g, or t
agcgcgcactctgcagtccggccccccgcgcactttggtccataaataatacaggntgtattttctncttactccaaaaggaggcgaactgagaggcaataaacatttcatcttaatcaaaacatcacctcacatctctataatttttaaagtaaaaccacaaaaaagcagtaagtcccccctcagcatccaccccataccaaacacacaccttcccacgcggcgcgaccgcgaggacgagaccccaacaactacatcaacataaatcatttttatatgaggtaacaaacttacttattataaanaataaaaaatttatcgccaatgttctttttctttatcttctatgatttctgatcgcagttttctatcatgtaatataataaatataaatgaatcgcacacgtgacgactggactatcgacgaataggtaagaatatttatgggttacacgactctcgcatgaagtttgacaaagagtgacatatattttctcttnattctattcttcgtgattggtatagatttctgtacacctacactctctaacactcaagtatacttaacttagtacagtgaatacgaccgagactaacaatgacacaccacacgtaaaataccgcgccccgtcgcctctgccttatggctgtgcggtcatccacgcagtatatagtcttaaatagcacacaaaagtgatagagatagtccgccgatccactcgttcatctacctcctcatctattccctaagtaatctattacctgcgcgcggtactcctatattaaatattcatacttcatctgtcttctctacccttctccatcccctactaacatttctccgcacacgactagataaacgagacgaaagn

SEQ ID NO: 587286 - DNA, 388 bp, Homo sapiens
aaggggttccaagtttccaaggcaaggattccagttatgtgctcaaggtgtatccacactgggccgggcgcggtgactcacgcctgtgggcccaggagtttgaaaggccgaggtgggcggatcacgaggtcaggagatcgagaccatcctggctaacacggtgaaactccatctctactaaagatgcaaaaaaaattagtcaggtgtggtggcgggcacctgtggtcccagctactcgggaggctgaggcaggagaatggcatgagcccaggaggcagagcttgcagtgagccgagattgcaccactgcactccagcctgggcaacagagcgagactcggtcaaaaaaaaaagagaaaggattcaaggcagtgtatggccggcctttg

SEQ ID NO: 587287 - DNA, 203 bp, Homo sapiens
ccgcgtcgactgtcatacatcaaagatatacatttattttaaatgactaagactagtttatattgtttctgaccagtgaaatgcatctgcaatttgaggaatgtgtgtgagtcactgcgtgcgtagattccagtcagacagaagttccaacctctcctttatcatcagatcagaggttaaagtggagctatccaggtcgacgc

SEQ ID NO: 587288 - DNA, 479 bp, Homo sapiens
gcatctgtctgaggacgacgagtcaggtgacgcgagtggagcgggcaagggatcgcttacacctgtagtactgatactacagaacagtcacgtaccagaggtggaagtccaagtcaatacgcatgaattgactgcctcactgactcaaccaagagtgtcagttgtacccgaggcgttactcagcatgcagccaagtacctgtggtaggatttccaggctgaactgattggcaggcattcttagacgtgagacctacgcaagaggttggttaaagccgatattgtgtagtagctgagtgaatcgtgattccaacgcgaaaaaacccaggcgtcacatcgtacagtctgttgcgaaggcgttctcgcccatgctgtgcattggtatctagggagaacccgcgttcatacactttatctatagccttcccctaggtcttcagaagtcatcaagttttagagctgtggacattggatatggtg

SEQ ID NO: 587289 - DNA, 1446 bp, Homo sapiens
  misc_feature (497)..(497): n is a, c, g, or t
  misc_feature (1384)..(1384): n is a, c, g, or t
  misc_feature (1446)..(1446): n is a, c, g, or t
tggaaatggatttccactcttgttggcccaggctggagtgcaagggcccgaactctctcagctctccactgtgcagcccactgtgcctctcccgaggttctcaagtgtgaattctccgtgcctcagcctctcccgaattagcgtgggaattcacgggctatgcgcttaacacacccaagctaattgtggttattttaagtataaaaagcgaaggtttctcctccaagtgttctcaaccgaggggctgtggtctctctcaaactctcccaccttcagcctctccacaaagcgtggcggggaatacacgggtgttgtgtgagcccacgcgggaaccaagccaaagtggtgccttctcttatattaggtggtcatactctcatgtgggctcttgtggttctctgtgcccagtgtgatttaacaatggggggaatataacgcgcgtggctatacacattcttctcattgtggtagaaacacctcttttcccccgtgtgtgncgtgaagaatttacaagtgagacactctcttaagaattttattctaaacattaggatatatttttttcccctgtgtgaaagacgcctaataagccgttttgagagctagactcttaaaaaagcgcgctgtttagttgtttttataatgtaaccccccaaagggggacagtgtaaacgcgagccccatataagtggggcctaaatgtgtgggccataaactctcctataattcatatgtcaggacacgtgcgcgcagcaacgcttttcacaaaaaaattttttcccccccgagggttctaacgtttttaaagagaattctccaaaccaccccatctctctttgtgtgagggccccctctaaccctttttgggtgtgtcccccaagagagtatgctacaacacaaacgaaggggtgtgcgtttccaaaatacaccccgtttttgtggtcgcctccaaatatcccccgggggagaaggggggccccgaaaaaatatctctcctccgcgcgcactttgtgggaacacccttcgtgtggggaaacgcctgcgtctctcccacaagggcgtgcaaacaaaaaacgtccctttgcggcaggagaaaaacccccccataaaaaagaagaggcccccctatagaaaaccgggcgagcaataataacattttttgcgcgcccctgagtgttatttttataacgcccccatttgttgtccctcccccgtgcggagacaaatagtggcggctctataaaattagtcgcgccgagctgttattaagaagcaccctccgcgcagcgttgtttagtataacccccccccctcgtcagagtggatcgaggtggacgcccgccagcagagcgtcgagtaaataaatcagccgatctatctgcgntagtcacttagtcgaggcacgcagcaggtatttaatctatccgcgcgactgactacataacn

SEQ ID NO: 587290 - DNA, 215 bp, Homo sapiens
gcgcgtacgacctcgcgagacacagagcctcgacttggtacgatccgacggcctcgtgcatcacccgacgtcgagctcaccatgggatgatgatatcgccgtagctcgtacgtcgataacggttctcggcgatgtgcacagacggacttcagcaggagcgacgaatgcctcgcccggggccgctactatcgcgcctcacattcgtgggagcgacc

SEQ ID NO: 587291 - DNA, 469 bp, Homo sapiens
taaggggggcccttttattcaaccgggctcaaatcaagggacagggaaaccctggctgcccccccccccccccaggggaaccaaaacccttcttaccttttaagttgggggaaaaaaaagggggaagggggtttgggtttcccccttatttttccccccccccccccctttaataaaaattttcctcatgggagggggtaatttcccggggggccccggggaaaaaggtgggagggttaatttcactaattgacccggtcaactggggccccttgtaatcaatgtttttaaaaaccacttatgggcgggtccgggggggaaaaagaaaccccctctcattgatatttaccggggggtgccccacccttgaattatgaggcattaaaacatgggccccccttaaaaagttccttaaaggggaaaacccccgggtgataaaaaaagccgccttaagggcaccataacccat

SEQ ID NO: 587292 - DNA, 194 bp, Homo sapiens
gccaaaacccgtctctaccaaaaatacaaaaaaaaaaaaatttagccaggcctggtggcgcgcacctctaattcccagctactcaggaggctgagacaggagaaaagcttgaacccgggagatgaaagttgcagtacgctgagatcatgctgctgcactccagctggggctgacagatgctgacactctgtctc

SEQ ID NO: 587293 - DNA, 436 bp, Homo sapiens
aactcactgtatcaaaaagtagaagcaaaatgtaaatgttataagtgactgaaatgtatttatgaatcttaagtcctacaaagaggtttgcaagttgatagaccactcaaagcacttaccatgacaatcactgtcactgtgctgggtattagggatgtggttatggatgtgttacaccggcttagtggacaaagggctcacagttggtgtgacagatacataacagataattgcaacatggtattagataaataatgataagaataagaagtatcagcagtagtatggaaaaagggaatcagtattttggtggaaaggagaggattgggaagacccgacagaacagataacacatttgttggtttttgagggtaactagaacctaagctggtagtggaagtcactgaagatggagcaaacagtacaaaaaaaaaaa

SEQ ID NO: 587294 - DNA, 970 bp, Homo sapiens
acacgtatacatgacaaactggagggccttcaaggctctcatcgctgctacagtacagcaggggctcaggtccgcgtgctcgtccgcgaccaccccacttccattgtggccaaaccaaccgcacccctgaatttctccggcaacatttccctgccaggccacaggtcccagccatctgcagggtgcatgcatggcattctgtgtgtttgcagcagcacacgccattgcctcactcatgtgagcaatgcaggcagctgcggggcaagtactccagaggcagcagcccaggtggtgcagctgggtgagcttagctgattccgatatagtgcccccagccagtacctgggtgttccccaccttgggcatcatgcacccacaaccacacaccaggcccactgcagcacatgcccacaggcaggcacagtgcaggcgcaattctggggctgcctggcatgctctacttgaagcacgaggcactcccctgcgtgggcgaacgagtgacatcggctgacatcaccagttgtctgcaccctgtcgtggctctataagcaggttctagagccttctttccgccaggcctttcccaatacaaccgctggttctcacctgcattaacagacccagtgcgggctgtcttgggggaagtgaaactgtgtgagacgatggcccacgtagatgctcagcacgttcgccagagacccacacctcacaacggaccacacccacggacaagcacaaagggtacccagagcaacagaagccacacgccacaggtgaaccgcacgcaggaccacacaggcggcatgcaccttgaatcacgaaggaagaagactgaccaaagtgccaccaccgcacgaaacgaagacaaggccaaggacccccgctacctgcccaaaaacaacaaggggagcataaaataacgaaagcaccaacacgcacaaaccacgacgaacacaagaacagaaccaca

SEQ ID NO: 587295 - DNA, 985 bp, Homo sapiens
  misc_feature (84)..(84): n is a, c, g, or t
  misc_feature (538)..(538): n is a, c, g, or t
  misc_feature (574)..(574): n is a, c, g, or t
  misc_feature (596)..(596): n is a, c, g, or t
  misc_feature (649)..(649): n is a, c, g, or t
  misc_feature (830)..(830): n is a, c, g, or t
  misc_feature (835)..(835): n is a, c, g, or t
  misc_feature (838)..(838): n is a, c, g, or t
  misc_feature (840)..(840): n is a, c, g, or t
  misc_feature (843)..(843): n is a, c, g, or t
  misc_feature (845)..(845): n is a, c, g, or t
  misc_feature (858)..(858): n is a, c, g, or t
ggcacgaagctgctgaaagctggtttgcgtcgacatggcggttaccctgagtctcttgctgggcgggcgcgtttccgccgccgncactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagaggcccttgtttcttcttacccgttgttaggggcgcagcgtcaggtgttcagctccccgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatntagacctgaggcgcttcaaaacatacattctgcttncacgcatggttctgtcattggntctcttcccccagcaccctgaaacgacagaaacaagcaatccgattccagaanattcggaggcaaatggaggcgcctggtggccccggccaggaccctgacgtgggaaagccaatggagcagatacggtatttacatgaggaatttccagagtcctggtcagttccaggttggtgaaggttgatgtcagcctgatgtgaccgaggagtttaaaagcaagttttaccacattggncagangcngngcngntaaatcttagagngggtgccacggaagcgtcgggcggaaacaagagccgggccagatagcgggacgggaactaaacggaagggtaggaggcgccgaacccggcggagaaacgcggggggaacaagaaacgagggggggaa

SEQ ID NO: 587296 - DNA, 134 bp, Homo sapiens
tgtgctttgggacggcggacactgaaggacgggatgttccacacctgcttgtggacctgatatggcgctggcggatcagcacgcgagcgttgtggatggacttgggcaaagccaggttgaagaactgggtcttg

SEQ ID NO: 587297 - DNA, 435 bp, Homo sapiens
  misc_feature (235)..(235): n is a, c, g, or t
gtgggtagtcaagatccctgttgtctgctctgtatctgacggactgtctaacacacgcgctgtgcacggtatctgacggtactgtctaacccacgccgctgtgcaccgtaatctgaacggtactgtctaaccgcacgccgctgtgtcaccgtagtctgaccgggtactgtctaaccccacgccgcctgtgtcaccgtaagacagagcacaaaggagcacccaggatgcacacctnacacacttcgcgggcgagccgcaagcctgaggagcgggagaccctcgcggttcagcggcgtgagggcagagcgacggagcccctccgcttctgtctgcgtgagcacattcgcatagaacaagagttctgacctggtcaaacacttgacacgcacataatggaggaaacttttggcatgctatcaaatgctttctcacatg

SEQ ID NO: 587298 - DNA, 772 bp, Homo sapiens
taataacaaaaggaaattattgggttaacggttctgcaaactgcacaggaagcacagtgccagcgtctgcttctggtgagggctttaggttaatcccatttatggcaaaaggaaaaggggacctggcttgtgcaaaaaccaaatgacaagaaagagagagggaagggagcttacaggttttggttttggtttttaaacaaccagctttctcaggaactaattgggagcaagaactcactcattaccacaaggaggacatcaagtcatccatgagggatccacctccatgacccaaattcctcccatcgggccccacttccaacatgggggatcaaatttcaacatgaggttggggggataaacattcgaactatggaaagttggtatggactatatctgggaagacggacacggatatgtgggaagtgtgccccttcgagtgtcacagggtggagtcagagaagcatccagacaaagcaggccaaggtggcagatcccaaggtcggagaccagcttgccaaccatggggaaaaccccatctctaacgaaactactatatatatatcgctggacactggtgggccagtgtctgtaatctccagctactccggacgatctgaggaggaaaaatcgtggaactcgggaggcggagttgaatgacgtggtatggccaatgcatcccagcctggtgaaacaccagaactttataggttgtccctccatgcagaatcgtcaaacaccctcgctcagtggttgctcaacccttaaggac

SEQ ID NO: 587299 - DNA, 1016 bp, Homo sapiens
caaagataaataaaacataggtccctgacttctaagcaaattcacaactttagcaataggaaactggactcatagatgctaaccttaacaacaacgtgacaaatgccagacaggacccatcagccaggcactgtgcagagcacagcagcagcggaggttaggagatcctgcctgcaggcagacctggtaagggaggcctcacaggaggcatgaccaggtctcagtcagcggggaggtggaaagctgcaggtgcatcacagggcgcaccctagacccgaggaaacacgctgccagacgagccatccactgctacaagtccacactaaggctcgacggtcacgtcaccctaaaccaacctgctccctctacagccacggcgcactgcagcttggagcatcccaccaacgcttcccctaacacagtcgcccagccccccagcgggcgcactccccgacgcctatcatcctcctgccacactgccctctagctgcacgacagacctacaccaaccactttcctacacgcacctctcgcagcactcctctactatctcgtccagctctcaaacccacttatgacaatcccacttatcaagtctcaaaccctccaagggcacactgccacgcagagagcttacgtcctcacgcttcaagaacccttgcccgaacacacccacaacagggaaccctaacacctctcctggctggctccaaccctcctaacctgaataggcttccaaacacaaaacccccacgcacctgcacttccgcaactgcaagcgccaagcggttcaaacaccaggctacaagcctggacacggctcacccgacgcttggcctacgccgcctttcacacacttttcctatacgctaaattatatccagggataccgatatctggaaacacgccaagctgcaagaccctactaaccccaacatcatcggccagcccccacacaacccccgtcgactccccatagcccctacgtccacatctaccttcccacattcacttcc

SEQ ID NO: 587300 - DNA, 405 bp, Homo sapiens
aaggatccccctaagtctattagtgtccgacaaaagtgtttgttaaaatagatcaaagactagatttctaaccattagggaagggaaagacattctcagagattcacaaatatacgtagttaatggaaccataacttttagaagtcagtgttcacaggacagatgggaatagctggaatgaagtgagctttgaatgctgattgctttattttatactagctaatgagtgaatgtgccacacatcctctaacctttctggaatggtgaacaaatggatagatgtgctgagtaagtgttggaaaacaactacatgaacccttaggcaactaggaggaatttaaagaaataaaccatgtgtttacaattaaactaggaaaagcctgtatatcaatccaattggtaaca

SEQ ID NO: 587301 - DNA, 145 bp, Homo sapiens
cttacacagcttttcgcaggtgtctggtctgtgtctaggtaatggagccctctggaactcccttagcaggagaatgctgcttccttcccagccccctgctgaactgagactggtctcttcctatgcatttggccaggaacactgt

SEQ ID NO: 587302 - DNA, 533 bp, Homo sapiens
gagagaactcgtctcgagtccctagtgttcatagtttagagttccacacgtctttaataagtcaataacggatccatgtagaatgttgcagtttgcttggtaaatcttaattgcgaaatttcttcttctttcggaactttgtttctgctgcatttgctggtttttcaggcatgagctatgagttctttcttcggctgtatcgtttgaattcagaatcagacagcagctcttccacaatagttgttttcctttgcttattgggaattcctgaatggtggaaatcccttggattggcaacaatggatccgatctggcattacttggggaagccatctctatcattcttcttgtgaaatctttttgggtacatgctggctctcatattcagtgctttgagatcatttttcaggtcatttgtcatttctggagctttcataccctagccattcgctgctgtgctttgaggttcctttctgcgcatgatctggctgatacctcgagtcactatatggagggacacgtgtggtgttttc

SEQ ID NO: 587303 - DNA, 215 bp, Homo sapiens
aatctgccatataaccgacatctaaaatcgtatcagaaaaacggatatacgcatctggcatgtgcttttatcctgtgtaaagatcaatatttttcaataattttaccatgattatacgggtcacagtatcatcattattcaaatacacacattgaataatttatctgcttaggcactgcctcctttttctaactaccctcattataattggtata

SEQ ID NO: 587304 - DNA, 391 bp, Homo sapiens
taccactcttgtctgcatctggtatagaatgctcaggatagtctggattctgctcctttctagctgcactcacttccttgggtaaagctcccatctgatttcatcataacttcactttacatacgcaaactcacaaatatcttccctgactgagactcctatcctgctgctgcttatcatctttacttgactatataacgaacatatcaaacataaactgaactgatagtctcctaacctgaaacctgcttctatagtcttccccaactaagttattggcaaatacgtccttgcattttctcaggccaaaatcacatcatgatccttggcatttctttctctggtaccccatgccctgtctgcagatctattggcaaaacctcccaacatt

SEQ ID NO: 587305 - DNA, 328 bp, Homo sapiens
tatatattcgtgtccgaccaaccagatgggactagaatcaagatctctgctttgttcctatgaaggacaaaattagagatttcatcatttggatccttttggaaatgttatttttacagaattatattgtagaaaagcagtgagtgttaacgaacaatactacttataagggaggccactggccatcagctttatataaagcagatcaggcttcctttggcttttttttttttttaaaatagcttaaaagctaattttcactaaaggtgtagtcaaagttataccacacttttccactgtctttcccctaagtggacacgattgtcca

SEQ ID NO: 587306 - DNA, 850 bp, Homo sapiens
  misc_feature (58)..(58): n is a, c, g, or t
  misc_feature (86)..(86): n is a, c, g, or t
  misc_feature (298)..(298): n is a, c, g, or t
  misc_feature (359)..(359): n is a, c, g, or t
  misc_feature (366)..(366): n is a, c, g, or t
gaagtcaagcatgtctgtcccaacgtgccatcatcctggtgggaataagaaggatctncggaatgatgagcacacaaggcgggagnatagccaagatgaagcaggagccggtgaaacctgaagaaggcagagatatggcaaacaggattggcgcttgtgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagnccttatgcggttaattttgaagtgctgtttattaatcttagtgtatgattactggcgcttngtcattnatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagtggtaacttttggtgaattaggctgtaactactttataactaacatgtcctgcctattatctgtcagctgcaaggtactctggtgagtcaacacttcagggctttactccgtaacagattttggtggcatagctctgggggtgggcagtttttgaaatgggctcaaccagaaaagccaagttctggcgtgtggcaaagtaccaggccggggtcacgtaagggaccatagtccggtaatggcccttatgtgtcccaattaatttttcccgatg

SEQ ID NO: 587307 - DNA, 264 bp, Homo sapiens
  misc_feature (64)..(64): n is a, c, g, or t
  misc_feature (114)..(114): n is a, c, g, or t
  misc_feature (137)..(137): n is a, c, g, or t
  misc_feature (145)..(145): n is a, c, g, or t
  misc_feature (171)..(171): n is a, c, g, or t
  misc_feature (175)..(175): n is a, c, g, or t
  misc_feature (216)..(216): n is a, c, g, or t
  misc_feature (257)..(257): n is a, c, g, or t
gcacgagcaccagctgtattggacccccccccgaaaattcggccagggttttcgctcttgtggngtctgttcaaaccggcccggtttgatccggaaatatggccccaatatgtncccccagtgtttccgtcagtacncgaagganatcggtttcattaagttggactaaangctnttccttcaaaggattatccggggcatttactcaatgaaaanccatgataattttttgtatataaaataaacatttgaaaaancccttca

SEQ ID NO: 587308 - DNA, 1013 bp, Homo sapiens
  misc_feature (58)..(58): n is a, c, g, or t
  misc_feature (86)..(86): n is a, c, g, or t
  misc_feature (298)..(298): n is a, c, g, or t
  misc_feature (359)..(359): n is a, c, g, or t
  misc_feature (366)..(366): n is a, c, g, or t
gaagtcaagcatgtctgtcccaacgtgccatcatcctggtgggaataagaaggatctncggaatgatgagcacacaaggcgggagnatagccaagatgaagcaggagccggtgaaacctgaagaaggcagagatatggcaaacaggattggcgcttgtgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagnccttatgcggttaattttgaagtgctgtttattaatcttagtgtatgattactggcgcttngtcattnatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagtggtaacttttggtgaattaggctgtaactactttataactaacatgtcctgcctattatctgtcagctgcaaggtactctggtgagtcaacacttcagggctttactccgtaacagattttggtggcatagctctgggggtgggcagtttttgaaatgggctcaaccagaaaagcccaagttcattgcaagctgttggcagagtttacagttctgtggtctcatgttagttacctttataaggttaccctgtgggtaacttcagtggccactttaatcgtgctgtggttccccaaacatttaattttagtttttaccccgagatctagctctgtgggatatattaggggacataaggggattgcctaacaaactgtgtatccttcaaagacacagtgtaatgggcttaagaacagaacaagctgtttggggaaa

SEQ ID NO: 587309 - DNA, 1063 bp, Homo sapiens
tcccgtgtggctgctctatctgtcgtgtagtattcgcattccctctgaattgctatgcgtgacacatggttcgtttcgcgttaaagtttctgtgtgcaatggtagtatttctagcatacatgtatgatgctacacagattttgtcaggtatgacggtgccatgtagccaggaatatcaagggtttcgcatctagcgtggactaatgactgtggtgctacatgtctctgtgattccatgttgcgtctagtcaaactttgctacatctttctcacacgccttaagcccatgtgagtagtccttctagtgtcgccaccagtagtcttggttgacttgatttgcatgagtctgtcatgtgatcacaagtgcagggtgcctctatggaatgagcagagcttgataacctagacactggaaataccgatgtcctggctgcacacactcatgacgactggaatgcagggagagcttccatctctactttcagtgttccgaccatctgcatagtcctcgatttctcgggtggtatatccatgatcttttcactttacgaatccctgactgctagcggacgtttgactaataagtacgtttatcagttatgtactatgcccctgtggactataaagcgagtagataatcggatggcgatagtgccaacttgatccatacaccatagtgcttccacagcattgatgcactgtaaattatataaccagcccccagtcagtgatggtggatatgttggctacttacagctattttgctgttacaatctgcggagtggccaggtacatgtggctcatgcctataatccctagcattttcgggagacacaaagagaagatggattgcttgagctccaggagttcaagaccagcctgggcagcatagtgagaccttgtcatttacaaccaaatttctcaataacttagactggcaggatagtacatgcctgtagtcccagctacttgggagggtgagccgagatgaagatcgctagagccggtgagtcgagacaatcaacgcggaatttgccactgccgaacatgcctctctctccca

SEQ ID NO: 587310 - DNA, 178 bp, Homo sapiens
acgtattgtcacaggtagatacagtcatgaaattgcagcaagtctctataccaaccatgacagtggacaaatcccatagtgaaaagtccaggaacacccatccccaggtcatgatcacgggatcttcaacagctcacggagtgctccaacagctccaaaataaccctcagttttatcc

SEQ ID NO: 587311 - DNA, 325 bp, Homo sapiens
tcccttatctttatgtttatttttatttcttgacgcttgggtcctgtctgtcaccccaggctgacgggctgtggtgtgctctcagctcactgcagcctctgcctctcaggttcacgtgattctcctgcctcacgccccccacgtagctgggactacaggcgcgtgcctccccatccctgataactttttttgtatttttattagagccggggtttcaccatactgaacaggctggattagaactcctgacctcaggtgatccacctgcctcagactcccaaagtgctgagattaccggtgtgagccaacgaacacggactgacaa

SEQ ID NO: 587312 - DNA, 281 bp, Homo sapiens
cagggccccctttatgcagggtggaatgttatccctggggggggcttggaccccccctggtttttttttttccggcccccccccaactctcactggaatttaaggaccctgccccccggggggttgggggtatgtcccggcccttttcccccaattgtttgggggtgggaggggggggtttttcccttaaaagggggggcccccaaaagctttttttatgttcaatcaatcaggcccggggtcccaaacattttcaataaacccagattggggccccccca

SEQ ID NO: 587313 - DNA, 228 bp, Homo sapiens
ccccgggttcaggcgattctcctacctcagcctcctgagtaactaggactacaggcgtgacgcagcacaccctgctaatttttgtactttttagtagagatgggtgccgagaccagctccgtgtgcggaggccagctcggttgtggagatcctaacccagcgttgctagaggaattaaagacacacacacagaaatataaagtgtggagtgggaaatcaggggactag

SEQ ID NO: 587314 - DNA, 1763 bp, Homo sapiens
  misc_feature (671)..(671): n is a, c, g, or t
tgcgggcggtcgactactcctggggggggtcggtcgttgtgttttcctcttaggtcactatgttgagtgtggcggttgtcctacaggtcctgtgtggtgtcattcatatcttgcgggcgtctgcgtccgttgtgtgcctgtcctgtatacagttaagttaaccggtgcgtgttgtcttgtatcgctttctgcgacagcctagttgttccccccccagagagggcacccgaggggttggttctcccccacgcgcgatcttgatggaggggcgaatattgggcgcgccagctggttcgtttcgcccgcccccctgtctggacgtgttccggtgttgtagcagtgtattacatagatgcgtgcgtgctctcctcaagaagagtgttcgcgcccccttgtgtgtgtgtacggcggcccgccccccgcccgttgtggtgagtacgatgtgggagaacaggggggcgccctagtgtgtgttgttgttcccctgcggtggtgtgttgccaccgaggtgctgatccacgtgtggtgtgtttcggcccccacccttgcggccgctgttgttttttggtggccagcacaatgactgtccctcccgctgggggtttggaggacgcaacttgtggtggggtggcgctaccgcaccgccgacacccccctctccggcgaggcgnccccaacggcatggttggttgtttctcttttccggcggggggcgccccttctttcccccgcccttgtggttggaggatggattttcttctcgagatgcggttgtgtctccccgcgtctgtggagtgtccccccccggggggcggtgaatgattgggaaagactttattgagggggagaccaccctctcttctgggccgccgctctccccccgcgggggttttctccccacgggggcagccgcttcgtgtttggtggagcaagaggtgggcgagtttggcgccccacggtgtcctcacgacgagtctctcggcgccccccactgtgagcctgtctatactttgttcgttattacagcgtgtgtggtttgtttcgcggcctctttttccaccactgttctaacacactgtgcgggaaaactttctctcctctctctgtgctctttctgtgcgcacacagacacactctgtgttcgccacactcttgtctctgtgtgtgtgaccactctgtgttagagagagaggcgacagagagtgtcgccacaccgtcctccacagcagagagcacactctgtttttgtggggccgccacgccactatagggcgtggtgtgtggtatatgtgataggggacccgcatgtgtggcgccactctataacacactgtgaatctgtgtaccgcggtgttataagcccccacgcttctatgtgtgtgacacctctatattggaggctcacgccccctcgaagcctcgctttgtctcttttcacggcgctttgtgagatatacacacaggctctttataattgtgagattttatgaaatctctgtgaccacctcttttatatgtagaatgtaaattcgcgcgctggagaaacacactcgcttgttctgaagaatcccactccccacgctgtttttctgtaatgtaaaatctgtggtaatacccccaccaccgttatccacctccactgagcttccttttgccaccacgagccacgcctggcgatctgggccactgaggaccgcctgttcacaaaaccacacacccaagggtttgggattttttccattaaaagaaaatttttcccctta

SEQ ID NO: 587315 - DNA, 145 bp, Homo sapiens
acaggttcattctaaacatttcttagagaatgactctcccattttttgcaggcgttcattcatctctgcagctcttcttttcccctctttccagaactagttgtaatgtcttcatctgtcaactcactctctttagataggcaaa

SEQ ID NO: 587316 - DNA, 972 bp, Homo sapiens
gtcggctgcccaggcctccccgggcccgggaacaggagtcccagctcactgcattcttcatctgcttccctgcgacgcattggctggacatcgaaacccctgccatcctggagccctggacatttcagtgcacctgacctcagtgtcgcctcagatcctgtcccgggaccgcaagactcttaggtgcccctctctttgtgccatctgcctctaggtcccatcctggggcctgaagcgctatgtactctgcgctgggaaaaggggaacgatggagcgatccagcacccaaacttaccctgtccaggtggcccacgaagctacccaagacatctctgcacatgcccatagccattatatggcttcacccacatccgtatcgggagttgggagaaccgggctcatatatactcactcataaggaagaatacctgcatgcatccagtggtctgagagtcaacttgtacgcataccaaaaagtcatcatggtggccctggaagagagcccagaagctcctggtgtggagcccacgaagagcggtagacttcagagcctccagtgcctgtggcggctggaaggtgacgttgggggaccccttgatgatacgacgttcgcatggtgagaaacaccacacccttcatgcaacgccatggggaggcaccaaaacatagtagtagatagagcagcacggaccaagtgaaagctacaccaatagaagggcacagaagaccgagccaagaaacgccctgaaacaaaactaagcgaggaaccggcgggcgacgcagactaagtgggaaaaaattggtagtcctatagaacttgtttgacatggtaactgggtggcataaaatgaggcctgtaaaacatttgaaggtaaagagacaaattacaattggaacaataaacctgggaccagggaatactggactggtgtggcaagacaacttgttaaaggagaaaggcgcactttggtg

SEQ ID NO: 587317 - DNA, 1585 bp, Homo sapiens
tgctggcgtggtgcctggtgttgatgtggagcgctgggttgtggtcgtccccgtgaggcgcgacagggtgagcctgagggggatgattttgttcgcctgctgtggccgggaaagcggcggcgtgtgaggtgttggaaggtgggtgtggttgacgaggtcgcgcgggggacacgcaccagtaggtagagtgtgttggggtgggcaggattgcctcggtggagccgtgtggggggtgtgatccacggggagggtttgtgtggtgcggcggggcgcacggagttcgcgttgtttgggtaggtgcgcaggggatgggcccctctgttgtcgctcgcggaagttttcccctggggagtcccccacagggtagtgtttggagaggagggttgccttttccgggggggagacccacgttgtgcaggaaggggaaccggtggtcggccaccaggtgatagtgtggtggggaagtggtgtctcccgccagggggcacgcaaatgtaaagttgggccccgaaaatgttgtgccccatggagctcgtttgggggaaattaaggagggggacgccgaccttgttatagggggtggcgcccagctggtagaagtcccacaggttggggttctcgcccgaaagatgcgtaaagtgcccagggaggtcagcccccacagggggtgtgttgcccccctcccccttgggggaagaaagaggaggtgtggtggccacgggaagtgtcttcgccctcgggtggttggttgttgctcttgtgtcttgtagatgtgagagttgccaccagcctgttgaggccactgtccccacggggtgccgcccgccacatgtgttgtatatgggtgttccccaccgcacatgtggcgtgggaaaagttgtggagaaacagggtgttctgtttttgggtgtaaaagaaataagtggcccccagataaatacccgcgttggtgttctgctgagagaaaaagggttgaaaaggcctctttgttgaaaaagagaggcggaccagctatagagagagatttggggggagaattgagcctggtgtctctttgttgggggaaaaaagggttaatagattctaggctttacccacagagaaaaagtgataaattgaggaccacatatagagatatagagagattagaaggtcaccacccgagacacatgtttttgtgagaggagaatttgaagaaattaagtggctctaaagccgcctgagaaaatggtatatgtggataggagatattgtgtggaagaatgtggttgtataagaatgcactaatgggataaagatgtctttgtacttaaaaagtgggctgtgttgttagtagaagccactcttgactctgttgtgtctgaaaaaaatgtgtttaagaaagaaaaaagatagtgaacttaactttgtaaagtgagctcctcttggaagaggaggattgatagatagtggaaagattatagcctgatagtggtcttggccagatgtgccagataattttgacccatgccagccatgtgttacctgtgcaccattaaaaaaatatttccaaatgccatgcatattaaatataagacacccgaga

SEQ ID NO: 587318 - DNA, 80 bp, Homo sapiens
catttgacagctgcagaaacctgaagcccacggagggaaagggcttgcccaaaagtcacacagcaagttaagggcaaagg

SEQ ID NO: 587319 - DNA, 395 bp, Homo sapiens
gaaactccatacacactaaagaaagctactggcaatatataactaaaataaacctctgaattctaccactgaaatggtgcatcatgaagcttcaaggaagattttgattggatctctttagtaggtcacctgccaatccctggaccaatcatgggcattgagccatacctgtagtaggggactgggtaccaccattggcagccccagaggaatctcacaaaattagaaatagttcctcaaaaggacattcatccagcaggagttcgagaccagccttaccaacatggagaaatcctatctctactaaaaatgcaaaaagtagctgggcgtggtagcacatgcctgtaaccccagatactcgggaggctgaggcaggataattgcttgaacccagg

SEQ ID NO: 587320 - DNA, 145 bp, Homo sapiens
gcactcttcagggacaacacacgacagccccttcgaatcttccaaaataagcgtgttccatcaaagctgagcggcagcttgtgaactcatttctcttagataagctgcatgtgattttctctacatatcctgtgggaccacactc

SEQ ID NO: 587321 - DNA, 804 bp, Homo sapiens
ggggagggtcatgacgcagcgagtttcagtcgtgacttttctgggggcatcgcggcgtcccctttttttggcctttaaagtaataacgtcgccccgacgcaccccccgggtatttcggggggcggaggctggcgggccaacggtcgtcgaagaggggcggtgcgtgacagccttggccggtcccgtgtggcgtgttgtgggggggaggggcgccgtcgcgcggtcggttccgggcggttgggtagcgcgcgagctagcgaggcggagtaggcagtcgtgcccgccgccgccccttgctctgtatgccgtctgctctcccggacgcggtcggcgtcgatcacagctgccaggagtccaaccgacgccgcggtgtgatgtggtatgggccggaggctgaggagggtccagcaagatagccgacagtccaagtcccgggaagatcggcgatcctgggctaccggtctgtgggggaaatcctcattgacgattcgatttgttgaaggccaatgtgtgggctccgtagatccataccatagaatgacacttttggcatgttggagtcgcagtaaaatggacaagaagtatcactcttgcaacttgtagacacagccgggcaagatgaatatgctatcgtttcctcagacatactccatagatattaatggctagtattcctggtgtattcgtgttagatcaagtcacaaggttttgaagtgattaaaagttatcagtgggcaaagttgttggatatgggtggggaacgtccaaatacctataatgtggggtgggaataaagaaaggacg

SEQ ID NO: 587322 - DNA, 370 bp, Homo sapiens
gacgaagtttacatgaggaaacatctaatactctgatggcgtgtgtcatatgatcggttgtgtagaagtaatgagggatttacgctcagagctaatggctcaattccctctcttcagtagttatatatctttttttttgagacagagtctcgctctgcctcccaggttcaagcaattgtcctgcctcagcctctcgagtagctgggactgcgggcgcacactaccatgcccgtctaatttttgtaattttagcagagacggagttttaccatattggtcaggctgggctcgaactcctgacctcaggagatccacccgccttgcctcccaaagtgttgagattacaggcgtgagccacggcacccggcca

SEQ ID NO: 587323 - DNA, 231 bp, Homo sapiens
cgcaggaggcagagcgagatagcgcactgcactccagcctgggtgacaggtgagactctgtctcaaaaaaaaaaaaggaaggacagggacaagagaaaaggtcctcgtagaaattaaaaataccaattatgtaagtatcggcccactccagggagataagtaatagtacccagatcggtggtccctcatatactcctagggcgggaaagttaatccaatgattccatgtgt

SEQ ID NO: 587324 - DNA, 224 bp, Homo sapiens
catgcgaacggactgatcgaggcggcagcgttcctgcccatcgaccccagccccggcgctacgagttgctccagacctgcctggtgcagacctccgatttcgccttcacgcggcccctggtcggctttgaaagctttgccgagggcgagctgatcgcccgcgatggcccgcacgagatccgggccctgtgcgacgactgcacgggatcagtccgttcgcatgtt

SEQ ID NO: 587325 - DNA, 415 bp, Homo sapiens
  misc_feature (76)..(76): n is a, c, g, or t
  misc_feature (96)..(96): n is a, c, g, or t
  misc_feature (253)..(253): n is a, c, g, or t
ctttcctccacccaagacccacatggccagactctaggaatcttagcttctacaagccaaggtgaccatgggagtntgacagaggaccatgggggngaaagggggacccaaaagtccttcgatcagcagtgctaaggtggggcagagccaaggaggtagtggggctggttctgaaagcttttgggggcttcatctgctctgaaggggtgggactaagagaggaggtgatgttctggttgggcccagggttttnttttaatcttaagtcttctgggcattcatgggcccagtctttttttctgtttgagagtatcattctgttgcccaggttagagtgcagtggtgcaaatcttggctcacttgcatgcagcctctgcctccctgggttcaaagtgatactttgctgataagccca

SEQ ID NO: 587326 - DNA, 687 bp, Homo sapiens
gtgaactcactggataatgtgcggtaaggggtccctacgaagacagagtgatgtggcgggtgatatgctctgcatataggatggtaattgttgaatgtggcgctaagtgtcatgcgatggaagaagtgcaaaacagaagggtggggaaagtggtcatccctaagagcatcagaccataagtaaatggagttatagtctacggattgccccctatttgacttaaagcctaagcacatagtgctgacaggctaatccgctaagtggaagtggccggctgtgttattcaataagactattccccaaagtgttattcttcctaatagttgcagtttctcgcctggagctcatgtttcgtgccaaaccgccatagatcactggtgttggcaagctgtacaatcctgtagacacttcgccaatccatcacacgaatgtgaagtctgttgaactagattccatataatgcactatgattcgtttaacagtatgagagaaatccaattgatccatcctatataggtgaatgatggatgaggggctatcattgttacgagaaatagatccgagaatctagggtgtgatgggatgccgagcgtaaggtagacagggagactccggagtagatagctactctgagtctccttagggaagacagtggtgttaaccgaatgtgttacaagctgtacgcaa

SEQ ID NO: 587327 - DNA, 202 bp, Homo sapiens
ggcgtgctgtggtgctctagcggctcccccttcgcccagccgccttcccagcgccccagccagctccttctggccgtggctctcacacgcgcccgggccggcgcccgtccggcggctcacgcgggggctccccctccggccatctccccactgggcggctccggtcgggctcgtcgggggggtcccgcgctcgccttcgtcc

SEQ ID NO: 587328 - DNA, 1363 bp, Homo sapiens
ggtctgctgctttccatacggtcggctccgcagctggctggctccgcgagtaccgacacgaccgatcgccgagaggttcgcgcgtgaggggtgcacctgacggcatgggagtcgctgcgatcgtaggcggggccggcactatgcgaccgaagcttatcgacacgaagctgagctacgtgttgcatgggagcacgacagtgtcttctgagacatcggtctcacgggagtcacgctgaaaacaccatgttcttgagcacgttgccatggtatcacagaattgcagaggacagcgcgaatggtgttgcaaggctgcacggcgcacaggttgtagttgaggacgtcgttcgcactcgggcacgccatggcgactcgccgattttcagatgagaatcgccaagatgcgttgagacgcgttagtcgtatcggtttgagtgacagtggtcagacggtctaatgacttataaagagacttgtgcaacaggcgttacggttcataaaggcttctcgggaagcttcacaggcctattgaggagaagggtatcaagtgcttgcgttggcaatttctcctcaccattttctgggctcattgcacttggactagacctccgaccgctagcgccgttgaaggcctgcagagggaatttacacgcttgataggaaggcccatctttgcacaccatggcaatagtgccaggggcccatgggagacacctattcctttccctacgtacgagcccctttttgaccgtgctaccggggagggcacgggttgagcgcgtgaaaacgagctcaacttgtacatgtgcattagcacgtgcgaacccggggggcattctatgtaccccaatcagaggccgtggctctaccattggcatcggttgggcacatccaaccccgttagggcccacttggattcttttggcgctttgacggccattttgccagttctggggcaggccttcggggtaaggacacccccgtgtttgtgtggcgtaggcctagaggttgggtcggcttctggacgttggatcccttcggtcagagggggggtacaggtccagttgggacccctgtccttagcgttctccctagtggatgcacgagagccttggttgagttcactttggacacaataccttccagattttgattgacattttgactgccctttcattgggagaatgaccttttcatagacttgtattaggccattaaagtcatatacttccttagatacaacgccaggttatgaggcgatgggcggaccgaacttaacgtttgccacgtggcagtatgaggccccatgtggaccaaggccactaattcagggagtcgcatacacaagaaggggtggtatgaggtc

SEQ ID NO: 587329 - DNA, 390 bp, Homo sapiens
  misc_feature (16)..(16): n is a, c, g, or t
  misc_feature (382)..(382): n is a, c, g, or t
  misc_feature (385)..(385): n is a, c, g, or t
ttaaatatacagttcnctggattttgaaaaatgtatacgtgtacataatcatggatcccaccacccccagttaagatatagaacattcccgggcccggttcagtggatcatgccttgtaatcgcagcatgttgggaggctgaggagggtggacccacttgaggcccaggagtttgagatcagtctgggcaacagggtgaaaccccgcctccactaaaaatacaaaaaaaagaaaaaaaaaaagaaaaaaatagctggccattgtgacatatacctgtaaccgtagctactctggtggctgaggcttgagtatcgcctgggaggcagaggttgcagtgagccaagatggcactgctgcactctagcctgggtgacagtaaaantgncttta

SEQ ID NO: 587330 - DNA, 965 bp, Homo sapiens
aaacttcggctaggtacgaggcctgggtggtgctttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggccttggggaatcttcctccacctgttcccgggcacttgggctgtggcgagaatggcctgaggttcgggggccttcggaggtttcccccgcctccagggaggaggccgggacgcgggcccaaccg

SEQ ID NO: 587331 - DNA, 109 bp, Homo sapiens
ccgcgtacagttgcgaaacaacaaaatagaacgcggtctatccattattcctagctgcggctgagctgtgcctggccctggcttcttggaggcctttgccaactgcggc

SEQ ID NO: 587332 - DNA, 497 bp, Homo sapiens
caccctccagtcctgtgaaaatgccccacgatcaccccctgatggagcaacatgcttctttgttgaaagacaggacagtggatgctgtgagacctgacaccgtcacaggataccctcctccagcaagttccttggtgccaaatgttgaaagccacatgctgagctgaaagacagtgatccaaataagagaagactctcaaactgtgtgttgaatgataattcctcaagccactgtttttattatactcatatgcatgaagatagaacagagaatcatctaagctcttcttttgcttaacatcaaaaccttataaatactcatgccgtttaggaaaacagattcatcagtttaaatattattgccatagcagcagataatcaagttaaacaactaattagggttactatttacagaatttagcatcaatctatgaagtccagatatctttaaagactcctttgtacaaaacaaaacaaaatgttgttttaaaaaaaaa

SEQ ID NO: 587333 - DNA, 2616 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 587334 - DNA, 2667 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccggctgcgggacgcgcgcggagtcgcgcggcgggcgggacctggccgagctggagggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 587335 - DNA, 2481 bp, Homo sapiens
acttacggctagtacgaggcccgggtgttcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 587336 - DNA, 371 bp, Homo sapiens
ggcgccctttattttttctctttgttgatgtgacaaacagcttttattccagattccagtgtccgcagcatgatggggtggggcggaggtagcggcgggggcagcattgggacccgggcggggtgaggggggggcagtccagctgtcagatctctgctgcaagaccgtcaggtgcgtgggaacctgacgtggaggcgggaggtaactatagctcctggccagcctgatccctgcggagtcctttgatcccatggcggtggcctttgtgtcgttgggtccaggtagcatattgctggggcctgggagaagtcacgattcacctggaaggtgaaggccctgtaatatgatacgcgaggacgctacgtgactat

SEQ ID NO: 587337 - DNA, 165 bp, Homo sapiens
tgcgaggttgttctcttccatcttcgtcatacgggccgctgttttaaatgaggatgcggtcaggtccacgcctggggcagcgtccatctccacattgatctcaccacccaccaggcgccacaccacgagccacacgaagagccacaccaagagccccacaatgag

SEQ ID NO: 587338 - DNA, 2618 bp, Homo sapiens
  misc_feature (355)..(355): n is a, c, g, or t
  misc_feature (358)..(358): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (368)..(368): n is a, c, g, or t
  misc_feature (372)..(372): n is a, c, g, or t
  misc_feature (407)..(409): n is a, c, g, or t
  misc_feature (411)..(415): n is a, c, g, or t
  misc_feature (417)..(418): n is a, c, g, or t
  misc_feature (420)..(420): n is a, c, g, or t
  misc_feature (422)..(422): n is a, c, g, or t
  misc_feature (425)..(426): n is a, c, g, or t
  misc_feature (436)..(436): n is a, c, g, or t
  misc_feature (440)..(443): n is a, c, g, or t
  misc_feature (445)..(445): n is a, c, g, or t
  misc_feature (449)..(450): n is a, c, g, or t
  misc_feature (452)..(455): n is a, c, g, or t
  misc_feature (461)..(462): n is a, c, g, or t
  misc_feature (465)..(465): n is a, c, g, or t
  misc_feature (476)..(476): n is a, c, g, or t
  misc_feature (483)..(483): n is a, c, g, or t
  misc_feature (487)..(488): n is a, c, g, or t
  misc_feature (495)..(495): n is a, c, g, or t
  misc_feature (500)..(501): n is a, c, g, or t
  misc_feature (506)..(506): n is a, c, g, or t
  misc_feature (510)..(512): n is a, c, g, or t
  misc_feature (514)..(514): n is a, c, g, or t
  misc_feature (521)..(522): n is a, c, g, or t
  misc_feature (531)..(531): n is a, c, g, or t
  misc_feature (533)..(533): n is a, c, g, or t
  misc_feature (545)..(547): n is a, c, g, or t
  misc_feature (586)..(586): n is a, c, g, or t
  misc_feature (588)..(588): n is a, c, g, or t
  misc_feature (596)..(596): n is a, c, g, or t
  misc_feature (612)..(612): n is a, c, g, or t
  misc_feature (621)..(621): n is a, c, g, or t
  misc_feature (633)..(633): n is a, c, g, or t
  misc_feature (637)..(637): n is a, c, g, or t
  misc_feature (642)..(642): n is a, c, g, or t
  misc_feature (645)..(646): n is a, c, g, or t
  misc_feature (657)..(657): n is a, c, g, or t
  misc_feature (667)..(668): n is a, c, g, or t
  misc_feature (678)..(678): n is a, c, g, or t
  misc_feature (681)..(681): n is a, c, g, or t
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagaaaaaaaanggngngangangnaagngaggaacgaacaaagaaaaggagggcaaaggaaannnannnnncnncngnagnnaaaaaagtanctannnnangagnngnnnnaaaagnnganggagagagggnaagaaanagannagcaccncaacnntgacnaaannnanaagaagnngcaacaaangnggcacaaaagcnnngcgcgggggaagaggccggcccggcaccccgcggcggangngcgcgcangaagcacctgcccaancggccccanaaaaaacggaancggnggagnccnnacaaccaccgngagccacccnnccccctgcanctnaacccccagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 587339 - DNA, 567 bp, Homo sapiens
  misc_feature (255)..(255): n is a, c, g, or t
  misc_feature (413)..(413): n is a, c, g, or t
  misc_feature (429)..(429): n is a, c, g, or t
  misc_feature (489)..(489): n is a, c, g, or t
  misc_feature (522)..(522): n is a, c, g, or t
  misc_feature (544)..(544): n is a, c, g, or t
aaatggcacttcaggaacaagtctacacctctatatattttttgaagcagggtctcactctttcgcccaggctggagtacagtggtgcaatcatggcccactacagccttggctcctgggctcaggtgatcctcccaccacagcctgcagagtagctgggactacaggcttgtgctaccatgcccagctaacttttttttttttttttggtatttttagtagagatagggtttcactatgttggccagctggctncgaactcctggcctcaagtaatcttcagcctcccaaagggctgggaattacaggcaagagccaccgcgcccagcctaacatctctgtattttaaagtctatgccatatggtattacttgtcttttttttgggagagcgtcttgctctgtcacccaggntggagtgcggtggcgntacctcggctcactggaaacctctgcctcacaggtttcaagcaattcttctgccttcggnctcccaagtagctgggattatagggttgggtancacgccagctaatttttttggnatttttagtaggagacgggtttc

SEQ ID NO: 587340 - DNA, 313 bp, Homo sapiens
tagacaacctagggtcagttttgcaggtgtaaagccatttaccaagatagttgtaggtaaagaagggcagatttattagagaaattgtgtaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 587341 - DNA, 2596 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttg

SEQ ID NO: 587342 - DNA, 84 bp, Homo sapiens
  misc_feature (84)..(84): n is a, c, g, or t
tgctgggattacaggtgtgggtcaccacgcctggccgcttaattgttatttctacatgaactttagaatcagcttgtctaattn

SEQ ID NO: 587343 - DNA, 2568 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgccgccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 587344 - DNA, 1847 bp, Homo sapiens
aaacttcggctaggtacgaggcctgggtggtgctttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 587345 - DNA, 1935 bp, Homo sapiens
ggcactttgggagtacgaggcagatgcctgagctcaggagttcgagaccagcctgggcaacaccgtgaaacctcgtctctactaaaatacaaaaaaaaaaaattagctgggcgtggcggtgtgcacttgtagtcccagctacgggggaggctgaggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 587346 - DNA, 712 bp, Homo sapiens
agagctgagccggtccaacaccctcatctgccacattgacatggtcttccgaccagcgctcaacgtcacgtggctgtgcatcggcgagctggtcactgctggtgtcgctgagagcctcttcctgcccagaacagattacagcattcacatgttccattacctgacctttgtgcctttactggaggacttatatgactgcagggaggagcactgcggcttggaccagtcgctcctcaagcactgggcggcccaagagccaatccagatgcctgggacatcggatactgtgctttgagccctgtgcctggtgctgggcctagtcggcgatcatcgagggcaccgtgctcatcataaagtctctgtgtgctgcacatgaccctcggtgccagtggaccctgtcatatactgtaaaggagacacagtatgtgaactgattaggacgtacgagagatctgaactccagcttgcctacaaactccatctgagctgttcttcgcacttgatgtggctacttcagtggctgactcgaatgctgacctgtaagctctgtcttatcattacctcatagcagtcatccttaggagagtttcgacaatcgagttcatgacactgtgtagcactatatggagatatccttcatgagcctttaacctctgactctttgagaaccctactgtacctaccagactcctgagacattctcagtttcgcc

SEQ ID NO: 587347 - DNA, 2622 bp, Homo sapiens
  misc_feature (2068)..(2069): n is a, c, g, or t
  misc_feature (2074)..(2074): n is a, c, g, or t
  misc_feature (2090)..(2090): n is a, c, g, or t
  misc_feature (2126)..(2126): n is a, c, g, or t
  misc_feature (2128)..(2128): n is a, c, g, or t
  misc_feature (2142)..(2142): n is a, c, g, or t
  misc_feature (2157)..(2157): n is a, c, g, or t
  misc_feature (2165)..(2165): n is a, c, g, or t
  misc_feature (2170)..(2171): n is a, c, g, or t
  misc_feature (2174)..(2174): n is a, c, g, or t
  misc_feature (2176)..(2177): n is a, c, g, or t
  misc_feature (2179)..(2179): n is a, c, g, or t
  misc_feature (2181)..(2181): n is a, c, g, or t
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggactggganncatantttattttttttttcntggtttttatgttttttttttctcttcttttttttncntttgtttctttttnttttttttttgtttnttgttatnttttnnttntnntntntgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 587348 - DNA, 424 bp, Homo sapiens
ggagctattgagggtctgtgatacatgaagttaaaataggcacagtaagtgattaaaacaaaataataaaatagaacaattatataattacagtatactgtaaaaaagttatatgaatgtggattatctccctctctctcaaaatatttattgtgctgtaaccacccttcttctggtgatgatgtgagatgataaaatgcctacatgatgagatagtgaggtgagtgacataggccttgtgacatagccttaggctactactgaccttttaaccatatgccagtaggagaataatctgctgtgaatgatcctagatcagtgagccataataatgtccatggttagacgtcaagagcagacaatgccgatgactaacgggcaggtagtatatacagtgtggatgtgctggacaaatagaggattt

SEQ ID NO: 587349 - DNA, 216 bp, Homo sapiens
  misc_feature (6)..(6): n is a, c, g, or t
  misc_feature (102)..(102): n is a, c, g, or t
  misc_feature (177)..(178): n is a, c, g, or t
  misc_feature (198)..(198): n is a, c, g, or t
ttcatntctgggacactcgcatgttgatgttgcaatcaactgatgccagcagaaagctattttagatttgtgaacatgactgccttatttaaagggtcctgnattgccttgatattcctaagcacattcattaaactagaaaccaggaaaacacttttgcaaataacagcataaggnnacttcactgtctctgctcantaaaatacctgtaactgg

SEQ ID NO: 587350 - DNA, 155 bp, Homo sapiens
tctcgttcggaagccccaagttaggtaacaccaatggggagtattggcgatcgtgtataccacgtcgatctgctgactgaagttccccttcgctcatccacaacgtgcggccttgctgcaccacgataccggcttgggctcagtacgctgcttac

SEQ ID NO: 587351 - DNA, 964 bp, Homo sapiens
taaaaacacttttgacccccaaaaaaaaggttttattttgggggcgggtaaaaaaaagggggggaaacttgggggggggggggaggaaatggcgatgtggtggcacgggaggcgcgtcaacgggttatctgcgtggagcaaaacccagagtagggggcccacgaggtatggaaattacaaaccgtggggtggccccagtgtttgtggcataatggtcaaaagacaacaagaaacacctctctcaggaaggacaagagtttgtgggtggggcgaaatagctcggtggacacacgtggtaactttaacaacacaatgaattatttccgcaggtggttcctctcccagaaaacaagggtggcctaaaaaattcgtgggtggtatacaccaaacacaatcatatatgggcgcggcgggtgaaaacaaacagggggggcgcccaacaaactactgggtggcgccacgacccacaacaaaaaaataatgttacattacatacaatggtggtggaccatctccggcgaagaaaaggggtgaccacccaccacaggagttgttacaaagaagtggagaagttgggtcgctcaaaaaacagacctccttttgtgggtggcaaaacggctgtgtagtcaccccgtggggggaacccagcaggatgaaatggggtcgaacggggtaccgaggaagaaatagaatcaacccaccctattattgttacccaaccatttcaaccaccccaatctgtgggtgtccggcgtgcacagcacaaacaacattcaggcgaggagatgcacacataatcgttcacaacaacagacacattattatgagcaagcggcgctactaaccaaagtgggccccctataaggaggagcagtagactacgcggcgcaaaagggagggaacagcacgcgtatggtcccaagtaaacaaaaacatattaccgcgtgcaactagcaacaacaaa

SEQ ID NO: 587352 - DNA, 190 bp, Homo sapiens
ctgtatgcctgtgagggatgcacatcatgaagacacctcgggatttgctgctgacacattaggacgcccatactctggcttgaagaagccctgttgcacccaccaagggtaccaggcagcctccacaataccgagggctgtaggagtcgggcatggggccactgacatctttcttctccccgggatacag

SEQ ID NO: 587353 - DNA, 349 bp, Homo sapiens
  misc_feature (47)..(47): n is a, c, g, or t
  misc_feature (88)..(88): n is a, c, g, or t
  misc_feature (98)..(98): n is a, c, g, or t
  misc_feature (103)..(104): n is a, c, g, or t
  misc_feature (106)..(106): n is a, c, g, or t
  misc_feature (197)..(197): n is a, c, g, or t
  misc_feature (205)..(205): n is a, c, g, or t
tccctccctttccttccctaccctctcaccatcttttttggcctctntgagggtctctctgtgcatctttttaggaatctcgctctcnctctttaagnagccnntntccttcccccatttttgggtccacccctgaactcctgagggacagaagccccaggcctcccccagccttgaacccttgcaaaggggcaggncaaggggncccctttcactcctgctgctgcccatgctttgccctcccttttggttgctttgagggttcggagcttccctttgggactaaaggagtgtcctttaccctcccagcctccagggtttggcagaaataaactcccacccggctgga

SEQ ID NO: 587354 - DNA, 262 bp, Homo sapiens
gacattacggggcttgccacattagacctttttgttctgcagttaatattcacctattttacaactcattgtggactcatgaaaaacacacaccaccttttggcttacttcgagtatttgaattgactggatccacttgcagtgcaacagtgcatagtggccataacttaagatggggaaaacacacatgggtttggggcaataggaacatcatcataattcttgtggttctatttcaggtataggattataaaataattgg

SEQ ID NO: 587355 - DNA, 300 bp, Homo sapiens
tgcgcgagtacttggctgcgtgtcagcttggttgccggcattcagctctagtcgatgctgctggtgacctggcgccactccccgcgagttcacccctgtcggtgccgcctcctggacaagtttctggcttctgtgagcaccgtgctgatctccaaataccgttaagctggagcctctgtagccgttcctcctgcccgctgggcctcccaacggggcctccttccctccttgaatcgggccttactggtctttgaatcaagtctgagtgggcggccgcaaggtgctcggcgggcgcaagga

SEQ ID NO: 587356 - DNA, 946 bp, Homo sapiens
  misc_feature (165)..(165): n is a, c, g, or t
ggatcgcacatgctgaccttcctgcagcaactgcgggtggcagtggcccgtgcctcggagagagcttcctcccacagcctgaggagccacgccttgaagaattacctctgctattgacggggaggacattgtccccgtgacattcctaggcagactggttgtctngaacgcgaagcttggttggagagaacagggccgcatagtgggtatagacccaaacttgacaactgttcttgtgactgagggatctccttctcttgtgctggttgagtttgcagaagaaggttctaattgggattgccccgaggaacaggccacccaggcctggttggggcctcagatactggtacagggcggctcgctttggttgtggaccatggtgggtagctggtgaagagaggaatgtcccagcaaaacatgaggttggacgctgcttgtgcagaagaggtgggttcagcgaaagggttccatccagacgagaaacgacctacattctggtgggcccgtgggtgaaaggtactgggggcacctgggactcttgattgattgcccttgagtacacacggagttcggggcatccccaagggtgttgcaagggctcagactttgaacagcatgcggggaatctggcaaagagaccaaggcttggaaaagagaatcttgtgtacctcttctggggcgcccatccatgtttggtatgtgagaaggccccaaagagcaggtttcctggctctggctgcacgcgttgttccagaagggaccagatgggcctttgcatgatatgcgcccgttgcaattttggagttcagttttcgggccctctttgccattccttgggagctggctacggagagagggggtggggcaccgaacccctggcgtgcggaggggaggccggccatttcggggatcgcggaggtcaacacggccccttgctcaggtggca

SEQ ID NO: 587357 - DNA, 1674 bp, Homo sapiens
ttatgtggtagaggtggagtggtaagatgaagtgtaggtgtaggatgagatgatagtgagtagtagaagtattgttgatcagtaggagagtacagtacgttggtatatgaagtatattgtgttaatgttgttggtaagagatgagttggtaatgagtaacgagtggtggtgtgagtagtacatataaaggtgttaagtaagtagagtatagttggatatcgtgtaaagtagttatgtcaagaagatgttgtctgatagtacggtggatgagaattggaagtggtgagctataaagtattggaatatactagttttgtatggatgaagattgtcttgtaatatataattgtggtatgattagtggtgatgattggggattgaagagattagttagtaggtaggtattgtaatcgggtgggtaaagtgtatgtgtgggggataagggtgtgtttgatgggatagtgtgcaagtgttagataaagtttgatgtttggtgtgtgttatcgacgtaaagtaggtttaaggtgtgttagggtagaagtttgcgtatgtagagtgagttggtgtgttgtatgggttatatgttattggggtgatggtatatagggtgggtgtgtgtaagtatatgtatgttattgtggtatgatggtgaggatgtgaagatttggtgtagaagaggggtgttgatagaggtgtgttccgtgtgtgattgtagtagtatatatgggtgtatggtgtttgtgttagtggagaggatgtgagtgtggtggtgagtgagggagggtggtggtatgtaaggagtggacttctgtgccgatggggggtatgttgttaggtgggtgtggtaagtatatgtgactgtaagattgggtgtatagggtgggagtggtggtaaggtggtgtggtaggcgatagattgttgtagagacgtttggcattgggagttattggtggtggatggggtgtgtgtgatggtaggtgtgaggatagtgttgtgtagtgtatgagagggttcaagttgtgtgcaggtagaagtggtgagggtttgagtaggaaagtgaagagaatggtttgtggtgattggggtttaaggctagggtaggctgtcggctgtgtctcgagagagttagtgtgagggttggtggtctctgtgtgtggctgtgtgagaagtttggaatgttgtgagcattgtaagatggaagtagtggatacagctgtggaggatggcctgtgggaattgatagcagcatggctgtggtgaatagttgtggcattgatactgtgttggtaagcgtcgtcttctgtccattgtacaagtggtgtgttgttgcaatggacatgggttcagtgtttgtgttgtagcccagcgtttgtgaatcttccagttgtgcttttgttctggtgcttttatcgcaagttgactacctaatgatctaatcgagaacatataatgaatgcacttgttgctgcacttagtgtaactgtggtgtggcttttgcagcttaaaacgaggtacttcatatgctctagttgtaaatgtgtcatgaaaatccacttctctactagtcgaactgctgttagtgtctcaccagtggttttacatctgcagagttttgagggctgtgctgacctttgagaggatttgaaattgctttaaattcgagtcctaaagtt

SEQ ID NO: 587358 - DNA, 805 bp, Homo sapiens
ggttggttcctgaattcgctgcggctgtgggaaatgctggcgcgcgctgtgcggtataatgtggcccttttgctgaggatctctctactgacttctgtcctgcgtctccgcgcctggcttcctctggattgccccgaaacaccgtgatattgtgcgtgccgcagctatggaggcctgcgtgatgagaacagaatggcgccgagtatccaccggatcctggagcctggtttgaacatcctcatccctgtttttatacctggattacagatatgtgcagcagtctcaagggaaacttttgtcatcatgcagtgctcgtgagacacgtcgcgcatgtgatggtctcgacaatgtaatctctgtaaattaatggagtcctttacctgtatatcatggacccttacaaggtaagctacggtgtggaggaccctgagtatgcctgtcgatcctcagcctagctacaaacgagacctatagagatacaccagcatcgagtgagaactctctcgtggcaccaaaggtcattccgaggcaagcgcgaagatccctgaatgccagcattgttggatgcctatcagaccaagctgctgactgcgtgggttatccgctgcctccgttatgcagcatcaaggatctccattggtgtcaccccggggattgaataggagtctatgcagatgcatgtggcacggcatgagcgccggaaggcgggccagagtgctagaagtctgaagggaccccggaaagttcggcatcaatgtgggcagaagtgaagaaacaggccagactcctggcctctcgaagcgaa

SEQ ID NO: 587359 - DNA, 921 bp, Homo sapiens
gctccgcggcggcgtggtgtgcaagggaggtgccgctgcggttcaggtgttgaacttgcagggggccgtgttaagcccatgcagatcgccgtggacccccaggaagagccgcataatgcacctgatgtcaactacgtggtggagaacccagactggatctggaacagtacgcggcagctacagggttgctgatgcgcatcgaacgggtgcagttcattgctgatcagctgtcccacgctgcgggtgtgatgtgccctgaagatggccctctccttcgtgcatgagaacctttaaccgtggacatgtactgaggaggatccaccgcaatgctctcagaggcaccagggagctgcagaatgcaccctgacgccatccctgagagctggtgtggagcccccagcctggacacagctgggtggaggccactgcggacagaaggcggctgctgaagctggagaagctggagccacagacctgaatgaactacaaggtgctaaatccatcaaagagagcatccggctgcggcacgacgacctgtggtgaccactacctggagtgtggggacctcagcaacgccctcaagtgctattcccgggccgggactactggaccagtgccaaacacgtcatcaacatgttgcctcaattgtcattccacggtcaagcgtctactctgcagacattggtctcatgttggtcagactaccgtacaggcaaggcgttgagtcaaccccaagaagattgccgagctgactgagagcgttgacaggcaaagccagggcatacttcacaggttcagttgtgcgcagccttggaaagttgccgccaggaattcaaggaggctgccaaagcccccgtgggtcattgagcccttggactcctgagtgtgtccccaaagtggcctcaggggccgcgcctggcg

SEQ ID NO: 587360 - DNA, 287 bp, Homo sapiens
ctgcagaatagaaaaaatacaaaaaaaaggaaaaccttatatattttaggaaataatgcttgcactttttcagactttttcacattattgagtacactattctataaaagcatggctatattttagtaacccttgaatattgttaatagtgtaatgtatgctaccatgggtgaataaattagaattttcagactatgcctttattctggcattcagaataatatctctatgggaatatcaccactgttgaaggtttatttgttagattcctgcgttagttgtctccg

SEQ ID NO: 587361 - DNA, 123 bp, Homo sapiens
attttttaattttttggaaagggggggcccccccattttgcccctcccgggggcccacctggggcaaaaaaggaaaggcccccaatttttaagttttttttaaattcaaaaaaaattaattga

SEQ ID NO: 587362 - DNA, 289 bp, Homo sapiens
cgaggtggaatcaaacaggagaaagagggaggagaggagggaggagagagtgtaggaaaaaagcaggaggaaagagccgggcacggtggctcacgcctgtaatcccagcactttgggaggccaaggcaggcagatcacgaggtgaggagatcgagaccgtcctggctaacacggtgaaaccctgtctctactaaaaatacaaaaaaaaaattagcagggcatggtggcaggcgcctgtagtcccagctactcgggaggctgaggcaggagaatggcgtgaaccctggag

SEQ ID NO: 587363 - DNA, 399 bp, Homo sapiens
caaatttcacattcatgcaattggaattgggaagtgtaaaagaaggattgttaaatgtgggaagcttcacaaaaaggggcgcaaactctgtgtttatgctttcaaaggagaaaccatcaaggatgctctgtgcaaggatggcagatttctttcctttctggagaatgatgattggaaactcattgggcccaatgaccccatttaagagagcacccagccagtttatgaagtagaagccagaagcttccaggtggaggttgagaaaagaatggtccccagtgcagcagcttggcagaatcctgagtcagagaaaagaagcacctgtgtgttgagaggacaaatcgtggctcagcaccccagtttgaaaagcgcaagtgaaacaatcattggaatcttcca

SEQ ID NO: 587364 - DNA, 118 bp, Homo sapiens
aagagattcgtttatggaggctgattgggcaacaagaacaactaccttctggaagaagagtgcattctagcctgtcggggtgtgcaaggaccctccacggaatagccttagttgatag

SEQ ID NO: 587365 - DNA, 221 bp, Homo sapiens
  misc_feature (157)..(157): n is a, c, g, or t
ttcatatggcaaggcaaggcaggcgggggtcagggcatagaggaaggaggctgccgcccatctttccctcccgcccctacccaggcacacacagggactgctggcaccacgctggctgggctcccacctgtactcaccacgcaaaattgccaagtgnggcattcggttcagacctagtctgtggccttgcctatatgcaagggtcaccgagctcgcacatt

SEQ ID NO: 587366 - DNA, 322 bp, Homo sapiens
tatggtggtgggcacctgtaatcccaactactcaggaggctgaggcaggagaattgcttgaacgcaggaggtggaggttgcagtgagccaagatcatgccactgcactccagactgggtgacagagcgagactctgtcgcctggactggagtacattggcatgatcatggctcaccgcaagccttgaccatcccgggctcacagtgatccttaccaccgtcagacctccaacatagctgggaccacaggcatagcatcatgcatgcgtcagcgtaatacggaaaatactacatgagcacggtagagaacagcgtctatgact

SEQ ID NO: 587367 - DNA, 847 bp, Homo sapiens
catattccatctccggagtcttcttcctcaaactgtgattcatccactctgaaaaagtacgatctaacagcaagggagccttagacccatgctatcacattattactattagatgaaacagaaaatacagcaaggctcagcaagcctagtcatggaagtgaacgtcctatcgcacaatcgatagtgtggttggtcatggaccttgggcgatcaacggtccatgtgtctccagatacgtcatgtgggtcgacttatctcccatctcgagtaacccgtgagtgcctagagcatctgtatacagatgcgtgcagaagaaggatctgacatactactctttgtgtcgtagatttccagatatcgttctatgaggcacatatatggtcacccggaattgttatgctagatctggggtcacgggggtctggcaagtaacttgcgtaaggatggatcgtcgagatcatgacaccctgtattgtattctcaaaaagcacgagatctcaatgaagacaatctcgtatgctagaagaggttgatccaggatatagctgtatgcattgaaggtaatccgctcttgaatgattcagtccatgatgcgtaatgtgctatcaattctcccggtgaaatatgccattaaccagttgcggataccaaacaggcttatatctaaggttgtcgagcctgtgggactggctatacgtgctgatcacgggacgtacggggcgccccgcctgggggttgaaacacctcagaatgtattgtatccattgaaccacgctacgaccagtagacggaacctggcaagctatagaaccaaagggtggaccatgttggacggctcaagcacgaa

SEQ ID NO: 587368 - DNA, 354 bp, Homo sapiens
  misc_feature (29)..(29): n is a, c, g, or t
  misc_feature (96)..(96): n is a, c, g, or t
tggatcctatccttaaattgggagctaancagaccctgggattctgtactgaatcttatacatgaataagtaatttactcttcataaagtcgcttnccccagctgggcgcagtggctcatggctgtaatcccaacactttggaaggctgaggcaggtggatcacctgaggtgaaaccccgtctctactaaaaataaaaaaaaagtagccaggcatggtggtgggtgcctgtaatcccggctactcgggaggctgaggcaggagaattgctcgaaaccaagaggcagaggtcgcagtgagctgagatggtgctattgcactccagcctgggcgacaaatgcaataactgcatcta

SEQ ID NO: 587369 - DNA, 871 bp, Homo sapiens
  misc_feature (567)..(567): n is a, c, g, or t
tagaaaaaaagaatcctaaaattcatatggaatctcaaaggacaatgatgaaatgatcttctacaaaggcaccaaggctatataagagagaaaagacagtctcttcagcgaatgatgttgggaaaaccgtgtatctatatccaaaagaatgaaattcaacccctaccttatgccatatacaaaacttaaaatggattaaagacctaaatgtaagatctaaaactataaaactcctaaaagaaaacacaggaaaaaatcttcatggcatcggatttggcaatgatttcttggatttgacactgaaagcacaagcaacaatagcaaaaacagacaaatcggactaatgtaacttgaaaacttctgcacagcaaataaaacaatcaacagagtgaaaaggtaacttatgaaataggagaaaatatttgccaactatatatcttataaggggtaaatatccagaatgcataaaaaactactaaaactcaacaagaaaaagaaaagcaaccaatttaaaaaatgggcaaaagacttgaatagatatttctccaaagaagatgtagaaatagncaacaagcctatgagaagaatgctaacatcagtaatcattagggaaatgcaaatcaaatccacagtaagatatcacctcacaccagttaagatggcccttgtcaaacatatcagaaaataacaagtgttggtgacggccatggagaaactaaggacaactgtacactattgggtgagaatgtcaaccagtacagaaatttctcaacacaactcacaataggattttcacatgacccagcatcccaactctagtacatacaaaaacacaaaacaaaaacacacacaacaccaacttcggcccccc

SEQ ID NO: 587370 - DNA, 624 bp, Homo sapiens
  misc_feature (417)..(417): n is a, c, g, or t
  misc_feature (432)..(432): n is a, c, g, or t
  misc_feature (451)..(451): n is a, c, g, or t
  misc_feature (466)..(466): n is a, c, g, or t
  misc_feature (470)..(470): n is a, c, g, or t
  misc_feature (479)..(479): n is a, c, g, or t
  misc_feature (496)..(496): n is a, c, g, or t
  misc_feature (499)..(499): n is a, c, g, or t
  misc_feature (502)..(502): n is a, c, g, or t
  misc_feature (504)..(504): n is a, c, g, or t
  misc_feature (516)..(517): n is a, c, g, or t
  misc_feature (521)..(521): n is a, c, g, or t
  misc_feature (525)..(525): n is a, c, g, or t
  misc_feature (527)..(528): n is a, c, g, or t
  misc_feature (537)..(537): n is a, c, g, or t
  misc_feature (539)..(539): n is a, c, g, or t
  misc_feature (550)..(550): n is a, c, g, or t
  misc_feature (552)..(552): n is a, c, g, or t
  misc_feature (554)..(554): n is a, c, g, or t
  misc_feature (558)..(558): n is a, c, g, or t
  misc_feature (560)..(560): n is a, c, g, or t
  misc_feature (563)..(563): n is a, c, g, or t
tcttccactgaggtcattgttgtcctcactcgaccctgagcctatcaacaactagaattctgtgcgatgcatgagtcggtgtaggttcaggacaacaagtgaccatcagatgggcaagaccagaggtcgaagttccagctttgttccgttttgaaagccactaggctcactgtgtgcttggcactgtgctctagggatgttacagcctggggctcactagaccctccccacacctctgaggaggtacctgtagtctctccattttataggtagaagaactatgctcagagcttgagtaatttacacatattcgagctggcagcaccaggtgtttgtcccaaggctgcctgcctcttgaccctgtgctcctgactaccacactgtcctgccagtgtgcctagaagaatgaagccacantcatattggcttttnttttttttgggaaagggantctcactctgtcgcngggntgaattgcnggggtgcaatctcggcncanggnantctcggcccccnnggtncatngnntctcttacntnagcctcttgantngntggncnccngggcttgcccaacaagcccagttaatttctgggtatttaagaagagaggggttcccccatt

SEQ ID NO: 587371 - DNA, 108 bp, Homo sapiens
gtgacccgggacgaggagtcgacccggaagcgaggaggtgaccagggaggaaatggcggcagtggggctcaccgtgactgtcacccacagcaatagaagcacgacctt

SEQ ID NO: 587372 - DNA, 698 bp, Homo sapiens
tatctgggcgcgttaaggcccaggttcccagagctaacgggcctgccaggttcaacacttgatgaagcgagagaaggatctatctgtcttctctgaaacctcccaagtgcttcacacgacatctacaggagcctgacacccacctgagactaccaccgtcgattcttccttttcgtggaccaccaccacctgtttgatcacacaggaatacattatgagtttcctcaaaccccctagccctataaaggctcctattgcacacattgtgacggcagacacccacaacgggctaaggctcgcagtataggaccgaatctgcagagggcgctactgaagatccagccttagccaacaccacctcattggatgaatgatacagggctcaacacagagaccacactctcattagtcagacaggatcttgcacaaagctttgagcatcttgtaggttgggctagcggcactcaatgatgaacttgtgctgtggtcaaacagcatgaagttactgcatcacgagagctataggagcctgtggtggtctccctgtccaagcgggaccgctttgctgtgccgcccgcctatcgaggcttgtgcttgatatgccattgttgcagcttaggccgaattatttgccgactggtctttctccacactcgccgtgtggattgcgaccctatgaccaaataagccactggtct

SEQ ID NO: 587373 - DNA, 558 bp, Homo sapiens
  misc_feature (351)..(351): n is a, c, g, or t
  misc_feature (366)..(366): n is a, c, g, or t
  misc_feature (385)..(385): n is a, c, g, or t
  misc_feature (400)..(400): n is a, c, g, or t
  misc_feature (404)..(404): n is a, c, g, or t
  misc_feature (413)..(413): n is a, c, g, or t
  misc_feature (430)..(430): n is a, c, g, or t
  misc_feature (433)..(433): n is a, c, g, or t
  misc_feature (436)..(436): n is a, c, g, or t
  misc_feature (438)..(438): n is a, c, g, or t
  misc_feature (450)..(451): n is a, c, g, or t
  misc_feature (455)..(455): n is a, c, g, or t
  misc_feature (459)..(459): n is a, c, g, or t
  misc_feature (461)..(462): n is a, c, g, or t
  misc_feature (471)..(471): n is a, c, g, or t
  misc_feature (473)..(473): n is a, c, g, or t
  misc_feature (484)..(484): n is a, c, g, or t
  misc_feature (486)..(486): n is a, c, g, or t
  misc_feature (488)..(488): n is a, c, g, or t
  misc_feature (492)..(492): n is a, c, g, or t
  misc_feature (494)..(494): n is a, c, g, or t
  misc_feature (497)..(497): n is a, c, g, or t
ataatcgtggggtgaagagtcgtgcagcgtaggacaataatgactccgtgccagatccagaggtatagtcatagctgtttctgctgtaaagccactaggctcactgtgtgcttggcactgtgctctagggatgttacagcctggggctcactagaccctccccacacctctgaggaggtacctgtagtctctccattttataggtagaagaactatgctcagagcttgagtaatttacacatattcgagctggcagcaccaggtgtttgtcccaaggctgcctgcctcttgaccctgtgctcctgactaccacactgtcctgccagtgtgcctagaagaatgaagccacantcatattggcttttnttttttttgggaaagggantctcactctgtcgcngggntgaattgcnggggtgcaatctcggcncanggnantctcggcccccnnggtncatngnntctcttacntnagcctcttgantngntggncnccngggcttgcccaacaagcccagttaatttctgggtatttaagaagagaggggttcccccatt

SEQ ID NO: 587374 - DNA, 844 bp, Homo sapiens
  misc_feature (654)..(654): n is a, c, g, or t
gcaccaatctcatgtcatgcgtccaccgtcacttgttcaagttccgacatgcgatccgggtgcttcagagtaatgtgccttggactcaatttctgtcatgattgtcgaatctgtatctgcgctgccttgtataagtccttttgtggaattttagaacgcccatcgttacgaaaaactatgtgatggtatcaacaaaatgttggatcgcatgcagcaacatatgagcacactgagttaagattgtgagcgtgatcatgattgtattgtgaaggatggagcgactgtctgaatttatgaaggaactaaagatagtaagttgttactaagggacttacatcattatttgcagaatagactttacccaattcagtagtcagacagtaagtgactttatttgaatggcttgtgttctttgaagataaacgcatgattgcctaaacagattctggtctaaatagcattacctaacagtggctaacgatgacgcatgcggaagatgaatatagtaggctataggggtagatgctacacacttgtacgtttatacaaatgatagaatcactagatgtctccagacctgaggactttttaatagggcaggtgcttgtgtcggtggcacgttggatatttctaacatgtacaaagctatgtatnttgatttactttcatttcttgctatgtatatgtactttttcttaaaatgccaagaactttctcttgctatcattgcctccttttgaaaccaattcaattttcatgtcctacagctgactggtttgttacgcattgagtccatcgacattcacgatttcaagtctgaaggtagtcaaccctcagaaaacag

SEQ ID NO: 587375 - DNA, 509 bp, Homo sapiens
tcgaggttctcgattgcattgtcttcctatataaagttgattagcacagagggaagaaagaagatagctatctgcaaaccaaggaaaggctcagaagaaactaatcctgctgacaccttcgccttggattttcgagcctcgtggaaatgtgaagaaataaatttctgctgtttaagccacccagtgtgtgatactttcttatgaaagccttagcaggccaggcacagtggcaggcgcctgtaatctcagctacttgggaggctgaggcaggatagtcgcttgaacctgggaagcaggggttgcagagaggcaagatgacgccgttgcagtccaatcagggcagcaagagtgaaactctgtcccccccaaaaaaaaaagaaagaaaatggggtggggtgcagtgactcacacctataatcccaccacttgggaaggccggggtggatgcatcacctgagttcagaagtttgagaccagcctgggcaacaaggtaagaccccatctctaca

SEQ ID NO: 587376 - DNA, 189 bp, Homo sapiens
ctcgataggcgaccatgaagaagtttagcagctggcaaagcgagctgcacagaaattggaacagtttgtctccatttcgttatggccagcattccactccctgacaaagccagttgacctggctgtgagtcgtctggcatctcccacacaagacccaggtagctgctaccttcttcggcccttatcgag

SEQ ID NO: 587377 - DNA, 559 bp, Homo sapiens
accgctgagtgtgcgttcttgagcagatcgcccagaagctcggcttgccgcaactggaagaacagcgctgggcccggcatccgttggtgtacctgatggaggcggccgacgatatctgctacgcgttgatcgacctcgaagacggactggaaatggagctgctggaatacgccgaggtcgagtccctgctgctggacctggtgggcgatgatttaccgcaaacctaccggcagctcggcccgcaggattcccggcgacgcaaactggcgatactgcggggcaaggccatcgaacacctgaccaacgctgctgcccgggcgtacgtcgaacaacaggaagcgttgctggccggcaccctgccgggggacctggtggaacatatgcacggccccgccaagcgttgcgtaactggatgccaaggacattggcgcgcaagaagatcttccaggacaagcgcaagacccttgcttgaaatcggcggctacaccaccctggaaatcctcttgaacgccttctgcggcgcggacctgaaacagcatggcggtcgcacccccgtcgt

SEQ ID NO: 587378 - DNA, 389 bp, Homo sapiens
taggataccccccagccttactgccggtggtgcaggcagaattcatgaattcatcgttcaacaaggcgagttacagcagaggctccgggagatgggcacaatgtccgaatcccacagacagacggcaggggactggcagagaaagcccatctctgcacggaggcccgggtaggagggggtggtggggccggttcgccaagatgaaggctttccccttctactgtccccagggtggagatcctgggtagggtggcccaatccctaggccagagctgtttggtccatagtcaagctcccagagcttggcatctgtggctctggccagcagggcctggggcccagcttttaaggcatcagaaggggagggggctgcggcagggaccccgggc

SEQ ID NO: 587379 - DNA, 365 bp, Homo sapiens
ttgcgcaagaaagttgtgcccgtgcgccaggatctgtcccactcccgggcggtgttgtcccaataccaggcccagcagggggccttgtgaggttgccccacttccccacgggggggagttttccccccccttgttaaaaataacgccctgttcccttcttgccttgtggcccaggggcgggccaattggggcccccaggggggttttaatgcaaataaatccttttttttttttaaaaaaaaggggcccccccccctcccttggggggggggggggggttttttgtgggggtcccgggcaggtaagggcccctttcctccccccgccccggttaaccggttcttgaataatttttgggaccccca

SEQ ID NO: 587380 - DNA, 695 bp, Homo sapiens
  misc_feature (423)..(423): n is a, c, g, or t
  misc_feature (539)..(539): n is a, c, g, or t
  misc_feature (679)..(679): n is a, c, g, or t
agctttaagatttaatgactacctgctgggtttcagacttgcatgggtccagtagcccctttcttttggccaatttctcacttttggaatgggagtgtttacccaattcctgtacccccaatgtatgttggaagtaactaactgtttttttattttgtaagctcacaggtgggagagacttgccttgtctcaggttgagactctggactttggacttttgaattaatgctggaatgagttaagactttgagggactgttgggaagatataactgtattttgcagtatgagaaggacatgagatttgggagacaccagaggtggaataatatgatttggatctgcacccccaccaaaatctcatgttcaattgtaatcctaaattttggaggttgagcctggtggaagaggattggataatggngggtggtttctcatggtttaacaccatccccctgggtgctgttctcgtgacagtgagtgagttattgtgagatctgattgtttgcttgcctccccttcaccttttgtcatgattgnaagtgttctgaggcctccccagccatgcttcctgtacagcctgcagaactgtgagccaattaaacctcttttgtgtatatattacccagtctcgggcttttctttatagcagggcaagaatagactaatacaggtttcanctcagcatgaggattt

SEQ ID NO: 587381 - DNA, 293 bp, Homo sapiens
ctccctgtcactagtggcaggttctgttgatgtgtgacaacttcttagagggccgagaatcttggcacagtggaaatataagttgtagtaacctctttgcaaacagttcacggacatgttgctaagaagcagggagacaaagccccctggcggttgtggttattcttctgagatttctggcagtgtgggatgggtgaatgaagtggaatgtgaactttgggcaaattcaatgggacagccttccatgttcatctgtctacctcttaactgaataaaaagcctacagtttttag

SEQ ID NO: 587382 - DNA, 176 bp, Homo sapiens
ctcggtcctgtatgagcctgctgagtatgttttttcttgttttatttaaaaacaagtgcagtattgagaagggaaaagagtagaacaaggggtttggcctgtaactgactgaacacatcaggtgatataactcactacctttggaccagccttgtgttgttttcttttaatcgagc

SEQ ID NO: 587383 - DNA, 420 bp, Homo sapiens
gcataaatctgcctcccagttgtctcagaatctgtaagagttgccagacaaagcagaagctccatagagctccattatactgtccgaatagagctgccgaggcttaaatagctagtctagcaccaggaagtttcatccttatagttagagtttgggtctggacaggcaagggttcaagaaggctccgataaaccgtgctcaatgtggcctacacgtgtttctggcaggttgaatcccaggccctccaggctcagaccttaggtgatagcttggcccccgatagatagcagggacatcttggtggaaatgctcacagacgagactaagatgtcagcgtgtgtgtatcctcacagctctttatacagacgcatcacaagtttggtaatggcgggtgtgactttgttgtagacatcgactgat

SEQ ID NO: 587384 - DNA, 719 bp, Homo sapiens
ctcagagctccagcgactgtacccgaatggggtcccctttaaggtgataatgctgctccatgaattaaacacacctttggcggatgtgaagggagtggggatacacatgctccccagacacctctccattctgaggggaagccgctgcggctccctgggggaccccatgtctgatgccctccaggaggataatgtctgaagctcgggctgggaatgggagcggagaggcccgagaagcgagacggcagcaggcaagggccctcatgctggcaccctggagacggtctcggctgcggggcccctgctcttctagatcctccccagcttttcgaggacactcttgtacaacccatggggtccctgcagaagtggctcccgggcgtgtcccccctaagtctccatgaaagcgtatctgggtagaggtgggaggcagtgcatgtgtagctcggcgaaatgctagagatggcacaaggggaccagactgttgggacctcaaagagacgactgaggtaagagcctggccccaatgggctaaggtgccaccaccagagcccactggaggcgtgtcgaggtactacaaggtgggtgcgggttaggtgccgcgctgagggcgtgctccgggaggcgagcatgtgtcacccagtggcctcaggacaatcagcattgagttcatgaacgcggggggttgtttaaagggcattcgtgccactagccggggg

SEQ ID NO: 587385 - DNA, 1316 bp, Homo sapiens
taaaaattttaaaacccctgttccccggttttttttctgggaaaaggggtaaagggagaaaagggagaaaatatattctcccttgtaatatttggaggggcgacctcataacgggagaaccaacccttttcggcgcctctctatagggtcccctctgtgtctctccacatagggagaattgctagaaatctctccgtgggtggggagatctctcaaagagagtttaatttttctctcccctacgagcaagagaactcaaaaatttctcaagcgtgggaatataaaaaaatataaaaacacaaactctcaatatagaccccagagtgggggtgtttaaacacaaaaaaaaagaggcgccacactctctctttataaacatgtgcaaatttttacacatatataaaaatatgtgtttaatcataaatctcatataaatagtgtgtgtttcccctctctttgatatttcaaatattttctctcccctccccataagagggagacccctaaaaaccgcgtaagaaaacagttgttaacatttaatataacaaaaatatttaacactcccagccccaccgttgtgtaaagaggtggaattgcgtgattaacatagtggggacaatacacctcgaggggtgtgtcccccccagggggcatgttgcgacagcacggaaaaaataagcgctaccccagggggcaaaagagggggttaacaatggcgagatgtgccccccacagcaccaaaaacacacacacaaagaccggggcgacacgggggcaccaccagaaacatacttgtggcaccaccaccgggtttcaccgtgtccgacaagtcttccccgacccaaccagttgccacgggtgacaatttcgttgagacacaccaaagtttcacataccgaagtaattcccgagttggtcgcacgagccccctattgtgctctgctcacacaccaggcataatatagttcccccatagaaaacctcggcacccacaccagcaacctatcggggggtggggaccccacgcagaagcgcgaacccaccctggtctcggaagggcgacaacactactcatgtacaaacaagaggctggcacctccctggcacagctctctaacaccacggggacggcgttctgaacacagaggtgctaccccccgtggtccgtgtttgcacaacttttggtgcaaaaatatttgtgtcttctagctcgaggtggttactgatcacggcgatacgcagttcaccacgagcgttttatgatgaacagcgccagacgcagcatgcatacaggcacacgttatacgtcaacgaac

SEQ ID NO: 587386 - DNA, 191 bp, Homo sapiens
gaaggacaccagttaggctatttctattcctccctgttctttgtactaccgtgtgcgctgtagtcccagctactcgggaggctgagacaggagaactgcttgaacatagaaggcggaggttgcagtgacgccgtgatcacaccacgtgccctccagcctggtgcgacagagtgtagactctgtctcagcag

SEQ ID NO: 587387 - DNA, 134 bp, Homo sapiens
tgggcgatctacacttagagagcttgagcgctatgtccatttcctgcctacggtaagaaaccccgtgaagccctacaccattaaggaagcctgtgggaaagacaaaggaggaactggcagatgtgttgcttggt

SEQ ID NO: 587388 - DNA, 328 bp, Homo sapiens
agctgggattacaggcattgtccaccacacctggctaatttttgtatttttagtagtagacgtggatttcgtccattgttggcctaggctgttctcgaactcctgacctcaagcgatatacccaccttgacctcccaaagtgctaggattacaggcatgatccactgcacctggccctcatgatgtctttgctaaaatagattcgtgtccttgagcttctaagcctctatgaacagttagacctcactgtgggtgcagatagtgagatgatgcccactgctgatagaccgactttccagagggagtaccttggcaaaagatccacagt

SEQ ID NO: 587389 - DNA, 646 bp, Homo sapiens
cagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctaaacccggggcctcaaggctcatggggtagtacccagcctgctccccgagtccagcgaccctgtgacaccggtctgcaaggagttggggactaagggcttccagagagtggctggaagagactccaagcccctggggagactgtactgttcctgaaaactggccttggccacactggggattcggaaagaaagagggaaagtcccctgcttcctggttggcattctccaacatcactggacctaaattggagcttgcctttggcccttggatgctggtgcccacatactcaaggtctaaaagaagaaacgccttttcttaggcccattacaaaatggacccctttagaaggggatggtagacacaaggaacgcccctgcctaaaaggaaggcctggggggggg

SEQ ID NO: 587390 - DNA, 174 bp, Homo sapiens
cgagcttggacccccttctacgtatgatcactgctactagtgcgtcagacctagaccacttggttccaagggttgtgacaaattttgttaggaccaggattcaaacccaggtcgcctgattccaaccccatgcttttccacagtcctacttgaggcagaaaagaaagcagcacg

SEQ ID NO: 587391 - DNA, 1236 bp, Homo sapiens
  misc_feature (468)..(468): n is a, c, g, or t
gctcaaaaaaaaaaaaagatgctacccagttttttccattaagccctcggctgattgagggaaaccccagtgactgtctgaccctgctacgggttaacttcacccttatggacctctcggcgccaccttcgtgggctattggttaacccagcatcgtgggggctttccttccaatgccccgtgatcattccggtcacttgtcccccgcgctgtatctcccaggagcgcagctttcacccttggtggggtagcggcctggtgaggcacccgcgagtgcgagacgtactggccgtccaagcgacactcttggttgctaattgtcacagggggacaaccaaaacatgtgtccattgtatatctaataactagtgaggactatatttttctaccctacaaacaggccacctggctctggtttctccatctcctttcccttacaagtcgcaagtgggtctccatagattctgngagaatagacactataatacgcagcgtggcgtgcgtgaaagtgtgtcatacacccgggaaaacgtttcttcccaatcttaaattattgagcaggcagactattaagcctgagtgtgtacttaactatgcgcaagatatacaacaaaaaataaataaaatatatatactatccacgagagaggcgcaattccttagtgtgcgcgagtattgtcgcgcgtcgcagagagagtaagagcgcgtgacaaagtcgtagcagattttcgtgccgcacaactagtcgcgtggtcccacatacaaccacgtcgttgccgtatctctccgcctgtgaatcgacgccaccactctcgttgtgtctcttgttgtcgtcacctcacctagggccgtgggtcgccaggcttccttcgcgcgcgcggtggtatccttcacctcttgtttaggggagggggggcctcgccctatgatcctaacatcttggcccgtcgtattggacacgccaagttggtggtgttaatcatccacacgtcttcaggattttttgaacgacaccttatctgcagctgcgcacacacgcacacactgtggcgcggccttgtccggtgcactttcggggcacacattctaaccggtcccctctggcggcacaccaccccctttggagctagcgggggggggagagccattcgccaatttgtcgggcggcaacgtacggggcccctccgcggggcgagagtgctctctccccctgtgcgagacccccaccccccagcg

SEQ ID NO: 587392 - DNA, 819 bp, Homo sapiens
  misc_feature (341)..(341): n is a, c, g, or t
  misc_feature (749)..(749): n is a, c, g, or t
tggacggatgagtctttaaataaaaaaacacacgtgcaccagttatcaacacacatctctcgcaatcctgacaagcgctgaacttcagtccttcacctggggggggtggccgtgttacactctcccacgaccagcggcatgtggttcctcttttctcattatgtgggcctcaaggggctcaacgtgctctccgtggccggctttcatgtgtttcctcctgtgtgtggcatcttttttctcacttctcggagtggacaaacagcggccctcgagcgtgaaggcgtggtggagtctcaagtgtgcgagttgttggccttatagatgtggaaaatctcacacanagagtgtgtctcctctcacatatatagcgcacgaggaagaggtgtgtgtggtgccatctctcgaggggcccaacaaatctcgcgaggtactcgtggtctcgtggcgcgtggtgccccacattcagcccaagagtattcacatctcacaccacatgtggcagaagagaggacatgtggcgagaaacatcgtggagtgagtgagggtgtgtcagagagacatctccctctcagacatcaacaggagaactgtgagaagtgtgtggcggctccatacttactcgtgtggccaccagaggttacaaagtgagagctctacaagcgggaccgagaagagcgcggcggggggggagaaacaccttgcgacagcgcgggcattaagacacctaagaaaaccacatcgcgggaacncaaaagcgaagtgtttcgagaaaacaccttgtgggggacacacccggggggttggcccccggaaggccaa

SEQ ID NO: 587393 - DNA, 1468 bp, Homo sapiens
  misc_feature (307)..(307): n is a, c, g, or t
ctaagaagctaggcacacaagttaatcaaacgcgttcaagctcgacacccactaccctaaaaaaatccgcagaacactagtagagctcgagactccgtgccacgacccaagtatgtgcacccagaatcgtgatcgacccctagtaggatagcagacgtcacagtgctgtgaggtcactaagctataccacctgcacaacaccaattctccgtcgcgccactagagcgctagcgatcaagtactttagaatacgagctgacatcttgcaccacatcttaccaggccgcgagaatactcatagcatacntacaagcgcaagtcaatggatcatttgagtgtatacccatcagcatgagtacagacacctcagatcgacatgtgcacactgtgctacacctaagcggagacacggcttaccacagagggagagactaatacacgtgataccgtacgagccatacagtactgtagccccgagcgctgattactagctcgacagagagaaccagtctagcactactttagaccattaccagccccaagttgaattcatgaacgttgctaacacaggcccctggcccctcagggtagaacgagggaatgatgttacatcgagtgcccccgtcgtggtaacacacctttagaacccgaatagtccaagaagagttaaggaccactaaactggcaccgttaggtttgcgcttttcaaactatgaggacgcgcagcgcgtggctaacttgcaaaattggggccctgcccgacccgagatgcggcggtttcccatgggcgtttgggtacttccgtttgagctctatatgaggaccactacgggtcggaccaaactatggaaaccctggtcgcacggctagggaccaggcagagcccggtgcgaattggagctagcaccgaccgaacggaacctgcaagtacatgccaacacgccttgaattgtgacagtggccatgatcgacagagtgctcctagtttgaagatcgcctaagaaaaccagaggtgaaccccattaaatcgaaaaaaccaccgagcgaagtggttccccttaagggaagttggacccaacaaatcccgtgaccattttttaaacataaaactctttgtcgggggattgggagggggtctggcacccctttcggtgtcacggcgaagaaacgagcgcccataatgccccatttcccggatagggtcactgttgtaacacgtttgcccttagcagagaatgcctttccatgcccacagcgactgcaaaagagagccgggaaaaacggttaaccttattttcctgtcgaatttcggcatacccacaaatttaacttcggggagccccccccgggcgatatcccacgtgtttaccccccttccgcgcggtgtagtccagtcgcgccaaaatctcgcctaatatctctcaggagggtccacaatattcaacacgaagatgggggggatacaacg

SEQ ID NO: 587394 - DNA, 246 bp, Homo sapiens
ctaaacctatgtcactgtggccctgttttgatagcgccatactatgcaaatcacgtgaatctgagtgtatgcgagggtaatagcgaatcactatcatagcagctcggtaagaaactatcggagacctggacttgcgaatggtttctaagctatcttgtgaggccaagctctcaacctgtgaagcaagtcattccaggcagttagtatccaaattgagttaaattgcacaatacccggagtccacag

SEQ ID NO: 587395 - DNA, 370 bp, Homo sapiens
ttcgcgcaggcgacggcggtcaaggcgcctgacgtgctggtgaaggacgtgaccgaagaggtgctcaccacgctgcgtaccgatccggccatcaaggcaggcgacgcgaacaagaccgctgaactggtggaaacgccgcgtgtgccgcatttcaacttcacccgcatgaaccgctggcgcttggcaaggaatggcgcgccaccacgccggaacagaagaagcagctgaccgacgagttccgtaccctgctggtgcgcacctattcgaacgcgctgaccagatacaagagccagaccatcgagtacaagccgttcaagatggcgatgccgataccgacatgaccgtgcgcacccagatcaatcagcccaac

SEQ ID NO: 587396 - DNA, 130 bp, Homo sapiens
actagtcacggtttggctcccgctgagatcccagcacgtggggaggctgaggcaagaggattgcttgaactcaggactttgaggctgcagtgagctatgactgcaccactgcagccaaccgtggactagt

SEQ ID NO: 587397 - DNA, 154 bp, Homo sapiens
taacggtagatccagctggtgtgaccaggagtggcaatgttgctgacctcgccgttcctaaagccctctgcagttagtagtgtgacatcgtctacctcctttcaaaaggagcacgtaggactgtgctgctggccggctcctctttgatggctca

SEQ ID NO: 587398 - DNA, 1281 bp, Homo sapiens
tggaaagggagtcttgccctgttatggggggaactcacccccagttatttcaatgtaggtcctttctattttccgaaagtgtcggccggttgaaaaataatgggacacagtataacagagagcgaattgttacacgttgggcgccaccaggggtgacaatcactttttcagtaggacctgtggatgcccatcactgagcctcaaaccagcaagttttttattaaagggtgtttcaaaaggggaggggggttgtaaaaacaaggggatgtagtgtcacaagagatccactatggctctcaagagggcaaaagagccagcactctacataatagagggtctaacacaagatatccactatactttgggagggcaaccaggaacaagagggcaccaaagccagaaatctcacgtgatcaagggggtctatgctcacaggcgggtgccccgttatggatcctctgattaaagcactctttattctttacagcgaagagaacaccaggcgttgtgggacaagcgagcagaaaacgcggtcgtgacccagagaattttaaccagggattgggacagtttttctcccccacatcatagtataagaccatgaggggataacatgcgaggaacaaaccaagggggcgtatctcttacagtaccctttaaatctccaacggccggagtataaacacagagaccttttccccaacagaggcgcattgtctatataaagaacccttccacccccagagaaacgtgcaattcaccttttccccccaaggggtaatttaacatcatcacaactaatacccttatgcctacagagaaaaaaagacatatttaacggacgaataattctccccccaataactgtagacaacagctcagtggtttaacaaatcagagccgatcacttctggtcataagcaacggtcacaaacaacatgacggcggcatccctaattgtgtcgcccaaaacccccccaaagtgaccaggagcaaagaaccccatttaagtggagtatgtataatccaccctgttgtttccgctctaaaagacatcaaccgtgtttacacctctggtgtaccttattcacaagagggggcacagtgggtttcaccatatagtcgtgaccaaagacacagtgttttcagcacaccacacactgtgctacacagagtatacaaccacaaagtgattacgacgagtcgacccggtccaacagagaagttacaaattcctagaggagttattaggaaacataaccagggatatacaaacattgc

SEQ ID NO: 587399 - DNA, 230 bp, Homo sapiens
agtgatcaccctatttgacatgatgagaacattgaggcacagtgcacatgactattatactgttattttgtaaaaaaaaaaaaaaacaaaaaagttccatatacccatttgtgtgattgaagccacagccaaaatttggggatttcccaaccacaatccatagttgtttaccactcaaaataagtcatgccttgttgataagcccgtgaaaggttcagcagggggagata

SEQ ID NO: 587400 - DNA, 762 bp, Homo sapiens
agcatcttcggcaacgtgtctggccatcatccagcggcgtgtactcgtggcacagccccggtaccacacacagatgctgcgcgtgctgcagggagttcatccgcttccaccagatccccaatcccctggcgccagcgcctcgaggagtacattccagcacgccgggtcctacaccaacggcaatcgacatgaacgcggctgctgaagggcattcccgtgagtgcctgccaggcgtgacatctgcctggcgagctgaacggcattcactgctgcagcacgtgcaagacccttccgaggggccagcaagggctgccttcgggcccatggccatgaagttcaagaccacacatgcaccgtcaggggacacacgtgcgtgctttgcattgtggtgaccatgctcacccgacctgtacttcagtctccctggggctccatctgagatccatgctgtgggcgacgtcgatcggtgtgccatcccttgggggaaagaattgacatctttggggaagccttcttgaaacctgtcttgcaatggccttggcaaagatcggagcgggggatcgtgcgggccctcacctacttgggacctacacaagatccatcgcgtgaagaccttgctggagcgtgcttggacatgtaccctgagttctccgagcacgttcttggtccattgcatggaggatcatccttccgacctgctagataaccgagcgtgatcccggggctcccccgggctagtacggacgttgagagcggtgcctc

SEQ ID NO: 587401 - DNA, 1245 bp, Homo sapiens
  misc_feature (716)..(716): n is a, c, g, or t
ggggcgaacgcgtagagcacgcctttagattgacctcgggtcacgcctatgacgcagctagcagggtagtggcggtcagctgcctgcccggccccaaatgctacatgttgcccctctacacgccatgggaatccttctagctgcctcttcactcgctagtccgctctgacgagatcgatccctgcttcgtggtacgtttcgtagtcgtcacgtataagacgacatatgagatcgaagtcctatcagtgggacgagtggtctagctgttgggcgatgcgttgtatgaccaagattcccccccctgcggggatgaagaactatcagagcgagttctcggtcatgccgcgttgtggtacatccgctggatccagggatccctagcaaacattgtactgggcgtagatatgcggggaggagcattgtaccaacgctgcagagggtctgctaaccaccagctgctcaccagagcaccacttggcggtgccacggccaatcgtcgcccagacgccccaggtccaagtccacgaactcaatgcaacggggtgtggatggagcacctctgcgcgccacagtcaccacggtgactgaacgcgtgacgcgacatgataacacagcaggtctatggcacctggacctctgacacgttggtcacaagatgtgccctgtctagtccccaagcggaggatctctgcggctggatgatgggagaagaaagnccaactggtttccacccaggcaagaagaaaggcctcaaaaaagacctctactgtccttaccgcgggcgacgtggggcacccttcccgtaccggggggttggtggtccttctcccaattacttaacaacgtccaagggaactccaggccgctccggggattaaaagaagccaaggggtttggtggcaaagccaagaggggaaaacaggtcatttacttccattggcttccccgttggaattggccggtggagcgcggccttccttggcagacagaggcgcggtctctatagcaaccggccggggacacgaaggccgtccttcacccttggtttcttcccgcgcgggctacacccttgacatgtttgtctgtactcggggcccggggcgggaggcccccccctgtcttcgcccccggggggcctccttcagacgggggtgccgggcgcccggaagggaatttggcttgggcaaaccggttaccgccgcccttggctacaagtacatacgagcgggggggggcgcccgcacc

SEQ ID NO: 587402 - DNA, 1079 bp, Homo sapiens
gagaaaactgtcgacattactctgaagggacgcactagattatcgtgaagggccccagtaggaaccctgtggtaaggagtgtcaagtcacatcaatgtacgaactcagccttctctgtggatagcgaagagaagaatacgaggctccgggtctgacaaactggtgcgcggtaacaagaatagggaacgttgtgacttgaccagtgccgtgcacgtattaagtcaggatactatcgtacgagagacatagatcagagggttgttacacttggagctgccgtatacaaggatgaaggtctgtgtactagctacacattgctccccatgcaagcgcttgattactccagagacgaagtaggagtctctgtagctttgaaattcccgaaaatcttactgtgcggttgacatagaataccctatccggcacggtggcttgcggattgaggaccaagcgtgtgagcgtttgttccagtaatcatcaaagcgcgcgagcacacagcatgcaattacaatcctttgcaagcgcaagattgcacgatatgcagcatatgtgtttcgaagattcgcagcgggcgttctgattccaagtcataggcgcaaaaaccgaggttaaaaaacaaggaatatcacggacaatctttgggactggtcatctatgtctctgacaaacaggaactggttcaggcaggcttgatgcaatcaacgatctaacgagttaccttggctaccagaaagaagatgccagatgacacttaagaccgtactttgtgaattatttagaatgcatgcgagtaacaaggacgctattgagttagggacgcattctttcgtttagaaaagaacaaaaaaaaaaaaaagttcaaaggcaatttaattgtgagggttggcggcaacacacggacggtaactggcaaatggcgcgcaacgaggtgcacatacactggtatcataggaaccccagagtttcactggacccacacaggggggtaaacacctcggccggagataccacgataaggagagagcagaatcacttcccagaaacgcgcaggtacacctgggattaaagaagggggcaac

SEQ ID NO: 587403 - DNA, 375 bp, Homo sapiens
tttttttgaagacggaatgtcactctgtcaccccaggctggagtgcagtggtgtgatctctgctcactacaacctctgcctctcgggagttcaagtgattctcctacctcaggcccctgagtagctgggattacaggcgtatgccaccatgaccagctaatttttgtattttcagtggagacagggtttcaccatgtttgccaggctggtctcaaactcctgacctcaagtgatccgccctcctcgtcctcccaaagtactgggattacaggcgtgagccaccatgccccgcctatccctggagctcttatttcaagaatacactagattctatagccagaaatggttaagttctaatatgcaaactggatctat

SEQ ID NO: 587404 - DNA, 205 bp, Homo sapiens
aaacggcactacactcccatctatcctccctctacccctcagacgagggctgctcttccaagcatcaaccctccagccccttctacgcacgtctccatttcttcacgctggttcccatgtttatgccctgttctactgttttcctttttccgtgttaaggctgctctgctcggctggctactagcggccggctactgcacggcta

SEQ ID NO: 587405 - DNA, 803 bp, Homo sapiens
  misc_feature (6)..(6): n is a, c, g, or t
cttatnatgcaccacaagaacatctcagacacctgaccagctggcaataaagaatgctggcaagcaggaccccaaacgtcatttggaggaacatgtggatgtacttatgacctcaaatattgagcagtgcttagcagctatgaaggatactgacccatttaaataaagcagagaaaaacgctattaatgatgccttcactgaatattcctctgttgatcctatgctcataatcaagggacctctgaaggagaacttggataaaagtaaaacatttgaaataattagacaaattgatacaactaaaaaatcagacgtaaatctactaatattaatctaaaacatgaactctgaaaatagtaaagcaacacctgactatctcctttctcacacaacgctgctcacacaccccccccacgctaaatcacacctgaccttctcacaagcccccctccttggaaccctcttctcctccctctttcacgccatccctgacaatacagacaccacgcaccatgacgaagtatttaatgttattacggcaaactctattagccagtttatgaaacttccatcaccctacacccaccacttggtgtcactcatctaccgcaatcgtctcacgcactaccccgtcacccctaccgaccttgtgcagtactcttacgatcttagatctagatgataacaaaaaatacctcctattcctccacactattaaccccacaattttccacaggccccactccacctcctccatcccacacactaatcactacacccctactactggctatcctagtcg

SEQ ID NO: 587406 - DNA, 920 bp, Homo sapiens
  misc_feature (24)..(24): n is a, c, g, or t
cgaatatgcgcgtgtctactgaangtgaccatgataagacatcgtgtatgcgctttgtgaaatccctgtggcctaatcttcctggaaaaggtgtttttgccacaagggggtttttttaacgcacaggcctggggcgcaagacaaatggtgcctccattaggcaaaagtgcgtcctggattccaaaggagtgtggaaaccccctgtcctctattgttggtcccccgggtccgtccaatgggactccaaggggctttaatattcacaggaaagcgaaggggaaaaaacaccccccccctcggggttcggtaaaagggaaaagccatttccgggggccaaaaacacagattggcagggctagggccgacccaagggcaccaccatgggactcgggcgccacctgcggcccctggatttacaaacgcccagtcgacagacgaccccgccgccagagatggccctcgcgcgttgccctcaccccagggtcctaataacatcggcatagggacgccacctagacttgtggagccccgccagtccgatagcatgcctatgtagcaatacaaggatgtaaccagacagtttgtgttgccccggggatataaaaacaggagtcacccgcggtacaggcccacctcacaagtgccaccccgctcagcgagagaagggtagaagatttttctctgtatgatcctaatctgttttcttatgtttaaatgccgcccacgagaagttttcccattgaagatcatgaccttgtactttctgcgtcgattgtcttccagcaggctcccaaaatatcctacatagggaggaatagatcgccccaaatcactgccgcctgtggaaacaatgagagaacattagtacccaaccttcatccaaaaaaaaatattaccaattaaaaacccccaacatgaca

SEQ ID NO: 587407 - DNA, 999 bp, Homo sapiens
  misc_feature (714)..(714): n is a, c, g, or t
gggttgtccgcgtagcggggtgggtacgtcgtgttgttgtcggtcggtggaggcttgtgtgggtgagtaagtgctggtcgtcggttgggtggatggtttggtgcgtctgggtgggtgggtggtgtaggagggtggcggtgtgtgatgtggtgtgtgtcgggggcggtctacgctgggggtgtgtagtaggtcggtggttgtgttggaagaaggcgtgtgggtcggtgtcaaagcatgtcgcgttacgccgtcttcgggggacgccctctcgcgcctttcgggtgttcgcacccccccgcgatgggttttaccccccctcatatggccccttctgttccccgccacgccgaatatgccggtgggctccccggaagtcccttgggcgggggaacccggccccgcaaatctttctgggttggcgagagccctttttcgaatgttttccgttggtctgtgtttccccgagaataatttctccccggattctcgccccatttctggcgccgggtacgacgacggggtccacgcccgctggggaatgttgttccccccgacagcgcccggctatggaaataggctctgtctttataagagaaggagtaatatagggagacaggaccaatatcgtttttcaaagagcggcacactgcgtcaagtatctcgtgtggaattgccccaagaatatcgcgcggagtgtttacaaggtccgggaangaaggaggactcaccgtgtggtgatataaaatagaatgatttgacacaccacaccagttgtggccaaaaaaatcgttaaatattgagagagaaaggcatctctgtctctccttggtacaaagagagtgtccaggctggtaaagtgataaacacgaccaaggatgcactcggggaatttttgaaacagaacaaataaatgtcaacacccctttttttttttaaaaaaaaaaaagttccaaaaggggacacaaaaaacccggtgctggaaaaattgaaaaaaaaaaa

SEQ ID NO: 587408 - DNA, 142 bp, Homo sapiens
acgtgcaggacagtgtgagagggatgtcccacttcacaatataacagcaatgaccagagatccaatagaggtcttctcatgttctctacccatcttcatagtgagtccagttggtcctagagtgcaggcatctggaatctgg

SEQ ID NO: 587409 - DNA, 299 bp, Homo sapiens
  misc_feature (66)..(66): n is a, c, g, or t
  misc_feature (82)..(82): n is a, c, g, or t
  misc_feature (113)..(113): n is a, c, g, or t
  misc_feature (136)..(137): n is a, c, g, or t
  misc_feature (145)..(145): n is a, c, g, or t
  misc_feature (147)..(147): n is a, c, g, or t
  misc_feature (189)..(189): n is a, c, g, or t
  misc_feature (199)..(199): n is a, c, g, or t
  misc_feature (217)..(217): n is a, c, g, or t
  misc_feature (222)..(223): n is a, c, g, or t
  misc_feature (237)..(237): n is a, c, g, or t
  misc_feature (283)..(283): n is a, c, g, or t
  misc_feature (293)..(293): n is a, c, g, or t
  misc_feature (298)..(298): n is a, c, g, or t
ggaagaggctgtttcggggtgggaaagggttgcttttcctttggggttaaggctgtgcagcacgtnttacagcagtcctggnacagggctgtttttatattcttgtgaatganactgctcttgctaaatgattttnntttttttngngggggggtgcactttcattttcaattgactttattaaatggnaatccaaatnttccactcctccccctcnggtgnncctccccaccacanaccttccttcttgtccttgtgttgaagagggtatcttggggaatgngtttattatnttctnc

SEQ ID NO: 587410 - DNA, 201 bp, Homo sapiens
atcatgtcgcgcacagccagcatgagcctgattcaggcgcctagttacggttcagacccccagccactccttactcggggcctctccccagtccatggtatagttgggcaacagtgaccggaagaagagagcaatggtgttttcatggctgataggacttagctctctcgcctgacgtaggagtagattgtgtccgaaggg

SEQ ID NO: 587411 - DNA, 368 bp, Homo sapiens
tggcagtttctttctttcagcactttgaatatttcaatccatcaccatgtggcctctgttttttctgataaaaatattctattattcttattgggaattccttggacaaaatgagttgcttctcttttgtttcttttgagattcttcctttgcctttgtcttatggcagtgtgcttatcatgtttctatgaatgtatctctttgtgtttaccatacttggagctcaaagcacttcttgggtctgaaaatggatgtgttttgaaattaaattagcttgtgtgaatcctgaaaaaaaaaaatcccatgaagctatgaaaccaactatctgtatggttcctagagacttcacacttttattctactttaaa

SEQ ID NO: 587412 - DNA, 296 bp, Homo sapiens
  misc_feature (50)..(50): n is a, c, g, or t
  misc_feature (93)..(93): n is a, c, g, or t
caatctcaagtacaatatatacaccaacaaacaatgttcaaccagtaacnactactaatcaacgcccataatcatacaaagcccccgcaccantaggatcctcccgaatcaaccctgacccctctccttcataaattattcagcttcctacactcgcgagggggttctcacacacgacaccatgataatcgttgacccagcagcaccaatccaaccttgctcgttaactccagagaaacacttactcaagacctcgacgcaagacccccagtgcttcagtatactactcgacagaa

SEQ ID NO: 587413 - DNA, 145 bp, Homo sapiens
ctcagactgaactcactaagcagggggtgaagaccaccaggcatggtagcagtgctggccattggaggaaatgtcttggccaggcttctgagaaccttaacacgccactgggtcctttgtcacagtgacaagaaggagtgtggct

SEQ ID NO: 587414 - DNA, 295 bp, Homo sapiens
  misc_feature (50)..(50): n is a, c, g, or t
  misc_feature (93)..(93): n is a, c, g, or t
caatctcaagtacaatatatacaccaacaaacaatgttcaaccagtaacnactactaatcaacgcccataatcatacaaagcccccgcaccantaggatcctcccgaatcaaccctgacccctctccttcataaattattcagcttcctacactattaagtttaccacaccaccaccccatcatactctgtcaccacagcaccatctactcatcgctacccactaaacactcacagactcaccctgaccccatgctcaggtactctcatagcatcgctgtgtatatcagcaccat

SEQ ID NO: 587415 - DNA, 413 bp, Homo sapiens
gacagagaaatactgggtagaagagggcagttccctggcaaaggtcccaatttcaagcctggaaacctctggccctaactgagaacatgcattcctgttttcacacacaaaagttgccttttggctctccacacgcccctctcctgtactcatataaatctgagacctcaggttccagaagcagatgaaaaggagatgaacagaagagcagaagaatggcataatggtgtggcagagagatgagaaggagagtctgaacaccaagaggagttcagctgggggcgattggagaggagatcagccactggatggctgaactccaggaagaccatcttcccattccgtctcctttccagctccccatgcatcccatccccaccactcaataaaacccccacattcaccatcaaaaa

SEQ ID NO: 587416 - DNA, 205 bp, Homo sapiens
acagagcaaaagaaacggcagcagaaaagaaggaatacaggctacaagtcagtaggaggcaccatatacagcctagcgggactagggtaggggagcaaacaggccagcggtggaggtctaggacagtaacaagtagtagatagcagctagtaggacaaggaagaaatacctataccgcctactaggggcctacagagactagcct

SEQ ID NO: 587417 - DNA, 604 bp, Homo sapiens
  misc_feature (186)..(186): n is a, c, g, or t
  misc_feature (191)..(191): n is a, c, g, or t
  misc_feature (316)..(316): n is a, c, g, or t
  misc_feature (320)..(320): n is a, c, g, or t
  misc_feature (327)..(327): n is a, c, g, or t
  misc_feature (533)..(533): n is a, c, g, or t
gcacccggcaaacacttacgaacagcaaactaacaccaagctgcatagtcctggatgtgcaattggtttaagtgtcatgtactagatgaacacagcttgtgcaggaacagaacactagaacgatgtgagtagaggctgctggtcaccttttgtgacctgaggaatcccaggcctgtgtgaaattcnaaacngcaattgcagcacatgatgccagaaatagcactgaatcaagaaaatagccattgcggagctgccctcttgagtctttctgtccatcccattctattctgtactgtgacttcagttcaggaagttnggtnaggtgtntaaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcactttncttcttttgacgcatcatcctgtgatgttgaaatgtcacttgcaggatgctgatgttgtgcacgtcaatca

SEQ ID NO: 587418 - DNA, 394 bp, Homo sapiens
aaacgatgcccagactccagatggtcaagaaaatggtgaatgtccaggctggcgtcatggcatccttagatatggggtgtttggtgggtaatgaccccgagcaggttaggagacagctagttatgccaagcccatattttctggttatataaaggacacttctattctgactggtaattcctagagctgtttcggtcactggtcttcttcctgtttatgtggtagcgtcagaaccgtgtacggagcagggtgagcgttcacattctcgcatagcttatgggctgcctttagtgctgccgggagtggggagacttgatgcattccctgtgactggtttctttctcggctagcgctagaaggacactgatgttcgcatgtgtggctaatctggaga

SEQ ID NO: 587419 - DNA, 400 bp, Homo sapiens
caaaactattatcataactcaacaaataatatacgaaatatatttcaattccataagccaattacgaagaggcagtagagagaaagggaaacaaagtggggatgaggaaggtagaggacaagagaaagcggccaaacaatggtttggttgggctgtgttacagagtataccacccatttaaaattctgatcacatactcttgacccataaacccttagcccttgttctgatggggtagccacaggagtccaccagctgggaatcatccactgagctctgaatcagagcattctagaggctggaatgtcgggggagttttaggggtagttttccggtcatacctgaaaccatccgtcctaactcccaggcaggtttaaatagtgaaaactcttaggcagag

SEQ ID NO: 587420 - DNA, 963 bp, Homo sapiens
  misc_feature (23)..(23): n is a, c, g, or t
  misc_feature (312)..(312): n is a, c, g, or t
ttgggaagccctggtttacagcncctacgtcggacatgtagatgttgtgacgtccttcttccatgtgcccacggaatgtggcacttgtcgcaagcgcctgtgaacgcaatggcacttagacactggggcgcacagaatatgtgtggggccaaaaacaacaactggggccggggtagccccccgccgcatgccgtgtgaccgtgcgggcccaatacatgtagcccccctgttccccacataatctgagcgtttgtgccggcaaaacaagggtgctgctctcgctctgttccaccagttgtttacacccccttnttaaccagaggaggtctgtataaagcctcgcctgttcggccccacaacgtaacattaatgttccccgtcgtgtcccaacaccccccttcttaaattcggatataattgtgcgtcactgcagcacccggcccaaaatattcgtgtggcaacgcccccgtctcgctcccggaatacattggccaacaaaagtctgtcccctccgcttggtcttatctcacacaaagccgcacttagagaatatacctgtgggaaaccctcccagactccctgcacaaacattctttggagcccccctcccgcccttatttcttctttcaaaacataccacccaatcgttgttacgggtgacaacacccacactcccatcatgttacccctgatattttgagatacccacactgttccgtatacataaaatatcttgctattcccaccaccctcaaaggcagctcgggctcccctccataaacaagatctagatcccccccgccatcgttaaccttatgtagtgaaaaaagttttagaatgttggcaaagaccttctatgttaccctggcggcatactcccccttactgtatattaccaagtttagtcgcccattttacgggagtcccacaaaaaacaaaataaaaaaccacaagacaataaca

SEQ ID NO: 587421 - DNA, 183 bp, Homo sapiens
tattggccccagcgtccaagtgaacttctcatggagtgcagaatctcaactggaccaaatactttgtctttttaaatactgaaaatctaattattagtactatgactgacaagattcttcatggcataaaaagctctgcatcaaactcaattcaggaggccttccctccctacatgcatcact

SEQ ID NO: 587422 - DNA, 177 bp, Homo sapiens
agctccatcttaaacgagtaattcggagtgtcagcacggtgctcacgtgtcgacggaacttgtacaggagaggcatgcaccgcatggtgaatacacgtcgaccaggctccatctttgcgatattgaggacgtcaggacggttctcacgtatcaaaggaactatgtccaggaaggcat

SEQ ID NO: 587423 - DNA, 454 bp, Homo sapiens
cagtcctgagtaactgcatccaacaggggcaaaaagtacttggtgggcctctgaagccatcacctcttggttcagggccacccggtcttacttccaggctgccgacttcttcaacaggcatcctatgggtctctggtaatactggtgataggcgacccagggcgggatgaggaatcgtccggggtgggggccctcggctttaagagagatgggccacatcttcagggtcggatgacttaaaccgattccacgttgccgagcttctccctgtaaaatggggccatacttctggaaattctggccatgttgaagttggcctttgtgtgtgcccgtctccctccagaattggtacaggttaagccagccattgtcaccaggagagggatctcattgaggggcgaggattggggtgagatgcctctaatggggggttctgagcagcaccttgcccagt

SEQ ID NO: 587424 - DNA, 185 bp, Homo sapiens
tcactaaggtgcatggctgagatcattaagctctggtacttttaattttatgtatttctctctgatttcattcagtgcatttgcacctgaagaacttcaggtagaagaaatttgtagtaagaaaaaactcttttctattttcccgtggtcaataccccctccataatgtctatgctggtgggaag

SEQ ID NO: 587425 - DNA, 694 bp, Homo sapiens
accttcctgctgactgctctgctgaccgcttcccgcactctgccctctcgcgccgcacagtgcccgctgccgggcgcggcgcctcagacaactacactggtgggtgaacgagacagatgctctctaacgcacacaccggctgctcatacgtccacggcaaaatcctgagcgaagatgaagaccagagcaaaccctgcgaaggagtccctagagacacctagtaatggtcgaattgacataaaacagttgatagcttgagaagataaggttgatcagcagtaggcggaggaattgaagccagttttttatgaaggaagttgggcagtcgctttggatgacttttgtgaccagagtcgtcagttgaagaagtcagcatcattagataactggtgggtgcagctctcacataccttattctgttcttgcacggagcacaaaaacacaccatagagcgaacggatttgcagagcacctccagaacaaggaaagactttttagttgcaaggcgctctctcttagatgaactgcttgaagtggaccacatcagaacagtatatcacatgtgtattgccctccgtcattctctttatcctcagcacacttgtagtagattacattgatgaaggaaggctggtgctgagttcagctcctgtcttatgctttaggcaaatattctaccgcagcttggacctgg

SEQ ID NO: 587426 - DNA, 1135 bp, Homo sapiens
gaatcatggctagtacgttgcctggttgtttaatcggccgatgtggggagtggctggagtgtagctggctgggctgtgctgtgctgcgctgtgctgtgctgtgcgtgcagtgccgtgctgtgacgcagagaccagttctggctgcatgtcttggacaatgaatgtcgtagtggtggtgagtggtggaatgctggtgaaacccacagtgagtgcaaccacactagtttagatcttctggtgaccccacttctctgctgctcatgcctgctgtgtgacttggtgtgctgtgcagtgaaaacatgtgctgccccctctcagtgggaaaattgagtgagtgcttgagccagtgcctgtgtgaagtgtgcttggtgctgtggtgtgcgagccagtggcctctgtgtgctgtgagtgttgtgggtctggtgtgtgagccccacaaaaaatggagcttggacacacacgagtcgcatacccaactcaaaagttcacatgagaaagagcacactaagaacatcaagatagtgtcacaaacaaacaaacaagaacgcatatgaggccaaaaaaatggagaaaagtaacactacgattgggccaatgaaaatcaatatagtagaacatagccaacacaaacccaagacacaaagagaaaggctaagaaatgaaggaaaagagaataagaccatgagagaacaaataactaggcatagcaaaatatatagaaaagaaaaggaagaggaagaaggaagaaagcacaataggaaacactacacacaagcaaaaagatgaaacgaatagcaaacgaaatgagaacactagaagcagcaccacaaaaatgagaatacagaagaacagcgaagagtcacacaaataacagaacaaaaaaagtaaaaagtggaggaacagcaaggactgagcagagagtagaaaaagtagaaacaagaagcaaagatagatcagacaagcaagaaaaacacaacaacaaagcaaaagagagaaaaagaagcaggaaaacgagcaaaaccacaaaaagagataatgaaaataaaaacgcaagcagaccagaaaacacaagcagaggagcgcagcagcgagtccaaaagcagaagaagaacataagaaacgagaacaggagaca

SEQ ID NO: 587427 - DNA, 1559 bp, Homo sapiens
  misc_feature (373)..(373): n is a, c, g, or t
taggaaaatattttctaaaaccagttttaaatgactcttattcctgtagtaatattcaattggctgtaccgtgctggggggttagaaaggaggctagaaagaatgaattcaggcactttcttccaataaaactaattatggctcattcccttgtgacaagcgtgtagaaacgtggatctcattttataaaccatttttcatacagtttcaaagtgggtaaattcgtgatgtagattttataaatgtggcattttgtggaagaaacttgtggctattagaattagtttatacagaattcttataataagggtgtgttgtatatcattttatagaaaagacacactctactaacattcacctatctgtggtgaanttctctgtgaacacctaaagtggggtgcctaaaatctccagaagacaacagtgtgcacaagtgtgtaaacagtgtggagaaatctcctcgtggtgtgctccactctgggacgaaatttccacaaagctgttttctctctctcttgatggtgagtaattatggtggtcccaaggtggtgtgtgccattttgtgaaatttatgtgtgtctgtgagtattccataaataaaatctaaagatcttttcttttaaagacacatttactaaaaaacaaaagaaatacactaaaacaagagaccacaacatacagatacaccaacaaaacaaaagacaacaagagataccaactggaaacaaagacagagacataacaccaacacaacataacagaaaaaagagaggaagacagcaactacaacaacaatataaaagtttataacaaggaaagaggacgacgccgactacaacagagatagacgaaaaaagatacaacgcaacagccagagacatagtcacatatcggcaacacgtaaatgagaaagaactagggaccgacgtcaagaatgagtatgggcaggatagcgaaaatctggaacacaataacaatgaactcagacgcgagcaagcactgaggacagatcagggaacgagatggtatactatagagaagaagagtaagggtatggttgcgagaggagagagagaaacacacatagaataaagaccagagcggagtgacacgctcgacgcgcgcagaaagcaagagaaacatcaacaagatagaagaagatataagacaaatcataatcacgagatccgacgcagacgacagcaggacgtgcaaagagagaaaataagaaatagaagtatgtggcccgtcggtcgccacacagacacacgtgaccaatcccaagggctgagagatcacaggtgagataggagtccacagacgctcacgctgcgagacgctgaggcgactccgagacacgaccggagaggtttaccgcgcgcagccgaagcggactcctagaactcgaatatgatgaacatcagcagtagcgataactataacgcaggccggcaagatagacgcagacagaatagacggcgcgagaacaggcggagcgcgggcacagcgagggaaggcggaaggaggggcagcggagagggcgccggcacaaaggagcg

SEQ ID NO: 587428 - DNA, 328 bp, Homo sapiens
aggtgagaaccaagcactgcaaacctcataggagtactccagcgacaaggctcaaagcgggctcctccgaataggctaggctaaggataggtaggtacagtccctaccaacaacagcaaggaggatgccttctccgggacagattggatagtaggagaaaataggatatgaaggagtacgacttggatgccctgtagggtatagataacctggaaaccatgccagataaccttctgaccacgttggatgacacttgtgatctcttagaccccctagtccaggagactaataagcagcccccccagacggtgaacccaataggccatct

SEQ ID NO: 587429 - DNA, 157 bp, Homo sapiens
tcagtggagaccttctgggttccgggatcctgtccatagtgcctcgctcatctcccgatcgatcccactgacccccatcagcacccctcacaccttccccaaaggtgagatgggtatgaagaggcaagcaatgcagtgagcagtgggcaggatggca

SEQ ID NO: 587430 - DNA, 1906 bp, Homo sapiens
aaactcagttctttggaaaaattaggtaacttgaacgtagggcacatgggctgtcacaccaccccatttagagcccttattggcatagagatgataaaagtggactctgtgatggcctctcatgatctcaggatagcaggataggggaactctgagtcatggccaaaataattggtcaatgtacagcctcagacagctgggaataccaccccaaatcacttggataaggagatgttttccttatcctgtgtctttaactctgagacggatggagttgaacaatcaacgattgttaaaaatgtaccaaatgtgtaagcatcatgaggtgtttaagctgagcttttaaattaaaattctgctgggtgtggcggctcatgcctgtaatcccagcactttgcgatccccacacaggaggattgcttgagcccagaagtttgagaccagcctgggcaacacaaggagaccctgtctctacaaaaaacaaacaaacaaacaaaaaagccgggggtgttggtgtgtgcctgtagtcccagctactagggaggctgagatgggaggatcgcttgaacctggcaagtcaaggcggcagtaaatggagatctgtactccagcctgggcaacggagcgagaccctatgtcagaaaaaaagaaaaagccacccagcaggctgagcgtggtggctcgcgcctgtagtccctgcactttgggaggccaaagcgggtgagtcacttgaggtcgggagttcgagaccagcctggccaatatggtgaaaccctgtctctactaaaaatacaaaaattagccagctatggtgacgcacttctgtagtcctagctacttgggaggctgaggcacaggaatcgctgaagcccaggaggtggagattgccgttagctgagattgtgcccctgcactccagtctggacgagagagtgagactctgtctcagaaaagaaaaaaaaaaaggctgggcacggtggctcacgcctgtaatcccagcactttggggggccggggtgggcggatcgcgaggtcgggggttcgggaccagcctgaccaacgtggtgagacctgtctctactgaaaatacaaaattagccgggcgtgcttgcacgtgcctgtggtcctggctacccgggaggctgatgcagaataactggaactcgggaggcggagctggagtgcagtggcgcggtttcaactcattgcggcctcgaccctcctgggtcaagcgattcttcctgccttagtctccagagttgctgggattgccggtgtgcaccaccaagcctggctggtttttgtgtttttggtggagacggggtttcactatgttggccaggctggtctggaactcctgacctgaggtggtccgcctacctcggccttccagggtgctgggaatataggcgtgagccactgtttccggcctgttttttttagacagagtcttgctctgtcacccaggctggagtgcaatggtgcaaacatgactcactgcaccgtcatcctcccaggctcaaccatcttcccacctcaccctccagctacagctactccagatctgggctgaggtgggagaatcatttgaacccgggaggtggaggttgcagtgggctggaatcgcgcgactgtactctagcctgggtgacagggtgagaccctgtctcaaaacaaacaaacaaaaaccccaccagcaaccttgctgacaaatccacaggcccccacgtctgccaattgcctgcctgtatgaactgggcacctgggggaggggcgtggcccccaggctactcatcttggctttcacagccaaagggcctgggtggaacctcagcttactgtgtttactgactgggtaatgtggcctctgaagctgtcacctatctataaaatggggattaaaacg

SEQ ID NO: 587431 - DNA, 114 bp, Homo sapiens
aaattgtgtcagcgtgggtgattccccaaagatctgagggtatctcctagtatcctaattctgaggctaaagtctgccttcaggagtaaggtttaaagcttaaagtggcaattc

SEQ ID NO: 587432 - DNA, 717 bp, Homo sapiens
  misc_feature (651)..(651): n is a, c, g, or t
gaacgaaaatctgttcggttcattcattgcccccacaagtcctaggtcctacccgccgcagtactgatcattctatttcccccatctattgatccctcactctccaatatatctctatctaactaacgcgactaatcaccactcgcgaacaatgactaagtcaagactaacctcaaatacaaatgataaccatactacacacactaaaggacgaaccctgagtctcttatactagatatcctataaattcattcttatatttcgccacaacgtaacctcctcggacatcctgacctcactcatttactagcctaacctacactcatactatctatataatcctagtccagttggccatccccgttagtagacgccgaggcgcacgttcgattgataaagtgctttgctgcgtctaactgattgagatagaattgcccgttaagcccactttctgtgacgcaccataggcaccactcgttagcaacctccctttagttcgccccattacctaagttcattagtgctgataacgcgatccaggcgcattagcatcattttctatatctctaacttggcctcttgagccgctgtaccgccattataccgcttttaccagttgacgttgccaaggctcgacccttacctcgaatntcgacccctaaattcggagagccgcccacctcggttaggcaaaattatctagacgcagttaaagcc

SEQ ID NO: 587433 - DNA, 240 bp, Homo sapiens
agaagatcgttaagaacatcctcgaggccgacgaagaggccctccaggctgcttatgatgccctggcagtcgccgatcccttctcattcgggcctgacacctacattcccaagcttgctcctcgtctcgcctcgcaatacgactccaaggatcccggtgttcttgtcgccctgattaccatgaacttcctcaccctgcaacccggcgaggccatctacatccccgccgacggcatccacg

SEQ ID NO: 587434 - DNA, 316 bp, Homo sapiens
cccccccccccccccccccccccccgggagggggagacttcccctgggaattttgttgtcccaaggaagcaaggggggggggggagaaaccccccttccccccggggggggaatttttgcggggggcccccccctttttaaggggggggggaaaaagaaaagccccttttttccggggtgggccagggggggtttggtcgggcccggggcccccccccttttttttctttcccccccggcccctttttaaccccggggggtttcagggggggtttttaatggggaataaggtttttttattttttttttttgggga

SEQ ID NO: 587435 - DNA, 283 bp, Homo sapiens
  misc_feature (233)..(233): n is a, c, g, or t
  misc_feature (238)..(238): n is a, c, g, or t
tcgagatagaatactggagctatcattgtactaaattattaatttcttgcctccagtgttctatctctcgcaggctgagttattatcagaaaatgaccatctgctcctttttcattgcagaagattgccaggggctaatttcagaagaacttccactttctttccactggctctcatactctctaacttattagttattgttgccccgctgtgtaccgaggctctacattcgntatcntagctcctaggcattttcctgtgtagacaaccctggccgtaccct

SEQ ID NO: 587436 - DNA, 284 bp, Homo sapiens
  misc_feature (116)..(116): n is a, c, g, or t
cacaccgggggtctgtagaggattcccatgcgcaccgatcagaccgctccgtccggctctcggactaccagccctatcccttccgcctcgacagcgtcgatcttgagttccagctngatctggtcgccacacgggtcaaggcgcgcctcgccttcacgcgcaccggcgaatcgggtgcggcgctgagactcgacggcgaacgtcttaagctcctgtccatcgccatcgacggtgcgccgctgtcatccaatgcttatcagctcgatgatgagtcgctgacgata

SEQ ID NO: 587437 - DNA, 161 bp, Homo sapiens
atgcagcacagtaggtgatagaaataaaatgcttactacagtggctattacaaggtcctatgacatagtatgatgtgcaactatatgacagcttattatttttaagactaccaattactgatatttctagttttattgccttgaaccctgctggaaaagta

SEQ ID NO: 587438 - DNA, 133 bp, Homo sapiens
gaaatagacacatatactgcttggtacagctgtgacatcaactggatttaccagtgctgtctcagcctctgcatctctatgttatctaatctgtgattctcttgcgtgtcacttatcatcctgtttttctaag

SEQ ID NO: 587439 - DNA, 244 bp, Homo sapiens
gaccatccccgagtacgctacatgatcatcactaccatttgtgttgccattagtgaatttttacggggatttttaatgtgggtgcaatccctctggaaaagaccattgagtattatagaagaaaaaattaacagattattggcatagccgtgggttacgcaatgatgttttattacacaaaacacagggaacatataaagtttgtacactttttaaaaagtacaaagatctgttaatcaaattg

SEQ ID NO: 587440 - DNA, 307 bp, Homo sapiens
aacaaacggccttttaaaaaaaacccctggggcgatagctcttttcaggtaggttttttaaaaattaaaacaggggcctcctgggcaggtagggtttgtcattccgttaccaaaatagggaaagggttttattggcccaaatatggttggggtttctccttaaactttctggccccatgactgaatgcatttagaattttcgtttccctgggttttatttgggttatccctgctacagggttagtcatgcaaaaaaacaaaggggccgttaggaaaaatttattttttccccccccccagggcccca

SEQ ID NO: 587441 - DNA, 611 bp, Homo sapiens
  misc_feature (105)..(105): n is a, c, g, or t
cgggacacaaccgttataaaggagaaatagggctgagcctatttggggcgtgcaaagccaaggcgccaagaaagtacctccctgtaaaatgaatttgtcatttcnaaagcaaacaagaggccttaatttgtcaccaggtacttgtcagtgccacgggccaaatgcaccagcacagagtgcggtggattgacctctcccatccagaacctcataccgattgcacactttattgtcaatctcagggaggtgggcttccttaaaagggccagctccaaaagtaccttgggtttctccccagccagtgatgatacattcggtccggtcggcgaccacataatttgtggatggcagacaagctgggattcgtgtgggctacaagaacagcctagacatttctatttcctgaacattcggttcgagattcacgtcttggtgtgcacccaggatgaccttgtagaatgaaggccttggggacttctccaagcagtgggcagcagtcaacacccactctgggtatatcaaggtgcctccacataagtgcattccaaaccttgttctaagattgacttgccacccccagaatgtgggtgggccacacacccacaaacaac

SEQ ID NO: 587442 - DNA, 229 bp, Homo sapiens
cccattgtctgggacgtgagcagcccctctgcctgtctgcccagtctggaaagtgaggagcgtctgtgcccggccgccatcccatctaggaagtgaggagcgcctcttcccacccgccatcccatctaggaagtgaggagcttctctgcccggccgcccatcgtctgagatgtggggagcacctctgcccggccgcgaccccatttgggaggtgaggagcaactctgcc

SEQ ID NO: 587443 - DNA, 206 bp, Homo sapiens
gcgccgggtctgtacaagcatgaaaaacgcatcaccgtgccgctgctggtgtcgagcatcctgctgttctacaccgggatggccttcgcctacttcctggtgttcccgctgatcttcaagttcttcgccgccgctacaccggccggtgtggtagatgatgaccagtcatcacgaagtcgaggtaactggtgatgtcgggtcgacgc

SEQ ID NO: 587444 - DNA, 992 bp, Homo sapiens
ggtccccgttttctcattgggggacgtttgcagctcccccccgcggggtttatttttttctggtaggaacgctcctcttgcgcagggcgcacccccattctcgctgtgtgtgcgccccaaggctgctcaccgtttgtcgaacacatttctgtggacgccctttctccacccccaattggggccccgcgagaaatgtggcgccgccgcgcagatctctatacccaaagagctcgcttgtggcgctctcgagatatatttgtcgtggaagacttcggtggtgtgtataaacaccgcgtgctttctgcgcgccccacaccccctgcgagtggttgcgatatttgtccccccccctgttcagttttcccccagggtgtcccccccgagggcgcagatttggacatagcggcaaaatagggccccaggttgtccacccttcctccccaagcgggcccccacgtggttaaacactctccctcccgcgctcgcgggagtgttccccccactcgatgtctttctgtctacccacattgagaggagcacttcggttgggatagccactctagagaacagctggccacgcggtcgagtataatgagagccccccactggagtgtccaccccgggtgttacaattacacactgccagtttcccccacggctgtagacacgaaatattttcatcggtttctccacgaagccaaggtccctgtcccataatatgagccccgtgtaccaaacatgaaggaagcatggggccctcctcacacatttgcaagacatcccctccacagtaaccaggcccttaattatttgtgaaaaattggcaatttgggaactgttttcccccgctcggcacaccttatggggcttcccggccccccctttgttctcccggtccccccgaaacccgccacaccttttcactccaacaggaaaggtggggggccactcccgttgggagcctattaaaatgaccaatttaaagagaggca

SEQ ID NO: 587445 - DNA, 1847 bp, Homo sapiens
gcagagagtggggacgctcctggctatcgtgagcgggcagctgcttctgttagtgccagcgacctaacacacatgagcaacttacaactactgggctgactgcttgacgacacaggcaacgcaagcacttcattactctactgaagctgcattcccacgcttgctctatcaccgcttgacaacacgggaaggcaaagacacaacggactatggtgccaacatactaccatagcgatactactatatggcgccgcgacagcacaagcgtcacatgcgccccctgcgcataactactatcaacacaagcccggccaactatagcacaccaacacgcgcctacactactagacgtagaagcagcgataacaacctcgacatcacggcacgctaatacaagcgcagcacattccccgcaaccgcaacaggttaacccactcacgactagcggcacaccagcacaacacataggcatacctcatatatgctaccggcgctacatacacacgcacatgcaaacgcgcacaacgcacacacgcggcgcccagaaacttacaacattcacgccctactaactactcaccaactaccacaacaatcgccttaaacactacacaactctagcaacgcctaacaatctcaaaccatctctggccgcccaccacaccctatgcacccccttatccaataacacacactaactacacacgaccaaaaacacccaatcaaaccacactacgcatactcaccaaatctagtcacacccatactcacatcatcatcactacacgtatcattaacccaccaactccccctaccacaaacagtccagcaactacctctctacttacaaccaacctcccaacgaactaacatacccacagcaactttccacacatagcaacaacttgcacacactatgtacacacacaacaacataacatcatactcagtacttcaggagatacacacgatatccccctattgacaaattctcctacacacccacactctactacaaccacaacacttttgctacccatactgtccagacggctctaccaatacaccatcgaccccatcacctatgcctatctccaacacacatacatctcaccaccatacattcactcaccacacacactcattacaacccctacactcacaccatctcatcccccactcacacaccttcgcactcattatacatcaacagcacttcttcaccccccccctctatcctaaatcagtcactaacttgcacttacagcacacctcacacaggcattcagcaccacactatctccacaccctaatctccacaccaacaaccgacttgtcccacacacctctgcccaaattccatactaaaacaccaacatcaccactgccaccaactcgtcgcctccacacaacaacacaacaccgtctcacaatcaatacactcccaccaatacaaccacccctccaataatagcaacaccccccacccacccactgtcactaccctaacaccacaaccacaacctcacttctcgccctctcccaccaccgcccacaccaccccaacactgcacatctacccacacccacaccacccacccacccactcctccctcctactcatccatcccctgcctcatcacactctgacctccacacatgctctcacactcacactcacccccctcctaacctcctacacttcacaccaactcgaccatcactctgaccacacaacacaaccctctcccccctcactccatcctctctcccctccctccatcccacacatcaactacacacctcatcatctccactcctccccccagatcacctcatctcacttc

SEQ ID NO: 587446 - DNA, 394 bp, Homo sapiens
  misc_feature (45)..(46): n is a, c, g, or t
  misc_feature (48)..(48): n is a, c, g, or t
  misc_feature (394)..(394): n is a, c, g, or t
actaaacatttaaaatatatttctgaacaaaacgggcccctcgcnnantcatccgagcagagcagcccatgaagatgcagcactgatttccgtcccatagtcagggtgaaaaatgtacagcttgttcctgaaccacagacacaccttctctctgcagcctaacaggtcactgctagtatggtggctctagccgaaattatgtagttccttaaaataaaaaaaataaaataaaataaaaataaaaggaaagaaaagaaaaaaaatgtcctaagactcctaatcaatctgggaatgtagactctggagcacaaagtagcccagctcatctaaaaaactgaagagacccttccttccccaccccctcagtaggggcctgaaaggagaagaagtagtn

SEQ ID NO: 587447 - DNA, 1100 bp, Homo sapiens
  misc_feature (84)..(84): n is a, c, g, or t
  misc_feature (86)..(86): n is a, c, g, or t
  misc_feature (113)..(114): n is a, c, g, or t
  misc_feature (132)..(132): n is a, c, g, or t
  misc_feature (135)..(135): n is a, c, g, or t
  misc_feature (147)..(147): n is a, c, g, or t
  misc_feature (194)..(194): n is a, c, g, or t
  misc_feature (202)..(202): n is a, c, g, or t
  misc_feature (207)..(207): n is a, c, g, or t
  misc_feature (213)..(214): n is a, c, g, or t
  misc_feature (222)..(222): n is a, c, g, or t
  misc_feature (225)..(225): n is a, c, g, or t
  misc_feature (233)..(233): n is a, c, g, or t
  misc_feature (266)..(267): n is a, c, g, or t
  misc_feature (275)..(275): n is a, c, g, or t
  misc_feature (277)..(277): n is a, c, g, or t
  misc_feature (297)..(297): n is a, c, g, or t
  misc_feature (306)..(306): n is a, c, g, or t
  misc_feature (315)..(315): n is a, c, g, or t
  misc_feature (329)..(329): n is a, c, g, or t
  misc_feature (443)..(443): n is a, c, g, or t
  misc_feature (459)..(459): n is a, c, g, or t
  misc_feature (467)..(467): n is a, c, g, or t
  misc_feature (472)..(472): n is a, c, g, or t
  misc_feature (492)..(492): n is a, c, g, or t
  misc_feature (528)..(528): n is a, c, g, or t
  misc_feature (542)..(542): n is a, c, g, or t
  misc_feature (545)..(545): n is a, c, g, or t
  misc_feature (559)..(559): n is a, c, g, or t
  misc_feature (561)..(561): n is a, c, g, or t
  misc_feature (565)..(565): n is a, c, g, or t
  misc_feature (578)..(578): n is a, c, g, or t
  misc_feature (623)..(623): n is a, c, g, or t
  misc_feature (1100)..(1100): n is a, c, g, or t
gcaggagccggtgcgagcggagcagagccgaggtcgggccgcgagcggagccggctgagcgggcgccgagctcccgccagggcncnggaacacgctgtcctcgcgcttccgcnngggtggacatcgacgaanttngacgagaacaanatttgtggacgagcaggaggaggcggcggcggcggctggcggagccnggcccggnacccntagcgnnggtggacnggnctcctgcnggcaaggggacatgcttcggggcattccatgcnngccttgtngnaactctcccgtcaacaccanagaatcaangctgtgaanggagcgagcccagngcgtggtgctgaaagtgctcacagaacttcaagagcagtgagattgagcaggctgtgcagtcactggacagaaacggcgttgacttgttactgaagtacatttataaaggcttngagaagcccacagaanatagcagngcagngttactccagtggcacgaanaggccttagcagtaggaggactaggctccattatangagtcttacagcanganagactgtttaacananatanaacgactcatgtnaccttgagaagaattctggatgcccaggctggtgaagaagggatngacaatggaccatcttcctaggaactcccaagtaactatttcaggacatgtatctgctgaactgtatttcattttcaaggtggaggggaagatccgctgtgtcctaaatcctgtttaggaatctgatagtctatgccttgtctccgagttctgcagactgacctttgacgtctacaacgtggggtggtgttggccgtgccctgtgtgcccggggcaggatggcttggccggtgccatcaggcctgggtaaagggaagaacatgggttttggaagggtgaaaaaaccatggagtttgttaaagtggggtcttcccaaaggggactcgtggaactgatagtgctgcgcacaaaacggggtttgatataaaaagaaaaggggcttggtgcgaaagaatgtgtaatgtgcacgataagatgtcttgttacatacagagggagagatgatcgtgcatgtgactctttattatttgttagagn

SEQ ID NO: 587448 - DNA, 400 bp, Homo sapiens
cagagaaagactctgtctcaagaaaaaaaaaaaaaaaattagccaggcatagtggtgagcacttgtagtcccagctactcgggaggttgaggtgggagaatcacttgagtgattctccgtgcacctgccaaggctgcaatgagtgctacttgccccactgccctgtagcctgagtgacagagcaagaccctgtttaaaaaaaaaaaaaaattaaaataaacctggtcaacatggcaaaaccccatctgtacaaaaaacacaaaaattagttgggtatagtttccacccacttggggggctgatgtgggaggatcacttgcacccaggaggtcaaggttgcagtgagccataatcacgccactgcactccagcctgggcaacagagtgagaccctatctca

SEQ ID NO: 587449 - DNA, 842 bp, Homo sapiens
aacggctaggtagcgaggctgggtggtgcacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 587450 - DNA, 236 bp, Homo sapiens
cgatgggtcatgcagttcaactcattatctgtgtgcaattgtttgtccgagaaactccatcttctttacatctcgcagcaatgtcttgtcctttcttatggtccctggtgatttgctcgtttttctcttccatcagctctcgaaccaatgaatattcatcatgattggtgatgccaatgcgggcacagatggtcatgagcatgtcagtgacagtcttagagggacacgaatgttca

SEQ ID NO: 587451 - DNA, 365 bp, Homo sapiens
  misc_feature (2)..(2): n is a, c, g, or t
  misc_feature (64)..(64): n is a, c, g, or t
  misc_feature (81)..(81): n is a, c, g, or t
  misc_feature (127)..(127): n is a, c, g, or t
  misc_feature (223)..(223): n is a, c, g, or t
  misc_feature (303)..(303): n is a, c, g, or t
  misc_feature (337)..(337): n is a, c, g, or t
tnttgctctgtcacccaggctggagtgcagtggtgcgatctccactcactgcaagctctgcctnccaggttcaagaaattntcccacctcagcctcccaagtagctgggactaccggtgtgtgccancatgcccggctaatttttgcaattttagtagagacaaggtttcaccatgttggccaggctggtctcaaactcctgacctcaagtgatctgcctgtntcagcctctcaaagtgctgggattacaggtgagccaccgtgcccggccaggggcaattgtctgctcgaaggcacatgttncccaacagctttgagcgtggggatcaagggagtncagtttttttgaggggcgggacagccgt

SEQ ID NO: 587452 - DNA, 638 bp, Homo sapiens
gctctctccccctctctccccacccgcttgcctccggccctaacctcaaggaactggctccgcctcctagaccccaacctcgccccaggccctgcctcctgggcctcacccacaacctcaggtcccgctcctgattcctgtccccttcccactgtcccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 587453 - DNA, 327 bp, Homo sapiens
  misc_feature (21)..(21): n is a, c, g, or t
  misc_feature (24)..(24): n is a, c, g, or t
  misc_feature (31)..(31): n is a, c, g, or t
  misc_feature (228)..(228): n is a, c, g, or t
  misc_feature (291)..(291): n is a, c, g, or t
aaccgtcgttatcccaaaatnaanttttaantttccaccggcccttccggcactatgctggatggtgtactggagggaaaactgaatgcggcgtttattgatggacccattaaccatactgccatcgacgggataccggtataccgcgaggaactgatgatcgtaacgccacaaggatatgcgccagtaacccgtgccagtcaggttaatggcagtaacatttatgcnttccgcgccaattgttcgtatcgtcgccacttcgagagcttggtttcatgctgacggtgccgntccgggaactatccatgagatggagtcttattcacg

SEQ ID NO: 587454 - DNA, 698 bp, Homo sapiens
  misc_feature (641)..(641): n is a, c, g, or t
  misc_feature (644)..(644): n is a, c, g, or t
gctctctccccctctctccccacccgcttgcctccggccctaacctcaaggaactggctccgcctcctagaccccaacctcgccccaggccctgcctcctgggcctcacccacaacctcaggtcccgctcctgattcctgtccccttcccactgtcccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggcaaanaanaagaaagaagtaaataattaatacaagaaaaagaaaataagaacagaaaaagag

SEQ ID NO: 587455 - DNA, 116 bp, Homo sapiens
tcacttgaccatctgcgcccccttctctcctgcaattggtttgtactcactggggatgtgctctcgcctgtttagccgatgtatggagataagaggatctttttgtcctgtaggct

SEQ ID NO: 587456 - DNA, 111 bp, Homo sapiens
ttttccggggaaagtaaagcctcagggatgcccgcgccttttttccaaagcctttgtctatgagacctcttaagttttaagattaaatgcccctcgctgttcttcctctga

SEQ ID NO: 587457 - DNA, 1547 bp, Homo sapiens
ccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgctctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 587458 - DNA, 1515 bp, Homo sapiens
tccacctccttggtgactccaagtactcacacagtcatcgcccctacccacgcacagatggccacatctgcctccatccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcgccccaacttctactaccacgattactcccaaccccactagtacacgcaccagaacccctgtggcccacaccaactcagccaccagcagcaggccaccaccacccttcaccacacactccccacctacagggagcagtcccttctcttccacaggtcccatgacggcaacatccttcaagaccaccactacctatccaaccccatcactccctcagaccactcctctcactcacgttccacctttctcaacctctttggtgactccaattactcacacagtcatcacccctacccacccacagatgtccacttctgcctatatccactcaacgccaacaggcacgattgcttcaccaacaacagttaaggccacaaggtccacctacacagccccactaatgacggcaaccaccagtaggatcagccaagcccacagctcaatcagcacagccaaaacctctacatccctccactcacatgcttcctccacacaccatcctgaagtcaccccaacttctaccaccaacgtgactcccaagtctaccagtagagacaccagcacccctgtgacccacaccacctcggccaccagtagcaggccacccacacccatcacaacacactcttcacctaccaggagcagtcccctctcttccacaggtcctatgactgcaacatccatcaagaccaccacgacctatccaaccccatcacaccctcagaccacacttaccactcatgttccacctttctccacctcatcagtcactccaagtactcacacagtcatcacccctacccacgcacaaatgtccacttctgcttcgatccactcaacgccaacaggcaccgttcctccactgacaacgcgcatgcccacagggtcgacacgcacaggcccaccaatgacggggaccatcattcagacaagcaaagctcacaactcattcagcacagccaaaacttctacatctctccactcacatgcttcctccacacaccatcctgaaaccacaccaacttctaccaccaacattactcccaagtccactagtgcagggaccagcacccctgtggcccacaccaccttggccaccagcagcaggctacccacaaccttcaccacacacttcccacctacagggagcagtcatgtctcttccacaggtcctatgactgcaacatcctcccagaccaccactacccatccacccccatcacaccctcagaccacacttcccactcacgttcca

SEQ ID NO: 587459 - DNA, 1473 bp, Homo sapiens
ccccatgtctcaccacgatgatggagctacagtgggacttggaatccagatgtgtgaaggatggagggttgaaggacaaggagtacgtgggttttgctgctctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 587460 - DNA, 853 bp, Homo sapiens
tgtgcgtgtcagattgcggcccgacagcctgagtcacgcaccacgccgcagctgcccaccacaggctcacaggctccacgcaagtctggcccatgacgggaacctccaccaccatcgggcttctcagctccaccggaccctcacccagctctaatcacacccctgccagccccacaccacctcggccaccagtagcaggccacccacacccatcacaacacactcttcacctaccaggagcagtcccctctcttccacaggtcctatgactgcaacatccatcaagaccaccacgacctatccaaccccatcacaccctcagaccacacttaccactcatgttccacctttctccacctcatcagtcactccaagtactcacacagtcatcacccctacccacgcacaaatgtccacttctgcttcgatccactcaacgccaacaggcaccgttcctccactgacaacgcgcatgcccacagggtcgacacgcacaggcccaccaatgacggggaccatcattcagacaagcaaagctcacaactcattcagcacagccaaaacttctacatctctccactcacatgcttcctccacacaccatcctgaaaccacaccaacttctaccaccaacattactcccaagtccactagtgcagggaccagcacccctgtggcccacaccaccttggccaccagcagcaggctacccacaaccttcaccacacacttcccacctacagggagcagtcatgtctcttccacaggtcctatgactgcaacatcctcccagaccaccactacccatccacccccatcacaccctcagaccacacttcccactcacgttcca

SEQ ID NO: 587461 - DNA, 316 bp, Homo sapiens
gcccaggctgggacccactgactggctatttatgaagaaaagaggtttaattggctcacagttctgcaggctgtacaggaattgtgatactggcatctgctcagctttggggaggcctcaggaagcttacaagcatggcagaaggtgaagggggagcagacacatcacaggccagagcaggagcaagcaagcgaggaaggagatgccacatactttaaaacaactggatctcatgagaactcactcattattgtgaggacagtaccaaggggaatgctgctaaactattcatgagaaacctgctcgctcactctta

SEQ ID NO: 587462 - DNA, 296 bp, Homo sapiens
caggcttgggacttttaggtagggagctcaggaatcctaggaatctgtagtattctagacaaggagcaaagacttggatgggtatatccccttggcaactcaagactctctagcctgtgggatgtacgagcttggaggctgcccaggccagaccccgcttgcctggctccaaggatggcctggtcagcctctcgctctgtgctgcaggtacatgagtagatgagcagatcccacctgcttctcctcctcaaaggtgaagacacatccctgaggtcaagcctcaatctagccatatc

SEQ ID NO: 587463 - DNA, 1641 bp, Homo sapiens
ccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgctctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggtctggtggggggatcctgggggctggcgcatttagggagggctggggggtctctgccccctgaggctgggcaatgaccaatccctgggtgcaggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 587464 - DNA, 354 bp, Homo sapiens
gcatgaaccactgcacccaacccttgaaaaactaaatctctgatcgcatattcatatataactccgacaatttattgccggcaagtgtgtaatatattataagtgaatcgaacattaaaatcttgctgcttaaagtcagcactcatctcggacatgttgaaattaaaatctattcttgtatcatatacactatgtgataaagatattctgcatgacttgcctctaaatctattactaccatactgcatttctactataaagtctcaacttagattatatctgtcattcactttgttctagcagattgtatcagctgattatggagaatattctatacatcaggattattttctg

SEQ ID NO: 587465 - DNA, 1607 bp, Homo sapiens
  misc_feature (1550)..(1550): n is a, c, g, or t
  misc_feature (1553)..(1553): n is a, c, g, or t
ccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgctctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggcaaanaanaagaaagaagtaaataattaatacaagaaaaagaaaataagaacagaaaaagag

SEQ ID NO: 587466 - DNA, 1713 bp, Homo sapiens
ccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgctctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggtgtgggaaacaaagaaggaaggcaggccgggcacggtggctcacgtctgtaatcccagcactttgggaggctgagacgggaggatcccctgaggtcaggagttccagaccagcctgggcaacatggcgagaccccacctctactaaaaatacacaaatttgccaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 587467 - DNA, 405 bp, Homo sapiens
agtgactgatgcgtgggccaaggagcaccaaggggagatgggtcactgcccaagccgtccctcagagcctggcccagctcggtggtccctgccaacaacatacaggtcacaaagacccaaagacacatagatgcaacagagaagccagccaaaacctgccaaatccaagatggcaacaaaagtgacttctggtcgtcctcactgcacattatgtgctaattataatgcatttgcatgctaaaagacactcccactgccaccaagacagcttacagatgccatggctactttcagaagctaaacgagggagggactctcagttccagggaaatcccctccccttacctggaaaactcatgaacagtccaccccttgtttagcatacaatcaagaaataaaccacga

SEQ ID NO: 587468 - DNA, 1807 bp, Homo sapiens
ccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgctctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggtctggtggggggatcctgggggctggcgcatttagggagggctggggggtctctgccccctgaggctgggcaatgaccaatccctgggtgcaggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggtgtgggaaacaaagaaggaaggcaggccgggcacggtggctcacgtctgtaatcccagcactttgggaggctgagacgggaggatcccctgaggtcaggagttccagaccagcctgggcaacatggcgagaccccacctctactaaaaatacacaaatttgccaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 587469 - DNA, 256 bp, Homo sapiens
gtactcacattctgcttacagttgtaacaaatacagacgagttaaaagacaaacaaaagtacgcttagctgaatcagccccgaagggactactcctatgggagcacgggttatcctgccgcgtgaaactgtcctatgttgcctatggacccggagttccccaaagggacagagcatcacagttgaagaggcaacatgggtcaagtgtagtgtgcagacaggccaacttgggtgactggcgctcatcgagggcccct

SEQ ID NO: 587470 - DNA, 986 bp, Homo sapiens
  misc_feature (374)..(374): n is a, c, g, or t
acactgccttgtctgctcccctgtgtcgcgagttgctttggaggggcctcgtgtctgcggtagacagcccctcgtgtggaccagggtgctctcaccatgttgctctcgctctttgtcctcttaagggccctcgtggctccggatgttgcttctctcgcgatattttgaggggcgcctggtctgccagaggtctcaaggcgcccctagcgccgtctcaggggcctccccggggggcccgcccggtgttcgccgcccgaaggtgtgggcgtcccgtccccggtacacaggcgcgtgtggtcagagaggtgtgccaaggatgctgcgcgcaaaaatctgtttgggcagggttctcccccgcgcccttttgttggggncctgtagtaccccgcgctggtgtgagccgcgggactcccagcgccgcgtggctgctgatggttgctcccggctgccgaccgtatcagccatctcgtgaacaacctccgcggttagggccgccgttgctccctaagaagcagcgtttattgcgtgtggaacaccgcctctctttgtgggtctgccagcacccacgtgggtagtctgagccaccccggtgccctgaggtggcacgttcttatcaaccttatcagcaggatgtcttaggggcccacccgagccagcaatggggggggaaggtacaaaatcatgataataatgtggatactagcgatctaaaaggcttcagtcttctcgcgcacaaatgttttcttgagcctgatccccactaacagacggcgaatctgtctttaattattcactctgccccccgtcttcctcaatgaacacgtgccggcttttgtctcaagaattctgcacacgtacattcccccaggcgcgcaagtgtctcatggcgaggggaactctcgcgtccttttttcgacagagccgacccccgtaaaggtggctggggaaccccgtaagatcttgggcgggaacagacccacataaca

SEQ ID NO: 587471 - DNA, 1099 bp, Homo sapiens
gggatctagctatattgcccaggcttctcctgttctcttaatgtctgccccatcttagaatcttgtgtttacaccatctatgtctctgagattttgtttttgtcttcctgtatgtccatctctccccatctctgtctttcatgtctttctctctgtctctgaccacccagtatctctgtgtctcactgtctctggtcatgaaatgtctgtcattgtggcccgtttcacactgtctctatatctgtttcccctgagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 587472 - DNA, 898 bp, Homo sapiens
agagagcctggtctgtggcaagtatctggctgaccatgtccactgaaatagaaggcttgttgccaagacttcgtggacgaagtgacactccgtgaggagctaggatagatgcgcaataactgctttgctgatatggcgaccggttgcaattgactggattctaggacgatgttcaacaataagtccccatggtgcaatcaagcgcggattgtactgccacacgtacatgatttgatactccttatacatacaatgcaggtctgtacaaccacctacagtgctcagtcacaccctgtgcaaagaccaaactacagaactctttccaaaagccactccgacaacagcccgcaagtgccttgaaggatgcgtccgtccccaggtgcctcccccacatgtttccacctccagtcccgccgctttgagcaatgagatcggtcttgccaaccagaaaagcatgacctgagatcctccagacagaaaagtggacacaagaaaatatcggtctgagccaaaggagtactctgggaatagtgaaccattggcaggtcatcaattcttcagcatgaaagagcagtaagcacttggtcagtttaaacagaggtatgccagctcggtgggctcccagggttcccaataaacctgaatttcagacccgattagcaatttttgtgcacaagggtaatcacttagaaatcaatgttattgtgtataactgatttggagcatcttcattctcagaattgaaaggatacgatggttttatattattgtctttagggagcaagtacaaagtgtatgtgagagtggttgtgtgaatgaactatatattttttttcaacaacagggtgcgggggttatactacggaaataatacattggtatgggctttatatattgg

SEQ ID NO: 587473 - DNA, 876 bp, Homo sapiens
  misc_feature (3)..(3): n is a, c, g, or t
ccnccccataatagcataataaaaacatacaaaataatcgccgaacacgcccagcttgcttgtatgtaacgattcgctataatactggggcaaaacaaatatagtattccctcgaagtctcttcacttaatgttgccccacgttttattatacccgccacctcttattaacccgttacctctacagcaatagttacagttcccagtatatacacacaatcttgttgtcgcacctataatctctttagattttcccttcttaatgccttctgatccatctgcccccggggtacaattcaaccccttcgcgatatacacacatgtaaaaatcgcagacccggtgtgtcgcccatcctggctgtcctctagaacgacagtctttttttccaaaactgtgatctatagtagttacacgtatccattttcacaaggacgtcttcgattaataatctacccccgtaaaggaaccccccttgcttaccctgtagtccctgagccagaataaccagtgcattctttaccataagggccgaataggcgcactaaataatatactgattacacttccccggagtattacaaaatttgtgggggagaaaactttggtatcccccagcgaccacacccgaggttttttttaaagattaaaatatgagtaatcattttgacatccacccagaagaggaacatctaatctcatatataatcaataatcattagtaggggagtccccatcaccaccccggtcttgcatcactggccctgataagtagtaggaacctcaagatcgttgtgaattcctatttttcctatttggctctcgtttaaaaaattttattctccaaacattttttcagtattcccagggaacaaaaca

SEQ ID NO: 587474 - DNA, 809 bp, Homo sapiens
tactggtcagggtaacactactgattacggggtggccgctctccgacttactcttggttttctctccagacattgtagaatggcagtggtcaagaacagtggctcccagacttacattactggtttaacgtgtatattcctggggcattccccacggggccagtggacaccgggcacacgcggattgaagaagggcataatacctcctggttggagttgtttattcacacatctatcttatttgaagaaaaagactgagtgtatagaatctttggtccttaaagctgaacttttcaagaaagtattatcgaaaccttcttaccttggacctgggtatatgaaaacttactgtttgggcggttcctaatgactgcggtaagctggggttcccgggaataacacacgaattactgggtcataaggcgggtgggtccttggtgcctttcatacgaagctaactattttccaaatagagagtgatactggggtaacttctggtatattccaagaaactgtgtaaatctttgtactcccgtccagggagaactccttctatgggttacgtggattcaaaacgctgaatggtatattattaattaaaacaaggtatcattgaccttcatggtattggcaatcttcggttggcgcattgccggtgtgacgtaagaacccaaatcggagaaattcagtatgcagggatctcaggttcctaagtaacccatagtattaacacctttagaatgtgcattaccgcaggttcttggtacaaacgtgcggtgtggcaccactagtgcagcgaaatttttttg

SEQ ID NO: 587475 - DNA, 244 bp, Homo sapiens
aacgtaggcaaagtatggtaaaaatatggtatagaaaattaaataaaaagatatacctgtatagggcacttcatgagtagagcttacagcactggaatttgctctgagtgaatcagcaagtgagtggtgagtgaatgtgaaagcctaggacattactgtaccctactgtagattttataaacactgtacacttgggctacagtaaatttattaaaatttttctttaataattaaaaaaaaaaaa

SEQ ID NO: 587476 - DNA, 341 bp, Homo sapiens
  misc_feature (279)..(279): n is a, c, g, or t
  misc_feature (302)..(302): n is a, c, g, or t
aaatatgttttagggccaggtgcagtggctcatgctgtaatcccagcaacttgggaagctgaggcaggaagactgcttgaagccacgagtttgagatcagtctgcacaaaatggacctcgcctctacaaaaaatttaaaaattatccagacatggaggcaaatgcctgtaggcccagttacttggggagttagcctaccgtacatggggggaaaagttagccttgtttgcctggggaaataccaaggataatctggggcttgcacgtttcttaagggantttaatgggctctgtttgacttnggtcttttggggaattttgcatattacactttctgggta

SEQ ID NO: 587477 - DNA, 335 bp, Homo sapiens
ttataagggacaggacttgctcactcggagggctcaggctctacgagacaggcgtctagccgatagacctggaccgaataaagcccttccctctttacgttggtgtttgcggagttttgtctgcggctcgtcctgctacagatgaacagaagtactattaccctacatgcagacttgcggaacagacatacagaggttcagcaacaaaccttaataatacaactaaacaggtacagagctacaaacagaactagagcctttttatcttgccgctcattccattaaataatactgcggtatccaggcggctcgggcctgctttgaccactctacat

SEQ ID NO: 587478 - DNA, 130 bp, Homo sapiens
ccccgtgcagaatatacctcggggggctgcagctcatctggggggagctggactcagatgctcccgtaggtgcaaaagcaactatcctacatctctactcctcccggtgctttttgcggtattcctgaag

SEQ ID NO: 587479 - DNA, 907 bp, Homo sapiens
cctgttttctccggacacctaagaagtcgtcctcctaggtactaacttaggctgagtacctacctgtcacacgtcactggcatagctgaaggaccaactgtgtagtccaggtgagagcatgctatcatggaagataaaagcatctacctcgtctaatagcgtaggtcgtcgcgcatagcagagatgtccttaaattatagagctgttgacaggagcacggaagctgatcatatttaattatcgttcttgcggataacgcatcacgtgtgatccgccgagcgcttggtgtatcatcaatcgccgatgaggctatcagtcagaaggcctgaacgcaggcacatacttcctattctacaccctaggtaggcgtcccttctccctactcatcggacgtaagttgtacacttcacaacatcctaggctcgactaaacattctactactcactctcactgcctcaagaagcgatcgaaacgtcctgagccggacaagctgtaatatgactagcttacacaatatgctttctatacgtaaaggatacctctttacggagctccagttatgactccctaaagcccatgtcgaaggccccagtcgctgggtcaatagtacttgccgcagtactcttagaactaggcggctatggtataatacgcctcacgctcattctcaaccgcctgacaaaacacatagcctaccccttccttgtactatccctatgaggcataattgtcacaagcttgatctgcctacgacgatgagcacgtaaatcgctcattgcgttgctcttcaatcaggccgcgtaagccctcgtagtaacaaggcattttcattccaatccccggaaggttcacgagggaacaatctcataatcgaccaggggttaaatcctcagaaatctgcgaaac

SEQ ID NO: 587480 - DNA, 196 bp, Homo sapiens
gggcccgggcccccgggagggcccccaaaatttttttttgggggggggggggtttttttttttggggggggggaaaaaacccccccccccctttttttggtgttttttttttttccccccccttttttggggggaaaggggcccctttttttttttttcccccatttttcccttctaaaaagggggggggggggga

SEQ ID NO: 587481 - DNA, 336 bp, Homo sapiens
agtcgggcagggggtgtggatgtgggactggtctggggcagtcagatgggtgacctctgcctgcggggaagggagtcgcaggcggcgtcatggcggtgtcggagagccagctcaagacaatggtgtgcaagtccaaatacagagacctaactgtacgtgaaattgtcaaggttatgactctatacaaagatctcaaatctgttcgggattcgatatgttttgaacgatggcagttccagggcactaatgaacctcactggaacgatccctgtgccttatcgaggtaatagatacaatattccattatgcctatggttaggggacagatacccatat

SEQ ID NO: 587482 - DNA, 133 bp, Homo sapiens
tccctctaaacatatcccgtgagatgttgcaacaaacgaaaattttgaaggttatcaggaagaatttggtcaaaaattgcttagatctctttactgacctggcggaagataaagcctacaagaaattctatga

SEQ ID NO: 587483 - DNA, 117 bp, Homo sapiens
aactgcaaagcgaactcaaaaccggctcttgctcagcctatataccggcatcttcagcaaaccctgattgaaggctacaaagtaagcgccagttaccccacgttaagacgttcaggt

SEQ ID NO: 587484 - DNA, 502 bp, Homo sapiens
ttgaactgtgctttaaaaaaaatcttatctgcatgtattgttaacttagagaccatgagatctatttatcaggaccaggaagatacacacttcaggtccattgcaactgacttttttcttgtttttctcaaaccctggtggagcctgggaagggggcctccacaattctgtggctttgatattagccccaattctcacaagcacatacaagccccataattgccgcaggaaaacacaagatggaaaattgcaataacccatgcactgagacttagaaaatcatccttactaggtaaaatgtattatgatgcaataagtgccaactggtatttctcacgttgggactggccaggaactgctgcaaagaaaaataagcagctccttctccattatttacattttaagatgtggtggggggaggttgggagaaattagttctgaggttatcatatgccttttttaaaagataatggaataaagctatttttaagtaaaaaaaaaa

SEQ ID NO: 587485 - DNA, 184 bp, Homo sapiens
tgtagactccagttagctgtgtgttcaggagcaggaatatagagagcccctactcctgttcatttgaggccattctttcagaaatctgtgctttcatacactgaagattcgatgattgctgacttctgtggaaccctcgtttggcttcatgctaccgtagatctgacttttaaagagtcatttt

SEQ ID NO: 587486 - DNA, 219 bp, Homo sapiens
  misc_feature (64)..(64): n is a, c, g, or t
  misc_feature (66)..(66): n is a, c, g, or t
ctctagtaggatcccctccaggtacaacagctcacccatcgctttccgtcggggccgggagatnanagtagtcacttatgagctgttgtaactgggaggaggatgaccgtgcttgaggaggaagaatgggttcaagaatggactgcattaatctcaatgaaaccatgcaggagatgttttgtttcaagttcactgcatccagccagctgttgtaactgg

SEQ ID NO: 587487 - DNA, 965 bp, Homo sapiens
cgctggttagtaattgcgccaataaataactttctttgtggcagttagaattactaatatttggtacaaaatatggtttacgacacctacgcgccccttatttcatgtaaggcccctgtctatgcggcggccctcttattctgttccttaatagtgcggtttcaaaaaaaaaacattgctggggtagaatacgccccgataaaatccgcttttccgccgtcaggagcgcccccccactaataaatattttcggctctttccacaataagaagaagtgcttaaatcttcctacagtcacgcggtgtgaacaacaacggttctaaatattatgttaggtgcccactcacgcactagagtgatgtatgacacccacggtgttctttctgcccagcgctccttgtcaggtcccacatagtctgttcctgggtgaagtagtcatttcttttttcttaacaagcccgccgccacacaaaattgctgggcaaacaacagagataaaagggtggagaacacacggcttgatctttaagtttggagtcctaccctcgaaaccccgccccttgttagaatgcggggtgtacatacaaaggaaatatatatatttgtacagggaaagaaaaaagtacagacatatgggatccatctggatgcgtggaagtgcccacacaccgcgcgagattcttgtcttttggtcatttcagagagatattcgtgtgaatcaccatataaaggtcagagtataaacacaggcccacgcctgacatatattgtggggcgcacactgtcgaacactgccagcggttacacgcacaacatttatgagcgtgcccgacggggacatgcaacacacctttatgtgggggcttaatcaaatggacgtggattgtcatctgtacgggtttttagttatggagacaccacctgtctaaaaaaaaacaatagaaacatttctcccaaaaaaaaca

SEQ ID NO: 587488 - DNA, 387 bp, Homo sapiens
cggcttcatcgttcagtccgtggctactgtcttgatattcatgtctggaagatgaagatctggcatttaactctcgaaattactattccatagttcagcccgagagcttttcaatatcttctatactatcaattgagttcctgaccagtttctccttgaatggtcacattttccctcattagcaccagactgtacagcaagatttgctttttgaggaactagctgatctaggtcttccaccaatgacttctggtcttgttattccaaaagaagcttatctccgagtgcgaatgtcctgcaatgggtacagcctgcatgtactcacacatgtcttccacgattcgtctactggatctgtctgtacttggttatgaaattcattatcct

SEQ ID NO: 587489 - DNA, 334 bp, Homo sapiens
agcggctgcgctgggtatgcggtcccagagggtaggtcatccgcgtttacccagcatttactcagtgttaggctttcctctcgcaggcactctcagctctaaactgactcaggtctcacaacccaccaagataagtcttcgtcatgttctcatttatggacaaactaaccagagcacagaaaagttaagcaatctgtccaaagtcacatagctagtaggtgatgaagcaagatttgaaccaggaacttgaggtccagagtccacaggtttcaacattatgtttttaccgcctcagagaaataaggctttatgagaggctgtggacattgcaggg

SEQ ID NO: 587490 - DNA, 183 bp, Homo sapiens
actgtgtggccgtcgctgcagactgtctgcttcgtcgatccaggcccccagtgtgaccgctgtcttccagatcatctttcccatggatcaccggctgttccttggtctggctcgtgctcgccactgccgtccagcctgttgcccagcgcctcaagttccggctgaacctttatgagcttgaag

SEQ ID NO: 587491 - DNA, 166 bp, Homo sapiens
gtgtggtggctcacacctgtatcccagcactttgggagaccgagatgggggggattacgtgaggttgggaattcaagaccagccgtggccaacatggtgaaagcccatctctaccaataataatactcttaccttctcttttctaattccatttattcttcaattt

SEQ ID NO: 587492 - DNA, 153 bp, Homo sapiens
agtcatacgtcgggtttattctcttctattctattctgttctgtttgttctattctattgtattctcttctattctattctattatattctgttctattctgttctattctgttctattctcttctgttctgttgttctgttttattctattc

SEQ ID NO: 587493 - DNA, 876 bp, Homo sapiens
  misc_feature (225)..(225): n is a, c, g, or t
tctcacggacacagttcttctccccttgggtttcctcgaacatgtggtggccacactctccacgctatatataatagggtatattttttaaagaaacgcaccgagtggggacccacagagatatagttgtttttataagactttgggggagagtttctttcctcgaattcttgggggtcctctctctttataggggggcccacagcacaccacagagaaaggtcnctatgccgttttttctcgggagagcccacacccctggtctccccacccctgggtgagccacaggtcaccttcttgtgggcacaagcaaatctaactggggagaagggcaacatatatcctgcgaggagcccttgtccttcccgtatggtgagcctggtgatagatcacagttggggcaccatttttttatgggaatgatcacagggcccttccagggtggaacacatagtcgttcccacagctctttgtctagataggcacagcacggaaggcgctcttccctctacgagccaagctatccacaaagtgtcccacagggatgccactccacccaacattggtccctcttcacagtacctgcaacgcacgtggtgccccacggctttcttcctaaggaattcccacagtggcacatttaatcacagtggccacagctaacctgcccaggccccgggcttggggcacaccgttttcggccactgaggcccggccgccttccgcacccctaccccgctggcagcagcatacctttgcaattttggaaagtgtgtgcatccatgaagtttgtatatttgaggcctttaaaatctattttcgttaacgagggccaatgaagaatgaatattgattctttaaaaaaggaaagaagac

SEQ ID NO: 587494 - DNA, 286 bp, Homo sapiens
  misc_feature (157)..(157): n is a, c, g, or t
  misc_feature (222)..(222): n is a, c, g, or t
  misc_feature (225)..(225): n is a, c, g, or t
  misc_feature (277)..(277): n is a, c, g, or t
ttagttcctttggagccctccattgtctgagtctgcagtgatctgtaggaaggcagctggtcaataatcatgtagacaatggcttggaattgtaaccctatggttattgattgcctgtgttggttcaggcatacttaggtatgtcctggggaaaaanaaaaccatcagcttagagttgctaccatgtctttgggtagaaataatggtcatttttggcctggntgnaataagctctaaaaggtctggtgactgaattgaacatgagtccgcatgctgnttcttcggt

SEQ ID NO: 587495 - DNA, 182 bp, Homo sapiens
ggttcccgaggcgcggcgggcgcggctgggggcggcgtgaggggggcgcaggaccccaacgtgggggtcccgggagccagagtggccaattcctgtcccccgcagcagcatggcatcgtgtgctgaaccctctgagccgctcgtgccccactgcccgccggggtcccagccgcgtcgaggac

SEQ ID NO: 587496 - DNA, 584 bp, Homo sapiens
tggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcaactgggcagcatggaactcaggccaggctccgaggctgggggaactgcttggagttttctgccccccaccccaaacttctgtcgaggagcaaggcttgccagcaaggcaaaaggatttgaaccgaacagccaaactttccagcccctccctaccgacccttggctggaaacgcaacaacccgggtcccccaaggcctctgggttgggggaataaagcataattcgctggggaaaaagtcaacgtttagccaccttggagccccctaaccagggcccggtgggttaaccccaaccccttttctggcgggccaaaggattggtttctgaagaaaggccacccttccat

SEQ ID NO: 587497 - DNA, 227 bp, Homo sapiens
cgatatggtggtgtcggggactagagggagtggggaatagggagtatgtttaatgggtacaggatatagtttgcaagatgaagagtttggagatggttgtacaacaatatgtgttgttgtgttgtgttggagacagggtctcattccgttgccgaggctggagtgcagtggtgtgatgatcacagctcactgcaacctcaaactcctgggctcaagcaatcctccca

SEQ ID NO: 587498 - DNA, 402 bp, Homo sapiens
tctagaggacctggcgatgtccgtgcatgtctccaaggaagtccaaggttgctttggacattaaatccccaaatcaggagaaccataactgcccaggctggtggcatatactttggttaccgtgatgccaccacacacggtcacgactggtcaaaatactggctttccaatccttaaataaaaaagaacttccacaccagctataaaaatgttgccacaaaaagccaaactttccttctaagaaatattaactggatttggactataaactaaactccagatttggtaaaggttacaggaattggtaccataaataattatatttgggtccataagtaacattctataaatcttgaagacctagctcacaggcatcttggaacatggcacgcgacatcgcca

SEQ ID NO: 587499 - DNA, 295 bp, Homo sapiens
tagaggatcccctcctagcctcggtagttgcatggtgtatctataccagccagactggctgttgctgcttaaagacccagtgtcctggttttatgcttgagtgtgggctgttcccctttgtggtgcaccagaccagaatgtgcatggctgttcccgtgattgatgagaactgttagaatgagaaggaatgagccagtgatttctccactggcgatggctagtgacacttggctgatgtgctatgaacaaagtgggctttcacgaaattaagcctatagagaatgagcttgcttgt

SEQ ID NO: 587500 - DNA, 973 bp, Homo sapiens
attactatggtggtgatttgtgagcataggaatggtttcccttttctagagcattcagtcttcagtgtttttagatgtcacgatgacctcagcttgactaagttattcataggtatatttgacttttgtctggtcgcttgtttcttgggctttggaagacaattttaaaaattattttatcaccattttcattatataaatggctacttggtttttctagactgactttattgtactacttggtgaagtaatgattggatgtaagagtcttggtgcggcacttgggtcttttaagactatgaacataggagcagtcaagagcactggctcttttcctagaggactgaggcttgattcccagcacctgtgtggcacctcacacctgtaactccagttccaaggaatccaacaccctcctctgatctctgggcatcagacatgcgcatggtgcacagatagacaggcaggtaaaacacccttaccaggtaataataataattttaataagatgatcatattatctataaatagagatttggcttcattttgcttccatttttctttcctccatgctcagggttgaaccaagggagcttgtatgtggtaggcaagaggtgtaccactgaactgcagcgccaaatggatctctttcctttctcttttaatgtctagcttaggtgccgagaatgtgtcccgcgggttcaagaacgtgtgtgactgtcttcctgtgtaactccctgaaagtttgagaagacgcgttaagtcccaaagggcataacctgggcccagttgcgggtggaacatttcttcacggggggttttccctccaaatcggaatataccgggagaaagctgaggcctcctatatgggggcacggaccggattactttacaaggtattgggagctattacaaaccccaataggaaaggccgcgaaataattacaggagatcgagacagagaaacaaaatg

SEQ ID NO: 587501 - DNA, 326 bp, Homo sapiens
agaggatcccttcactaagagcgccgtgtatgataggggcatagggcaagattcagcgtaggcggactacgaacgatggttctggacagatctgtctaagaggtctctgtcatttgataaacccctagagcttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgttt

SEQ ID NO: 587502 - DNA, 158 bp, Homo sapiens
tccccccccccccctttgggggttggccctttttttcccggggggcccccccctttggggggcccccgggttttttttcccccccccccccccccccccttgggtttttttttttttttttggggggggggagaataaaaaaaggggttttttttcca

SEQ ID NO: 587503 - DNA, 327 bp, Homo sapiens
gatcttgccgtcctcgaaacgcaccgcaatgttgtagatcagcgtgccctggtaggacagcggcttcgaactcacgacatggccatagacccgccgccaatgcggcgtggtgaagacctcttcggtcgggatgttggcgttgcagctgatgccgttcttggcggacgaggccccaccttcccactcgtggccgtccgcaagcccgatggtgaggtcggtgccgggacccgaatattgcagcgcgcgggaacgcaggccgttgagccagttggtgcgctcgcgcaagaccgcattgtggctcgcccaattcgaaatcgcatccccgcg

SEQ ID NO: 587504 - DNA, 535 bp, Homo sapiens
acgcgagtaggctgcggcacacttcaacgcattgaacaacacaatggactgggacacgatcaaaccgatacccagcaacgagtaacccacatgcaggaaaatcgccgaaccgacgcccaaggcccgtccatgtgccagcacggcggccgtgggtcacgctttcacgcaccaccacggcgaaatccgggccggggctcgccactgccaacaagtgaatcaaggctacggtcaaaaactcggcgacgtacgtgctcactccattaagtaactgattatttcatctgataggctcggcagattacgccttcgaacctcgtcgcaaaaggtacagttgatcatgaacaatcgccgcgccgtcttcctcgaccacccttccctggacttgggcgacctcgacctcagcggtttgcatggctgcttcagccagctgcagttgtttgaacagaccacgcccgagaatgtgctggagcgcttgcagggcgcccaagtcgccatcagcaacaaaatcccgctcacagcccaaaacctggcggcc

SEQ ID NO: 587505 - DNA, 302 bp, Homo sapiens
taaggttttcataatttatttatggaaaaatattccaaatctggtggattctctccagtcaaaagttcttggagacagaggccatcgggcctgggccaatcgggagaagggaatcatctggactcacccatcctacgaagggccccgcagatagcataagttttaaactgggccattaaacctggccggttgcacctggtcaacctcgggccacggttcatctgggatgggatcgcggtgggtccttgggcaccggatgatcgcagatggctagcgggagcatttccgggggacacgtacag

SEQ ID NO: 587506 - DNA, 376 bp, Homo sapiens
ccccaatctgcaggacaaagaaatggctgcccttttcaaaatgccctactttccccaacaacaaaaatcacaaattgtatttaaaaaaacaaggccgggtgccgggtggtcacgccctgtaatccccagcactttgggaggctgaggcaggtggatcacgaggcccaggagatcaagaccaccctggctaacacggtgaaacccttctctactacaaatacaaaatattagccgggcgtggtggcggacttctgtagtcccagctactctggaggctgaggcaggagaatggcatgaacccgggaggtggagcttgcagtgagccgagatagcgccactgcagtctggcctgggcaaaagagtcaaaaaacgtctc

SEQ ID NO: 587507 - DNA, 187 bp, Homo sapiens
tcttggatgcggatgtgcgtctccaccctttatcttgatacatttgagggaccgtttgtacttggagatcttcagtcaactccatgtgcgcgccgctcgtagggggcaaaggcacacagctcccgtaatcatgtcccgatacgcaacttggtgtgtcatggtacagaccgcccgcggcgtcccgctg

SEQ ID NO: 587508 - DNA, 403 bp, Homo sapiens
tcggcagcgtcgttgagttgactcaccgtccttcagatagaagtgtcgtgacttgtataactctgccgggataacactgagctgctgaatagcaaggcaagcatcatgataaggtgagttatcttgattcttctggtctaggcataagagatctgcttccactcttttacaccttctgtggcatagcaacctcttgaggtaccctcatgtatgtcattggcattgaaatcatgtctccagaatgtcaggttcataacacctgtgacgtccagagtcgccatccttcacccctaggttactatgtgatttctcatggtcactgcttagaagtctgtctgtgtctgattcctcagtcttttcatctggctcatcaatatctagctcaataaattcaacccaagag

SEQ ID NO: 587509 - DNA, 393 bp, Homo sapiens
cagggggcccccccggtttcccccttggaaagggggcgggggggccccccccattaattggggttggccccccctttgggcccccccgggtttccccttttgggtcccgggtcgttttttggggggaattgggggggggaacccttttccccccgggccccggtttgcccggttttcgatttttaaacccccccccaagggggattggccccccgggccccaaaattgggcgcgggggcggttcccccccccggggggggggggggaaggggtttttgggggcggggacccaggggttctttccaaaggaaaccccgggggttgggccccccaggattcttttttttttaaatttttgtcccaaaaaccggggaaaaaaaaaagtttttccca

SEQ ID NO: 587510 - DNA, 1120 bp, Homo sapiens
gcagttactgagaactcatatgacgaagctaataatcgcctcttcggatccactagtctaaccgcccgtgattcactattcctgtaaaaacacgcccagaggaaatgagagcgccagtgtgtcttactacagaataatagtgcacgctagtctttctggtctagcagttgtccgtgtgtgttacgtcgccatgttctaccatttcctgacatcctgatggttgcacggattaggccacattagagtcgcatctgactgaacgaagtgataggaagcactcgaattctttctcacccattccgaggatgtcacccacattatctttcagttgcgttggtgacttgcctgtcttgctctacatggcgatatcccacttcctcttaaggtgtacctagaggtagagacggcactggtctgggtcccaccataaggaacgtctaacgcttacgagggagtttccgacctttattcttagtttgatcaggcattaacacttacgattaattaatatcaagcgcgattcaatcacgttaaaatcgcgagcggagtgtttcctcattgctggctcgagaaggcaaagccaaaccaccacgaggaagatgctcccaaagtggctcaggaataactccttggcttctatctgtatttctaactggaaacgatctatatcccagtactagattagtatagcgccaaaatgagtggccagtcgacatctctgagtgtcactcgcgagcatggccgctggcacgtctctttcccttggggccaaacctggggccgcttaacattaaaacgcatatcggctgcgcacaaacgctcggactctgttagtctggcaagcccattactgtgggactcgccgagagcaaattgcacgacacgaacccgtttgtgatggcaccgtctctattctccccctttttgaaacggccaagttgacaccgcccgagaccattgtctattgggaagtcagacccggccatgttcactagcaaggggaaacgttcagttcagcgttgtgcccagcgccttacttcgtcaccccgtgggacctctcttacgcccgattgccccctctaaattccaccctatatgcacgggcttagcgatccagttc

SEQ ID NO: 587511 - DNA, 530 bp, Homo sapiens
gggcaacagagtaagactctgtctcaaaaatgaatgactgaatgaatgagcgaatgaatgtactatgagctgatacgtggatacaggtaccgcagttttgtgctgaatgatatgtctggggtaaatcagtttttttcttatagaattcggcgttgtgctgcaattgcaatatttttgcatttaaaagacacaaagagaggaatgtattttccaaaggagtgaatgaggttaaaatcaagatttgtgaatggtataattatgcaactaaatccagtggtagggatatcatcacaatttttaatggctaaatatgtttctttcatactgttgcagtgcttacatgttccaaacaagccttttccaaggaaaaacttttccatatttggtggtcatttggtaaagtatccttaactacttgtcacaaattaatttggcgattattccaacttttacattgtatgtctgaatttcatcgatgttgtaccttggctcagtcaatagttgtcacaggtatcaagccatttggcact

SEQ ID NO: 587512 - DNA, 204 bp, Homo sapiens
tggcatccatgggaaagtccatggcttaaaaagtcttaaacctacggatttaacagtatgggaaataaccctacttaggacatggtaaattataggtaaggttcttcctcgggttaccggaacgggtgttatgggatgcccaggtttatagagggtccaaaatacaaaatatgattcaccgggtgtgtagacctcaaaagaaat

SEQ ID NO: 587513 - DNA, 165 bp, Homo sapiens
atctcagcctgctcacagtggcatggggtgtcggggtaaggctgtccagctacttcgtctctgcaggaccctaagccctgcccgcagccacatgcctctgtgatgagtggcgtctttcctgcctctgatgatggactcaataaacagcactggacaaggctgctg

SEQ ID NO: 587514 - DNA, 393 bp, Homo sapiens
  misc_feature (270)..(271): n is a, c, g, or t
gttgtacttagaaaggacaacaaatttttgggggtcacttgggggggggttccaaggtggttttttatgggggtttttagttttaggggcattttgggggggttttaaaagggttcttccgggtcttcctaaaggtattttttgttgaagaaggggggcttttgggggattaccatgggggggggagggtaggggttttttagctattcttttttttcaaaggtttttagggaggggggggtccggaatttttttgtgagggggaatttnnttggcccccccccccccccggcccttgggcggggcccctttttggggaacccattttcatttgttgttgattcttttttttttttaataggattttccctccaaataaaacatggttggtta

SEQ ID NO: 587515 - DNA, 736 bp, Homo sapiens
gcttcctcctgcgaatggaccgcgcccacgaggccaagatccgactactacacctacctgatcatgaacaagggcaggctgttgaaggcgggatgccaggtgcgagagcccggccaggacctggtggtgctgtccctctgtccatcaccaccgacttctatccctttccttccggctgtgtggcgtactacacgctgatcggtgccagcggccatgagaggacggtgagtaggccgacgtcccgtagctgtgagtgagacagtctaaaggacatccatgccgtggtgcttctgcttggtggtaaaaaggcggccaagtcagaagaccggcagcctgtacctgggcagcagatgaccctgaagatagagggtgaccacggggcccgggtggtactggtggccgtggacaagggcgtgttcgtgctgaatacagaagaacaaagctgacgcagcagtaacgatcctgggaccgtggttggacgaacggcagacatcggctgcaccccgggcagtgggaaggattacgccggtgtcttctccgacgcagggctgaccttcacgaagcagccgttggccagcagaccagccagagggcagaacttcagtgcccgcagccagcctgccgccgaacgccgttccgtgcagctcacgggagaagcgaatggaccaaagtcgggcaagtaaccccaaggaagctgcgcaaagtgctgcgaaggacggcatgcgggagaacccca

SEQ ID NO: 587516 - DNA, 1243 bp, Homo sapiens
  misc_feature (38)..(38): n is a, c, g, or t
  misc_feature (1241)..(1241): n is a, c, g, or t
  misc_feature (1243)..(1243): n is a, c, g, or t
cggccccccatggacgcccccagacacggggtcgctgnagaccaccgcgctgtcgcatgcccagtcccggtccggcgcgccacgccgagggatctctggacaggacaagactccgaagctactcccccagcacacagcccgggacccacaaacccagcttgcagctgggtacgcgtaaggcagggccccgtcgagcggactaatcgtacagcaggacgccgactatatacagagaataagagagagaaatacaaaacgtaactccagagagtattataaaaagaactagcacgatgactaactaagaacaaacatagtaaaaaacacaatactaatgcatatgagacacagacaggatctgataccacaaagagacacaacaaccacacacaaaacaccatgaacaactagacaacaagaaacacaaacaacacaaaccagcgcaagccaaaaacagaacaagcaaacagcaccacaccgacaaacacccacgagagacagagaagagcacacaacaacacgaacagaaaacaccacccacgacacgaaagaaagaaagagaggcacgagcaaccaaaccaaccacgaaaaacagaacacaacaccaagaaagacaaagacaccacaaaggtagcgaaacaagaccacgacaaaaacagaaacgagacgacacacaagacgacaaacgaacaggagacagaaagacaacacaaaacgcacacgcagacaagaaagggagacagcaaggagaccgaacgcacgaacaaagcaagcagaggggacgagagcaagaagagacgcgaagcagaagaagagcagaaaaaagaaaggagagaacggagtgaagacgaggaagaaggacaccgacagaagagcaggacaagagagacgagaaacagagacagagagcacaccgagcacgagacgaccagagcagcacagaccgagacaacagcaaagcacagacacgacacaaagcagaaggaggaaaccaacacaaacaccagaggaacagcagaacaacacgagacaaacagaggcaacagaaccgacgaaacaagactacgtacagaagacacgaaaataggcagaaaaaagacagaagaacaagacaaacggcaacgaaaataccaagcagaacgagaaagaagaggagcaacaaaagaaaaacaggagaaaacgacagacacaaatgaagcagataaaaatagtttctctcttctgcttgcgtcctcacacgnan

SEQ ID NO: 587517 - DNA, 344 bp, Homo sapiens
  misc_feature (3)..(3): n is a, c, g, or t
  misc_feature (15)..(15): n is a, c, g, or t
  misc_feature (37)..(37): n is a, c, g, or t
  misc_feature (229)..(229): n is a, c, g, or t
  misc_feature (270)..(270): n is a, c, g, or t
  misc_feature (273)..(273): n is a, c, g, or t
  misc_feature (298)..(298): n is a, c, g, or t
  misc_feature (306)..(306): n is a, c, g, or t
  misc_feature (315)..(315): n is a, c, g, or t
  misc_feature (320)..(320): n is a, c, g, or t
aancctacctgtccncctgtcctttgcctaccctccngcgtcctttccttcacagaaaagtatggggaatgaaagtgtccatatggaagacaaaaaaaaaaaaacattgtctaggaatcagtagggacaaaagaacaggtgaaactgaagtgtatggagagatttagggagtacagagtgacagcattggacttaggacacagactgcagccagactgtctgggttggnataccaccttagcctttttttacctgtgtggtcttgggcanaantactccctctctgcgttagtttctntatttgtnaaatggttntaatnaaaatagtgcctatcgaaaaaaaa

SEQ ID NO: 587518 - DNA, 119 bp, Homo sapiens
tggcggcagacgcacaagtagtctgacatacgactcctcgctcagaagtcttcaaatactcctcctacggaaaaagtcaaactttttagccgggcctaatttaaagctcttactgacgt

SEQ ID NO: 587519 - DNA, 232 bp, Homo sapiens
gggatatggatatgggtggatggacagatgttttgatgaatacagctgaatgatgggtggatggacagatgtttggatgggtggatggatggatggtgggtagatgagtggataggtggatgaataatgggtggatagacagatgttttgatgggcgaacagatggatgatgggtagatggatgatgagtgggaggacagcttgactgatggctcggaggttgtgaacgagt

SEQ ID NO: 587520 - DNA, 277 bp, Homo sapiens
atccccctagctacttgggaaagctgagatgggaagatcgcttgagccaggagtttgaggctgcagtgagctgtgatggcaccactgcactctagcctgggtgacagagcaaaaccctgtctctttaaaaaaaaaaaaggaaagaaagaaagaaagaggcctggggtgggggctcatgcttgtaatcccagcaacttggggaaggccgaagggtgggtggatcaacctaaggcacgaggaagttcaagttccagcccgtgggcaaaacataggtgga

SEQ ID NO: 587521 - DNA, 725 bp, Homo sapiens
  misc_feature (711)..(712): n is a, c, g, or t
  misc_feature (715)..(715): n is a, c, g, or t
aaaagaaaaaaagtggggagatatatttttaccattaggggggggggggtggtccccttcccccggggttttctttttttataaaggggggggggggcccccgcccccaacaaaaaaaaaaaaaggcggggttgaatttgggggggtttttttaaaccaaacctttttagggggggggaaaggccaccccccccttctttttgtgccggttttgtggggggaaaaaaaaaaaaaacccgcccccaaaaaaaagacccgcccaaaaaaaaaaaaaaagcgggccccccaaatattacttctccaaaaatttttttttttgtgggggagaaaagtggggttttttttaacaaggggggggataataaaaagaaaagtcccggcccccccccctttttagaggagaaaaaaaatttttttttcccccccaaaatataaaaaaaacacccccccccttataaaaagggaaaaattgccccccccccgggggggcgcccaaaaaaggtgggtgtaaaaacccccccccccccaaaagtgttgggaaaaaaaaaaaaaacatttgccaaaaaatttttgggccataccccccctaagggaaaaaaacctttgcccactggaaaggttccccaaaattttctttccccccaagtttttgtgaaacagaaacctaattttcccaagtagttatttttaggtgatatccccaataaatanntanatcatatgtc

SEQ ID NO: 587522 - DNA, 663 bp, Homo sapiens
gagaacttgttcgagtttttttttttagcccagatggtgtgtctctatagggactggaccacaccagtcaggaagactcatatcagagtttgattgcgtatttctccatctacccacccccgactcatccatcatcctctctccctctctcctccctccagttcatgggaagttagcatgagcattctgccagcagactatggagaacagcgcaggggggtgaaaatgaagagacagttaagagagcaatacacggggctaagaggccaagctgatctgctgggccttacacctgggtgtatcagtggaagtgtgatgtggacagagcacctgagcttctctccagcttaggagcagtcccgcgttgcgggaaagggagggggttgttttttgtggcttttgcttgctcccaaccccatcttggaacaagtgcctatcgtgtgtgctgtgtgatcctctaaggcctgcctatcttccgggtggaggatttctgtaacttttggaagtaccatcgctaggcaactggtggtttcttgctttcataaatgaagcccctcggtcatctcggccctctttcgtaatgaacaggtggggcgccggttttgtgggcattaacccacaccctcggccacgccagcggtccctggtcgttctgtctccccc

SEQ ID NO: 587523 - DNA, 999 bp, Homo sapiens
ggtgaacatgcggcgccgttgtgggggcccgggcagagctctgctgcgggcgggcgctggacggctgcttcggggaggcgtccaggagctactgcgtgccgcgacatgaatgggaacagcccctgacctggcctgcaacttcagcctttctcaaaatcggggcacgggggggcgtggagcgctggtggaaggtaccggctggccggggcagggccggcaagccgcgcctgcaccggcgacatcgacgtctataaggctggtggaggacacgaaagcatcggcccaaaagaaaacctggagctcatactgacgcagtcgcgtggagaagtgcttggagatcacggggctgaccctggtctcaggtgaagaaacatctttaacgcccgagaatcgacgtcacttcctcaagggacatggggctaggttcatattcgcattccccgcgttgaacaaccagaggagaggcttggttttgcacacgatgcgtcagccccacttcggcgtgagggagccaaggaacagggagaagactttagaagacggactcacagaacctaaggggacagagatcgcaggccggcagaagtggcaggcttccttagcgaagcgtgcgtcgatcgcccatgggaactagctacgcggcaatggaacagaaagcacaagtggaaccaaatgatgggggaatgccttggaaaagccacgtgaagacgtacggtcagccacgagggccacgcgactcaatgtaagagacaacgtcaataagggagaggaatggcagagtaatgaccaccaagcaataaagcacaatacacagggcatacgcagagaacagagagccatatatcaccaaacgagcgagacgggaagacactaataggggtgacagcagagctgaaacggggaccacagcggagccgatagaaacatagagaacaaagcggcaaaacaacgagatgaagagggagcaacggaagcagagcgccagagacgcgcaacaaa

SEQ ID NO: 587524 - DNA, 180 bp, Homo sapiens
tttttaaaaagggggggtttttttgggccccccaggaaccccccctttttaaaaccaaccccgggctttaaatgttgggccccttttaaaaaaccccttaagggttttgggggttttaaaatgggttaaccccccggacttaaaaccccttttttttccccccgaacccaaaatccggga

SEQ ID NO: 587525 - DNA, 156 bp, Homo sapiens
agtgctccgcctagaaggcggtttttttaaagagagaagatgacttttacacataacttgactgtttttttaaaatgtacgaaaagtaaacaaatatatcaggtcataaataataagactcatttaagtccatcaatctttcccagctggctccga

SEQ ID NO: 587526 - DNA, 400 bp, Homo sapiens
tttggcacaattggactgtgaagagacatgagaaggaatctttgatgatgtgaaaggaaaccggttgctcaactgtggtagacgcagcactacaagcagcacggacgcctcagctcaaactgcttggacaacaggagggaaggaggcccctggagaggagacagacaccgaggacagaactgtctggcccaacttctacaatgaagaaacctcttcacttctataaaaaagaggaagccatctaaggatcaaggagtaagcttttgatttaaaaggtcaacctaagtactgccgactgcaggctagacagagctgcgttctctcggaatgtgggtggcagcccatttattccattgtgttctcctgctcctttttgtcactaaaaagggggatagacaca

SEQ ID NO: 587527 - DNA, 230 bp, Homo sapiens
gttaactagaggatcccaacgttggacccatctggactacggctggctccagtaggcgtgtagccggctgcggttgtgggcatgagctgtgtggcatggtgtgggtaggactggtgaacagtggcataacagggcttgggtgggtagtgctgctcgtgcagaaagtggtacttgcaggggtagcaggatgacactgatgtgcctggggaatgggaccaactgttgggtac

SEQ ID NO: 587528 - DNA, 1223 bp, Homo sapiens
  misc_feature (1)..(1): n is a, c, g, or t
  misc_feature (29)..(29): n is a, c, g, or t
  misc_feature (52)..(52): n is a, c, g, or t
  misc_feature (117)..(117): n is a, c, g, or t
  misc_feature (125)..(125): n is a, c, g, or t
  misc_feature (127)..(127): n is a, c, g, or t
  misc_feature (158)..(158): n is a, c, g, or t
  misc_feature (162)..(163): n is a, c, g, or t
  misc_feature (183)..(183): n is a, c, g, or t
  misc_feature (186)..(186): n is a, c, g, or t
  misc_feature (490)..(490): n is a, c, g, or t
  misc_feature (497)..(498): n is a, c, g, or t
  misc_feature (656)..(656): n is a, c, g, or t
  misc_feature (707)..(707): n is a, c, g, or t
  misc_feature (946)..(946): n is a, c, g, or t
naggaaatgagtgaaaaaatagagagagnaggggtgtgtgttatggttgggngggaggctgttgttttggggagtgtgtgtatggagggtaaattgtgagagtgtgagacccattgntttatgtntngattatggcggttatagtgatgccagttgtntggnntaatgatatagagtgaagtnggntgtcgaggttgtgagttgcggggtggtgcgggcctatagataattaatataatagtataaggggaaagagttcccaacaaagaagacagacaaacacatagatacagtgaagaaggagctgaataggaaggatatgggcggggttgtatacaccttttagggatatgtgttagtgcgcgtatatctcgaagtaattattgtttattactcagcgaaagggagggaatgggttttttcctatagtgtgttatttgactttaagtttttatgtttttttcttgtggtggggatgtgtgtgttggtnatggggnngtaaaaggtatatgaggaaaaagaaaggaaaaatatgtattttaatgataagtgggagtgcgtgaattcgaatatatagtagtagagggtgttagtgatgagaaattatgataaatgaattaatttatattaacataatctccaaactgacactatantatcatatagtggatcgggatgaatagtagtgtgatgggtgttagaggagngttgatggatgttttgttgttgtcgtgtagtcattaatcgtctctattgttcatttatgttaagcgtgcacgcccgactggagcaccgacgtacgatatatgtttatttgttatatgttatgatgaaagtattatgacgaaggtaaagaaggtgtaggaagaaatgtagtgggggagttaagtgagggttgagtataggttatggtccgtaattaattgtgtgtatgtcgttgttgtantagtgtttagtgcaatgaagcttgagtacgatgagcgtggtctatggatgctaagggtgtgtgtaggtatgcggtagtgttacgttcttatattatgctattgaagtactattgtgttatcagacctttataacatatgtagtagaatgattgtttcttatagttcatagatttgtaagagtgataatgtactttatacgcatagttggttgtcggtcgagcgtagtgggtcgatcatagggagctgtaaggtatgggtgtggtcgcgcgagaggtc

SEQ ID NO: 587529 - DNA, 853 bp, Homo sapiens
  misc_feature (1)..(1): n is a, c, g, or t
  misc_feature (3)..(3): n is a, c, g, or t
  misc_feature (24)..(24): n is a, c, g, or t
  misc_feature (29)..(30): n is a, c, g, or t
  misc_feature (231)..(231): n is a, c, g, or t
  misc_feature (233)..(233): n is a, c, g, or t
  misc_feature (240)..(240): n is a, c, g, or t
  misc_feature (257)..(257): n is a, c, g, or t
  misc_feature (285)..(285): n is a, c, g, or t
  misc_feature (308)..(308): n is a, c, g, or t
  misc_feature (488)..(488): n is a, c, g, or t
nanggattccactttccctatgantaccnnaacctgcgttacagtccagctgcgtgtatgaccgagaggttccagtggacgcttggtagccatttctatataagactacgatccttatccatgtcatgggatcttcagggcaggaaggtgtccgacaacgcccatgtggtagtctggtgtccgtcgtctcctttgtatacaaccagctatctcttctttgcctgtatcctngntggtagnctactggccatcttccntataccttctgcggtacgccgaattcanccaccgacaaacacgagcctcanctccattgacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgatgtctgaccttgtggatatttgccctnggaatttctactttactttctaccgtaattccttctccgtacccaggtcttctctgagagaagctataatttaatctgtgaggaactaaactgacagggagaattgcgtgctaaataccgggggacccacaggcttggtccaagttgaagcaaggtttcgactcctttctgagaaggtccgggtgtcctagaaatctcaacctttcttcccttgctaagcatgaagttggcatttggccactggggcctgttgactcgaacatggggctctgtacaacgccgaaaatctgagggggcccttttttctggcaaatacttcttggagcccccttcggccgattcgtctcccttagatcgcgtgtttt

SEQ ID NO: 587530 - DNA, 131 bp, Homo sapiens
gatgcaggcgagtctgacacacaggaaacaagtgtttgcaaagcccaggggtgtgtttccctctgcgtacaagtgttatctgagtaactgtctagaaaataacccaccacccaatcccgaggggacccgac

SEQ ID NO: 587531 - DNA, 915 bp, Homo sapiens
  misc_feature (1)..(1): n is a, c, g, or t
  misc_feature (3)..(3): n is a, c, g, or t
  misc_feature (24)..(24): n is a, c, g, or t
  misc_feature (29)..(30): n is a, c, g, or t
  misc_feature (293)..(293): n is a, c, g, or t
  misc_feature (295)..(295): n is a, c, g, or t
  misc_feature (302)..(302): n is a, c, g, or t
  misc_feature (319)..(319): n is a, c, g, or t
  misc_feature (347)..(347): n is a, c, g, or t
  misc_feature (370)..(370): n is a, c, g, or t
  misc_feature (550)..(550): n is a, c, g, or t
nanggattccactttccctatgantaccnnaacctgcgttacagtccagctgcgtgtatgacgcagataagtgttctaggctgtgacctgcttgtggatgcgcatttatcgtgaatatagaagacacagcaattcgttgatcacatcgtcaacgggaattcctatgcagtgcgagggtaacgggtgtgcccgatcaacgcgccattgtgtacgactggagtgtacgctgtccatctccgcatttctgctatactacaccaatgttaatgctctgtctattggcctgtatcctngntggtagnctactggccatcttccntataccttctgcggtacgccgaattcanccaccgacaaacacgagcctcanctccattgacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgatgtctgaccttgtggatatttgccctnggaatttctactttactttctaccgtaattccttctccgtacccaggtcttctctgagagaagctataatttaatctgtgaggaactaaactgacagggagaattgcgtgctaaataccgggggacccacaggcttggtccaagttgaagcaaggtttcgactcctttctgagaaggtccgggtgtcctagaaatctcaacctttcttcccttgctaagcatgaagttggcatttggccactggggcctgttgactcgaacatggggctctgtacaacgccgaaaatctgagggggcccttttttctggcaaatacttcttggagcccccttcggccgattcgtctcccttagatcgcgtgtttt

SEQ ID NO: 587532 - DNA, 128 bp, Homo sapiens
gcgactgcgttcttgggcataggagcgcaagcagctcagtcctggacttccaccactaaactgcgtagagaagctaaacgtgtttcttttcccttaaattatttttgtaatggtagctttttctacat

SEQ ID NO: 587533 - DNA, 270 bp, Homo sapiens
ggtagtcagaagcctatagtacaagatagctcacgtatttgaaggaacgtagttgcgcattttatgacatttttataaagtactgtaattcttccattgaggggctatgtgatggagacagactaactcattttgttatttgcattaaaattagttttagggtctctagttcaaactgacgttcggacgaatgcttgaacttgttggtctgtgtgaatgtgtatatatatatacctagaatacacggaatctatcggagaccatattcac

SEQ ID NO: 587534 - DNA, 271 bp, Homo sapiens
ctggaattacaggcgtgtgtcgcacgcccagttagtgttttgtatctttagtagagatggggtttcaccatgttggccaggctggtctcaaactcctgacctcgtgatccgcctacccgcctccaaagtgctggattacagcgtgaaccactgctcctggccgagctcaaagcttttatcaactggccatgagtctgcactgagtcttgagggggaggtgaaataaatagccatagaagtgcttttacaactactgtgttaagaggagagg

SEQ ID NO: 587535 - DNA, 928 bp, Homo sapiens
ggcttttttttttttccgcaaccggttttgccgccagaaacaacaggttgttcggtgaaaacttaccccttaaaagccaaaaggggacagggaaaagactcatattcaacattggtcgtcattgggacacgtagattcgggcaagttccaccattacgggccatcgtgatcatataaagtgcgggtggcattcgacaaagagaacctttgacaacacttggaagaaggaggctgctgagcatggcgaaaggggctccttcaagtatgcctggggtctgggataacactgaaagctgagcgtgaccgtggtatcaccatggatatctccttgtggacaattggagaccagcaagtcactatggtgactatcatggatgccccaggaacacagaagaactttatcaaaaactgtgattcacggggacatctcaggctgactgtgctgtcctgatggtgtgctgcatggtgtcggcgaatttgaaagcgggtatctccaagatggtggcagacccgagagcttgcccttcgggctttacacagtgggttggtgaacacaactaactggtcggtgttaaccaaaatgtggattccatgtgagcccagccctacagccaagaagagatactgagccgaaaatgggtcacagagaaagttccacgcacttaccatttacacgaacacatgggctacgaacccccggaacacaagataagcaattctgggtgccccactatacgggggtagcgacacttgcgtgcaaccacaattttgctggaagcccagatggggctaaaccaattgcccttgggatacaaaggcgccatgtggaaaagttccaccagcggattagagcgatgtaacaacgtggccatggtgtaaccacaacgatggattggaaaggtcttctgaactggactttactaacacg

SEQ ID NO: 587536 - DNA, 291 bp, Homo sapiens
gagaggatcacttgagcccaggaatttgagacctgcctgagcaacatagtaagatcctgtctcaacaacaaattttaaagttagctgggcatggtggttcatgcctgtattcccagctacttgggaggctgagacaggagaatcacttgaatgcaggagtcagaggctacagtgagctatgattgctctgcactccagcctgggcaacagagcgagaccctgtctcaaacaaacaaatatacacatggtgagatactacctatggattccagtttggctgactctcgattt

SEQ ID NO: 587537 - DNA, 1076 bp, Homo sapiens
  misc_feature (199)..(199): n is a, c, g, or t
agcgggctcacccagtgggcggcggatgggcggccggggcggccggtcctgagctgcggaccgggctgtcaggtggagaagccgaggcctggagaggggcactctgtgtgaagttgttagactgggggcctggagactctgagagacagacagtccttggattgctggcctggtgcaagtgggctgtgcccttctgagncgtccacgtgcacaactgcggactagacagtaatgtacctcttgctcctcagggttggaggccagggcttcaggaagggctgggctttgctggcggtggataggactacccatggaggcaggtgacttggggccagaatggcgaagcacacgcgcttacctcccaccccatgggcaccaatacagtcaggtgttgcctcgagtcgcgttgcctgcttagcttcgcatcgtaccgacggacattgggtgaccgtccgaggatccgcgtagcatggcgaccgtcattgcgttgcgtcaatccccgaagtgctgacgtactgtgccgtccatcttcccttgctctggagatgcttccaatcctgagacgtggcgaaagatccagcatcaccatccagcccccattttgttatcactcttctacatcctggatgtcttgtgggtggcgcttggtgggcattgcccggagccgtggtatccatgacggtgagcacctcggaaacgctgcaactgtggctgataagaatcctgtgggagatcacccgctttcttcctgcttggccatcgagctgagtggtgatcatcctggggcctggccttttggcaacctgggagacgtaagtccagcattcaaagcgggtgctgggcatcagcacatgtgctgtccctggcctactctgtcacccaaggggaaccctgggagaatccttgataccctgatgcccaatctctcaagctgaagtgactttaataatctattgggcgcttgggggccccgccaaattcttgacttggctcagagtcctgctttcttcttcactgggctaataccttggggagaaacccgtcccaagaaacccggtaatgagagcgctattccg

SEQ ID NO: 587538 - DNA, 995 bp, Homo sapiens
  misc_feature (220)..(220): n is a, c, g, or t
  misc_feature (266)..(266): n is a, c, g, or t
ttgtggtgtcttttctccctccaatgaaagtagagtgatagaggtgggcgaaagaggcagaggagagacaagacagcagaagattgccgacgctaccatcacttgtatgtttacggtcagattatcacacgacacggcagttggggcacagccagattgtgtgagacactccagactaagtgtcggagcttttgtgcactttgtaaatcgtcccgccgcnccgcgtgtatcgccggtgccgcccgcggagaagtttgtgagccctngccctcgtgttccacacgaggcctcgtcacaaaacaggcgaaccagcaatggggttgtagacctgcctaaatgtgacgccgtctgtttttctgcgcagcaaccaagccgaggtcgttgttgcttttctctcctctgccgccccctccttggttgtacgcctgggggcataacatccgtgcttcgcgcccggaatgttccagagtcttgttccccggcgggtatttgccccccttgttcggagcagccgattgcttcacagggtgcgaccgggttctctgcgattatacacggactccgggcttacgggctttcaaaatctcacgtcctgcccctctgtggtccggcgcctcaccgagtgtcgctcccccgttgctgttacgacctggtcttcctccccttccatgcggatgctccgcacctcgtttcagacagccgccagtgcgcacgagtttgcgacgacacgcagacaggtttcattctttctttttttgttgagcagggatttgaacccccccatcgttgttgcgccccgtctttttgatacccaagattcgctgccccagtgcttttgtgggatacccgcacgtccccgagcaccccctcgtgtgggttggcgacacccccgctttacgccccgggcggcgctgctgcccagtactgcagggggatccccgggtttttttctatcaaaacccaacaaaacatttttataaccaagcaacataaca

SEQ ID NO: 587539 - DNA, 273 bp, Homo sapiens
agtgactttttgaaaaattaaggctgagttcctttcggtcagctgacactccccttttcctgttctgggttaatcataaggagccccctgccatagcaaaggccaggtgagtgtcaactatctgcatctggctgagagaggacccgtttcctttcatggatgtgacagggtaaggcagcaagccatggttctcctaccgcgtgtggggtaacagactagaaggtaggctaagacctgacaccattcagatttcaattagagcaggttgagatc

SEQ ID NO: 587540 - DNA, 168 bp, Homo sapiens
cagcataaactattacagcataaactattacagcataaactattacagcataaactattacagcataaactattacagcataaactattacagcataaactattacagcataaactattcccccgagcaatctcaattacaatatatacaccaacaaacaatgttcaa

SEQ ID NO: 587541 - DNA, 110 bp, Homo sapiens
  misc_feature (20)..(21): n is a, c, g, or t
  misc_feature (25)..(29): n is a, c, g, or t
tatcattatttggggtttgnnaaannnnnttttacaccttctaatttctttatttctcaaagcagataattcttctgtgtgaaaatgttttctttttttaatttaaggtt

SEQ ID NO: 587542 - DNA, 1412 bp, Homo sapiens
ttcactcatgtgccctctttcggtggttagtgtcctgaagatttttataagggggcacactgttatatcgtgcttacaaatgagttcgttactttcttaagactcttgagcccgggtaccattttttccgttagaccccttatttccttttggaacgtgaaccccagacggcctcttctttaaaaccggggaattattggatctgagggaaaacaccagaattgttttcttcggcacaagttgatacccagaaattggagaatgagaattttttggggaaaaacccttgactgttgtaagattgaagtcgatctttttctttaaagaagaccagtttgagagggtgaccaattttgggcaggaatccacaagtgatttttggggagccattaaaaatgtattgccttgtttggttggaacccacataagagatataaaattaatgggtaaattgggaaatttaaactttccccgccccccactagtttatgcgcagtttggttaaaacacaaagacccggggggtgacgctcaaatttaatggtataagccccagtgtaaggtcctccacagtttatatattcgtgaagaaggtgaatttggtggaacactcaaaccacagattatagtcttttcggcccttgaagtgttggcgcaagccactgtgttagaagcttgcccgctcggttaaaaaataaaggggaatcttgtaagatatatccacgcccttgtttgaggccacaatggagactcttgagaattctaaggtttttcacacggtgaatccacgaagccaccgccacgctatatattgtgaaggtgttatatgagatatggagaattgagatgagatcccccctcgtgggcttaataaagtggtatctcgagaacgcgcaccccactatgtgtaccaccgagaatatatatgtttagacatacacacaatatttgtcccaactctctcgatagagtttttctcccacgagagaggggggctatatgggagattatagttttgagacactcgtgcacaattccctctgacataactttctgttggaacacaccccctcgcgccactttgttctcgtgtctcttaatattaacacccacgggtggtttaaggtggtggagactcgtgcaccacacctgtatatagtgtttgcccacgtgaaaactagagagtgaccagagtatttgataattataatttgtatttcacccaccctataaatgtaaatgttgagttcctccaagaatgaaatgaaggcacctaccacttgaaatattgttttgtataaatttgtcactgttgaaccacgcacttttagccatggtaagttcccttagctatatgaattttggcatgtttcagagagatccagtaaatataaataattagatataaatata

SEQ ID NO: 587543 - DNA, 194 bp, Homo sapiens
agtcctgctgcttgcactcttgtcctcatctacctgtgggcacaatcttcagtgatgtcgtcgtgagagtgccagtgggttggcggtgcgtctgtcttgctcccccgagcagcattgaaagctccgtggatgttcttggcactgtagctgtgtccccaaaggagcagcttgtgagaatcacatgcgtcatgtct

SEQ ID NO: 587544 - DNA, 620 bp, Homo sapiens
  misc_feature (251)..(251): n is a, c, g, or t
gagcacctcaatttgcacgactggctggtggaagagtttttggtagcacgaagagtgctctcacatgctctaatttccggggctaagaagctacccctcgagtgtggtccccacccgcgatatgtagagaaaatcaccactgccggctcactttatagagaaatgaggttccaaagcttcgcccgctccacgcttttgatggggaccaaccgctttaatttttggaagtttcgaaaggggggctctgtgtnggtgtggtgtgtgtggtgtgcgcccctcttcagagtatcatctacgggcgtctttgtgtcttggtgccataccatattcggtgcaggcgcgccccacattggggcaccacgaaaggggcgttcttggaaaaaggttccgcgagaaccacaattcgaggtcccacataataggctaccacttccacaccctcgtgtaatcctcgggtttttatgagaccccttaatttctcacgaccacgctgagaaagtgaaatgggctgaatttgcaccttcttggtttctttggagagcccttttggtggaataccccctttccccatttttttttttcagatcattaatgggccgaattaaaagagtaaaatggta

SEQ ID NO: 587545 - DNA, 116 bp, Homo sapiens
  misc_feature (94)..(94): n is a, c, g, or t
  misc_feature (96)..(96): n is a, c, g, or t
ggttcgggcctctgtttattgacaggcacagaccaaggcctgcgcagcacagggctcagcgacaataaacgtcccgtcccttggcctcttctgncnggatcttggccctcgccgct

SEQ ID NO: 587546 - DNA, 1335 bp, Homo sapiens
  misc_feature (368)..(369): n is a, c, g, or t
  misc_feature (378)..(378): n is a, c, g, or t
  misc_feature (671)..(671): n is a, c, g, or t
  misc_feature (681)..(681): n is a, c, g, or t
  misc_feature (683)..(683): n is a, c, g, or t
  misc_feature (712)..(712): n is a, c, g, or t
  misc_feature (731)..(731): n is a, c, g, or t
  misc_feature (737)..(737): n is a, c, g, or t
  misc_feature (739)..(739): n is a, c, g, or t
  misc_feature (755)..(755): n is a, c, g, or t
  misc_feature (786)..(786): n is a, c, g, or t
  misc_feature (790)..(790): n is a, c, g, or t
  misc_feature (796)..(796): n is a, c, g, or t
  misc_feature (799)..(800): n is a, c, g, or t
  misc_feature (803)..(803): n is a, c, g, or t
  misc_feature (811)..(811): n is a, c, g, or t
  misc_feature (815)..(815): n is a, c, g, or t
  misc_feature (829)..(829): n is a, c, g, or t
  misc_feature (836)..(836): n is a, c, g, or t
  misc_feature (872)..(872): n is a, c, g, or t
  misc_feature (889)..(889): n is a, c, g, or t
  misc_feature (895)..(895): n is a, c, g, or t
  misc_feature (914)..(914): n is a, c, g, or t
  misc_feature (922)..(922): n is a, c, g, or t
  misc_feature (932)..(932): n is a, c, g, or t
  misc_feature (938)..(938): n is a, c, g, or t
  misc_feature (945)..(945): n is a, c, g, or t
  misc_feature (947)..(947): n is a, c, g, or t
  misc_feature (957)..(957): n is a, c, g, or t
  misc_feature (965)..(966): n is a, c, g, or t
  misc_feature (973)..(973): n is a, c, g, or t
  misc_feature (979)..(979): n is a, c, g, or t
  misc_feature (982)..(982): n is a, c, g, or t
  misc_feature (995)..(996): n is a, c, g, or t
  misc_feature (999)..(999): n is a, c, g, or t
  misc_feature (1006)..(1006): n is a, c, g, or t
  misc_feature (1020)..(1020): n is a, c, g, or t
  misc_feature (1024)..(1024): n is a, c, g, or t
  misc_feature (1026)..(1026): n is a, c, g, or t
  misc_feature (1035)..(1035): n is a, c, g, or t
cggctgtacggctggagtatgggatgcgagcgcggcgggttccgctgccccgctaagcccttttggcggctgccgccttccgccccatgggccccgtgggccccgctggcgcagtaccagctgacctggcatgtcaccagtgaaccggatgcccatggctggcttgcaggtgggaccccctgctggctccccatttggtgcagcagctccgcttcgacctggcatgccacccacatgatggatccattccgaaaacgcctgcttgtgccccaggcgcagctcccatgcctgcccagcgccggggggggttttaaaacagcacgcgagcggaagatggcagataaggttctacctcagcgaatccgggnncttgttccngagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcaggtcccagcaaggcggaaggcgatagtgcaggaactgcagggacccctgggggaaccccagcaggggacaaggtggcttcctgggaactccgagtggaaggaaaactgctggatgatcctagcaacagaagaggaagttttcttcatnctttaagagncntcgcattgagctggacaaggagctgtacnggcctgacaatcacctggnggagtngnaccggatgcccaccanccaggagacagatggcttccaagtaaacgcntggngacctnaanngtnaagtgcancctnctgctatgctggancatcagnctccccagtacaaattggacccccgattggcaaggntgctgggagtgcacacncagacnagggccgccatatgcaggncctgtggntttacataancacaancagctgnangatgggcacnagcgggannacataantggaancgntacttcgccagannttnagtgggncgactccgttttcnggantncatgaagtngcagggttgctgcagcatccagaccccattggtcatcagaccatgtcattcagtgtcgaccctaaacgaccagaagaagacagctgtgacgacatcgatgtggaggttggacgaaccattgaagggccaaaatgagccaattttctgggctcttacaccaatcaagcaggagattgcctccttgaatgtcaggatccaatgagacccattgagtccatcaaccaggtgaagacccagagaagatttaaggtcagttttagaccgaaccccaggattccatccaggaatggtcccgtccca

SEQ ID NO: 587547 - DNA, 1117 bp, Homo sapiens
  misc_feature (368)..(369): n is a, c, g, or t
  misc_feature (378)..(378): n is a, c, g, or t
  misc_feature (671)..(671): n is a, c, g, or t
  misc_feature (681)..(681): n is a, c, g, or t
  misc_feature (683)..(683): n is a, c, g, or t
  misc_feature (712)..(712): n is a, c, g, or t
  misc_feature (731)..(731): n is a, c, g, or t
  misc_feature (737)..(737): n is a, c, g, or t
  misc_feature (739)..(739): n is a, c, g, or t
  misc_feature (755)..(755): n is a, c, g, or t
  misc_feature (786)..(786): n is a, c, g, or t
  misc_feature (790)..(790): n is a, c, g, or t
  misc_feature (796)..(796): n is a, c, g, or t
  misc_feature (799)..(800): n is a, c, g, or t
  misc_feature (803)..(803): n is a, c, g, or t
  misc_feature (811)..(811): n is a, c, g, or t
  misc_feature (815)..(815): n is a, c, g, or t
  misc_feature (829)..(829): n is a, c, g, or t
  misc_feature (836)..(836): n is a, c, g, or t
  misc_feature (872)..(872): n is a, c, g, or t
  misc_feature (889)..(889): n is a, c, g, or t
  misc_feature (895)..(895): n is a, c, g, or t
  misc_feature (914)..(914): n is a, c, g, or t
  misc_feature (922)..(922): n is a, c, g, or t
  misc_feature (932)..(932): n is a, c, g, or t
  misc_feature (938)..(938): n is a, c, g, or t
  misc_feature (945)..(945): n is a, c, g, or t
  misc_feature (947)..(947): n is a, c, g, or t
  misc_feature (957)..(957): n is a, c, g, or t
  misc_feature (965)..(966): n is a, c, g, or t
  misc_feature (973)..(973): n is a, c, g, or t
  misc_feature (979)..(979): n is a, c, g, or t
  misc_feature (982)..(982): n is a, c, g, or t
  misc_feature (995)..(996): n is a, c, g, or t
  misc_feature (999)..(999): n is a, c, g, or t
  misc_feature (1006)..(1006): n is a, c, g, or t
  misc_feature (1020)..(1020): n is a, c, g, or t
  misc_feature (1024)..(1024): n is a, c, g, or t
  misc_feature (1026)..(1026): n is a, c, g, or t
  misc_feature (1035)..(1035): n is a, c, g, or t
cggctgtacggctggagtatgggatgcgagcgcggcgggttccgctgccccgctaagcccttttggcggctgccgccttccgccccatgggccccgtgggccccgctggcgcagtaccagctgacctggcatgtcaccagtgaaccggatgcccatggctggcttgcaggtgggaccccctgctggctccccatttggtgcagcagctccgcttcgacctggcatgccacccacatgatggatccattccgaaaacgcctgcttgtgccccaggcgcagctcccatgcctgcccagcgccggggggggttttaaaacagcacgcgagcggaagatggcagataaggttctacctcagcgaatccgggnncttgttccngagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcaggtcccagcaaggcggaaggcgatagtgcaggaactgcagggacccctgggggaaccccagcaggggacaaggtggcttcctgggaactccgagtggaaggaaaactgctggatgatcctagcaacagaagaggaagttttcttcatnctttaagagncntcgcattgagctggacaaggagctgtacnggcctgacaatcacctggnggagtngnaccggatgcccaccanccaggagacagatggcttccaagtaaacgcntggngacctnaanngtnaagtgcancctnctgctatgctggancatcagnctccccagtacaaattggacccccgattggcaaggntgctgggagtgcacacncagacnagggccgccatatgcaggncctgtggntttacataancacaancagctgnangatgggcacnagcgggannacataantggaancgntacttcgccagannttnagtgggncgactccgttttcnggantncatgaagtngcagggttgttcacattcaaaacccttggataaaacttttttaggggggacctaacacaaaaatttttggcccacaccacaa

SEQ ID NO: 587548 - DNA, 594 bp, Homo sapiens
tgagtgtgtggggcggagcggactgcgtgtccgcggacggtgcagggaagatgttagccttacgatgccaggagcgtggtagaagcctctgggcttcctgaagcccttcctccttgatgacggcttccagcctgttcaaggcacaccaggatgcattgccagggttgccctgtgccccctctccagcagtcccgtggagcactagctgaagtgcgctgatgccatcgtgagtgaggaggagtgggcccacacccaagcagctggtggctgagttcaggcctcaggaggtgtaggggagcgcctgcagaaaggggctggagctttcgggccatggacagacggagaactgggctgttctgagtggtggctcgaagaccggcctacctcgagtaccggcagcctgtggtcatctactcgagcccaggtgtgtgatgcttacccgaagcaggacttctgtgggacctgcaggttcaggctccgattggttggccaaattcattgaggggtgtgtaggatctccagggtcatgattggacaatgagaaccttgcccgtggatgtacctgggggggacagccactgtgcttaacccagt

SEQ ID NO: 587549 - DNA, 245 bp, Homo sapiens
  misc_feature (2)..(2): n is a, c, g, or t
antacagaaacattcaagcctgtgataaactctctcaccctaaaaccaataaaaactcttagtccataggagcaagcactcctaaccaaaaaaaaaaaaaaatttgtccagaaaccccctctcaggtttattctccaaaataaccttgtcttggactgtggacccatttttcatgtttcttttctctttctttacttctaactttgggtgctgaaacctgggttgggtgtgggggatcaccttca

SEQ ID NO: 587550 - DNA, 141 bp, Homo sapiens
agttggcgtggactgcaccaggcaagcgtcggagcgcacgtcggtggtgcaggcagagtaggagcggccctcgaagaatgaaggggaagtggcaggcgccatctgcgtttccaaaccgagttggaaccacgacgacgacga

SEQ ID NO: 587551 - DNA, 237 bp, Homo sapiens
atgaacggtctggaatagaatagaatggaatggagtgtaaaggaattgaatatgaatcaacccgaatagaatggaatggaatggaacacaatggaatggaatggagtggaatggaatggaatggaatcaactagaatggaatgcaatggaatggaatggaatggaatggaatggaattgactgtaaagggaattgaatagaagtaacccgaatggaatggaattgaaccggatagct

SEQ ID NO: 587552 - DNA, 437 bp, Homo sapiens
  misc_feature (73)..(73): n is a, c, g, or t
  misc_feature (81)..(81): n is a, c, g, or t
  misc_feature (95)..(95): n is a, c, g, or t
  misc_feature (98)..(98): n is a, c, g, or t
gcagagtaatttcttattgtgaggaactgtccaatgtattgcaagatgttctgcatacttgggctctcgaganaggggggnggtgggggggtggnggngggggtgggggggggggggggggggtgtggagggggtggggggtggcgggcggtggggaggagggggggcgcgtttggaagagagtgtgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggc

SEQ ID NO: 587553 - DNA, 312 bp, Homo sapiens
cccgcttgttcaccgatggcttgccacacattcgggtcactggcctggccgatgcgctgcaggtggtttctcgcgacgtcaccacgacattcgaacgtattgcctggtatgcccacgacattgcctggattatcgcgctattgctgtgcaatggcgtggccttgtggatggggttctgcctgttcgacatcgcggtgccgctgctgttcagcgttttgctggcgaggttgtaccggctttcgatcaacgagctatatcgcacccgggtggaaagcgttaagggatttgactccctattgcgctcggcccatg

SEQ ID NO: 587554 - DNA, 507 bp, Homo sapiens
tccctccgcggggggggcccctcttctttcccagcccccccgggggggggggcctttttccctgtgggggggggggtttccggcttttcaaatttgggggggtgttttttccccccccccccccttccccccctcctctccccgtcggggggggggggtgggtgttgtgggggctttctttgggggggccccccgtctccccccccccgggggggggccagaccccccccccccccccccggggttttttttttttttttttaagggggccccccccgggggggggggggggtttttttttgttgggggcccccccccccccccccccccccggggggttttttttctttttccccttttcccccccccctcggggccgggggggggggggcccccccccccgggggttttttgcgggggtttcccccttttttcccccccctttttttccggttttggggtttttgggggttttttttcccccttttttttttttttttttttgga

SEQ ID NO: 587555 - DNA, 925 bp, Homo sapiens
ctttctcagggtcctattacgttttcattcgggttttccactttaaaacaggtatcattcccccgtaggtccagaaatattgtcgcgggaaggaattggtcccctgggggctttcagttctgcttacaaggtcgggccacgtgtaccccccgtggttttggcaacacttttgtgtgggcatattttctaagtgcacgatttcaaggggcctcccttgtcccgggtacgctctattcaccagtggcctttctggccaccaattttgaaatttgcctttcacctgcgggctagtgatattaagcgacttggggggcccgggcggtgactgtgcccccttgcacacattcggaccacgggtccctgtcgcgcacacagcttctccgaggcccgtaaaggcgtgtccaaattgggctcccaatggccaacatgggacctggccccaggcggtcaccctccacacgaggccacgcagtggcctggagttgactgactgagcaggctttcggggtggagcaactggactccggggcccacacctggctggaggaaatggggtttggcctgttagaagtttaacctggcgccctgccttcctggaggaccagattgtgtttgccccaaccttgccacgggacagggtttgtggctgggcaccctgaacttggctggggaaggaaccacgggccctgggcagggcaagggcagcctgtcacccgtgtgaagattaaaggggcttttcatctgcctgcgctctctacggtttttttaggattattgtaaagagtctgggacccctgttggggaatgggtggccacagtgggggtggcctctctggccatgaattttgcctttcccaggtgtccccctccttccagggcctcctgggggacctttgtattaagcccatttaaaacatgaatttta

SEQ ID NO: 587556 - DNA, 362 bp, Homo sapiens
  misc_feature (282)..(282): n is a, c, g, or t
ctactcgattgtcaccgtcaagaattcgcagttcgcttgtttctagaaataatggggaaagtatgtaggagttgaatattagtccgccgtagtcggtgtactcgtaggttcagtaccattggtggccaattgatttgatggtaaggaagggttcgttgccctcgtctgttatgtaaagtatgcgtaggtatgggaggccaatgaggtctagaatgatggcggccagtataggttgtgagtgtataggaaaagggcatacaggtctaggaagcagataagganattgattatgagggcgtgctcatgaaaggtgataagctcttctatgatagggaaagtagcgtcgtgtagacctacgtgcg

SEQ ID NO: 587557 - DNA, 183 bp, Homo sapiens
gggtttgcttgtcactcaggctgcggtgtggtggcacacctggctaattttgtatttttttttgtggtagagatggggtttcgccatgtgcccaagctgttcttgaactcccgggctcaagtgatccgcctccctcggcctcccagagtgctgggattacaggcacggaccaccatctctacc

SEQ ID NO: 587558 - DNA, 248 bp, Homo sapiens
cctcacggctctgctcactttagcaggctttcaagaccattatctaaacgatgcaaatgcctctgcgctgaagtgctactatcccatcactggagcccacaggaacaagtcctacaattccaaaaagcgctcgatggaaaaatttctcaatcctgaaatcccctagggaaggggtcaggagaaagtgtttggttgatatttaagaactccacagctcttaaaaataagcacttatccctaacatgcaa

SEQ ID NO: 587559 - DNA, 1531 bp, Homo sapiens
ggagagagagaactagtctgagtttatgtggtattctcaattccataaaattttttggtaaacatattttaacatccacatgtaccaaaaaggtgggaggaaagggaggctgggcacacaggggatataatacgcctataaaggggggcgacagggaggaacgacgggggcgcccagggctgaccaaaagaccaccacggtcctctatggaaatgtgaaagaagaagtagaacacgcagaggtagtagcaacaaacgcaagcgctcgacaacccgaaagacagggatgcgccaacacggcgcataaaaaatcacccacaagaggaaaacacattgggcagctgtagcggcacaatgacatggcccgcgagataaaacgatagcaccatagaccgcggagaagcgacaacgcgacacacataggaaaacgctaacaccaagaaaacacgaggttaacaaaacaacaacaggcaaatcacaaacagaagaatgacacccgagaaggctagccacgagaacctcaaaggcagaatgaaaaccaccacagagcgaaacctacacacacgaagggacagtcacaaaacaccatacacaaagaggccacacacaacaccaagagggcacaacccagcaacacaagaagagcaataacatgtagataacaggaacaaaaagacaacaagacacaaacagacccaacgaacaaccaagaaacagccacaaaggcagaccaaaacgtggacaccaagcatacaactttcacacgtatgatgaacggaaaacgacccacagaagagccaatacggagaatagactacgataagacaaagagacggataccaatacggagtagcagagaaaaaaatagaataaacaccacgtgaacagtgccgacacaatacagacaaggaatacgaacacccagaaaaagaaatagggagcccacaaaaatagtgagaagtgacagagaagaacaaggcacaaaacagaccacagaagacagcaagcgaagaaaccgagaagaaccaccaacacctatgagcaacttgggaagagaacaaaagagacagtagagcaccattcaccaacaagaaagaattaaaatgatgagacaagtctaccaagacaataaaacacggacgacaagatacaggcgaacgatggaccgacagactggaagaaagaaccaacgaagagaagcaacaaacaccaacagcaggatgggacaaggtaaaccacaaccactgtagacatagcataggtggactgctacgaggatcaaacacgcaacgaaagaagacacaaaaatgaccagatcagaacgcatcgatgcagaacccgcacgaacgtggaatgtgggacacacaccacgcagcaaacaatagaacgaccagaagggacaggaaccataaaagataagaaaacagccagcaacagagcacaaacaactttacaaaaatatagaaaagagaccaacacaagaaacccagaccaacaagaccgagaacactgagactcgcagacatacacga

SEQ ID NO: 587560 - DNA, 565 bp, Homo sapiens
agccccaacagcacggcgtggcctctcagcctcgagcctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaattggaaatgtaaccgata

SEQ ID NO: 587561 - DNA, 198 bp, Homo sapiens
agaggatccccgggaatacctacctacctacctaaccacgataggggctcaggggctacggggagggctcagggtagagcacagacacagctaacggcagggtagccaggcacacaggagacaccagcaggagtacacgaggactagaacccaggcactactaaccccactaccacaagaccaaggcaaacaccataa

SEQ ID NO: 587562 - DNA, 424 bp, Homo sapiens
accgtcatatgtacatgagtttacctatataaaaaacctgcatatgtacctgtgaacctaaaataaatggtaaaaaaaaaactataagtgttttatgtaagcttcatggtaatcacaaagaaaaaacctgtaatagatacagaaaagataaagaaaaaagaataaatgcataacactacaaaaaaaattatcaaatcacaaaggaagacagtaaaagattaagaaagggactacaaaagtcagaaaacaattaacaaaatgacaatagtaagtccttacctaccaataagtactttaaatgtaaaagtacttataattggctgaatggattgaagaaaaatattcacctatctgtagcctacaagagacttacttaaaatacaaggggacacaaaaatagactgaaaatgagagatgaaagaga

SEQ ID NO: 587563 - DNA, 922 bp, Homo sapiens
ggatcactgaccgggtgccatggcgcccacccgggagagtgcctgtgtgctcctgagcatcactacacaccgacgggtactgtgtccgcggagcggttgcgcaccagtgggttctcccgcgaggcccgggcgcgctctacaggactcgcggcggagagcggtaccgggccgcgcggaaggccagcggacgctccggaatcgccccgcgccccgtgatcgaggtgccattccggtccactcggtgtcgctgcccccatgggtctaacggatacctagcacaatcgaggttccctccgggcgagtctattctctctctgtccactgaccatcatgtggagtgaactcacagtactccaatatgaaatgtgctgtgtcccttggggcgactctcgtcattaaatcgtgattggaagtcctgtatggaaaggactgtgaatagcacaagtcgcacgaaaagcttcgcacctcccgaatggcccgagaccgatgcgacgaccgcgacgtgtaacgagaagggtacctgtgtccgactaactcaagtccatcctttcccctgggcacggctcttcgtctccgccctgattaaggtgactaccagtgcatggctgggcacgaccgttgaatacctgtgcgcgagcccatcctttcacccgggcacccggcttccatcgcccccggttcccgcgcgaccgctcctatagagcatagcgtaggagagagctcggagtctctcgactaggacgccaacgagttagtcacctttcgccaaagcgcctttcggcgtgggctcttccggtgattgcgttcctgctgtgcgctacgccctcggttccttttcggccttacggggcacttgggattccgtaggcagggcccctggtgaccctggatggatgtggcccgatgaagtgtaggcctcctg

SEQ ID NO: 587564 - DNA, 261 bp, Homo sapiens
gaatgtaatatgcttgctgtctattatcaagaacaaaatgctgtctcttctctatagttggtgtgtcccacctagaatatatatttggttctggccacatatgaaggtggtcagagactgtcatatgaaagttcccaggcccataatcaaatctgagctgcttctgcgaaactagtgcccctgatgtggcaaaaccagatccttaacccactgcactaggctggggattgaacaggcaacatcacagagataagctggatc

SEQ ID NO: 587565 - DNA, 975 bp, Homo sapiens
cgcgtctgctgtggcccccatgccgtgagttgtttcaactcagtgggcgctttcctcacgctgctccgccaatgggcccccgatgctcaacagggcctcttctcttgtgtgactgagctccacaaaaccgggctttttcgctgtggtgtagggaccacctgtggttcccgctggtcccccgctatacgccggggggggtcccccctccccgcctgtttgtatggagccccaaagcctcccccctttgggcacagttgggccgcactcccaggacaagctgctacaggggccccttgcaaaaaggtttcccggcagacactggggtccgccttccagagcacagcgcccctccatttttctgtatgacgtccgtttaaaatctccctctcaggcggcccaaagtggcttcttggatcaagagtctctgtactacaaaagcccatgggcgtccccccccgccgcaacgccaaacatggaaaaatgatgggccgcgagttctcaaggaggtaacttgccgccccgcaagtccctcgggatgttcaatcctccgccaagcacccaatatgggccaggatccccgcatgacctgcttcgtgcacgactcctggggcggagggatatagctcgaagaccgccgaccacgcgcccggggccgacacccaaatgggggcgccaccacaccggcgccgcgctcaacgaggttgagcaacccccgctcgtcgggtgagaacaaccctttcccctggccaactcgctgcacaggggtgcctagcccgttaccccccccctccctgtgtagtagtccgcagaccctcccaggccgtccgcccacgttgaagagcgctccgcggagatccccaagacaaagcctcactatacagagaggcagggagcgccaccagtagaaagtgcgaacccagcgcgcccgtgacccggtctcaccccagaccaaaaaagcatcactccaacaaaaca

SEQ ID NO: 587566 - DNA, 1526 bp, Homo sapiens
agcgggcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaacagggaggtgcaatatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttctttgagaatttcagacctatgtgaaaagccacgataaacaatttgcagcagccactatttagactataggcagatgtgccaccaacatcttggaagtcactgacccctgccctcaaatggcttgggtttgtctggttgtccaacaggggattaaataaattttttgttgaaaactttgggtgtgttattaat

SEQ ID NO: 587567 - DNA, 1015 bp, Homo sapiens
agcgggcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaacagggaggtgcaatatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttctttgagaatttcagacctatgtgaaaagccacgataaacaatttgcagcagccactatttagactataggcagatgtgccaccaacatcttggaagtcactgacccctgccctcaaatggcttgggtttgtctggttgtccaacaggggattaaataaattttttgttgaaaactttgggtgtgttattaat

SEQ ID NO: 587568 - DNA, 168 bp, Homo sapiens
aagcatgtctcggtgtggacactggagcatgtttagaagcaatgtacctgtcttgtggcggaagaagaacagggttaactaggaatagacctggaataagtcacgcaattgctttccttgtcctccccgtctaactgttaaaaacggcctaattgggctgcgtataca

SEQ ID NO: 587569 - DNA, 679 bp, Homo sapiens
cggtctcaactcattcgacaagactacttgagcgcgacccacttcttttaaatccatccagtatagagacataagatatgacgaactgagctccgatgcttgcgctacgttaccaagactagaccatgaccagttcgttatctatacgcaggactgcttacgtatcgtgcgcacgattatgccgtgcgtagtcaagcagccattgctcgatctcaaagccgcccctgaagctatcaccgggctgctagtcattgctcagtatatcgcccacggacttagcagtcctcattagatatgtctgcctgagcaaactctaactacgaacagcactcacagtcgcatcatgatcctctctgcaaggaccttcagagacatctgactcgccaataatagctcgttataagatgacttgctgagcagagcctcgcgtgaaccatcgccattaccaccccgacctagtaacctagcattgggagaactctctgtgtctagtaaccacgttctcctgatcaaatatcactctcactactttacaggactcaacatactagtcacagcccctatactccctctacatatttaccacaacaacaatggggctcactcacccaccacattaacaacataaaaccctcattcacacgtagaaaacaccataagccgaggcctatccctcaca

SEQ ID NO: 587570 - DNA, 272 bp, Homo sapiens
caagtagcaatatctatcggttatttctaattatgtggctgtcataaatgagaaatatttcgggttatattttgcctattttaagtaaatggatagttactattttcttctgtttttgtatcactttcgtagttttatacagaaagctattcttttttttttttttttaagattggcgttcactcttgttggcccaggctagagtgcacgggtgtgacctgggctcacggaaacctccacctcccctcaacgtgcaaacgcgcttggagtgg

SEQ ID NO: 587571 - DNA, 476 bp, Homo sapiens
catctgtaaaatggatattatggtagaatttatcacctggaattactgtctggattggatgaatttattcaaaggtatttagaacagaaattggtcatagtaagcactcaataaaaaataatatattggccgggtgcagtggttcacacctgtaatcccaccactttgagaggccgtggtaagcaggacatttgaagcctggagtttgagaccagccttgccaacatggtgaaaccccgtctgtactaaaaatacaaaaaaattagtcacgccgggtgggaccccacctgttattcccgttacgaggtgggttgaaatataaaaattgtttgaacccccgaggcagaggtttgattgatccaatcaattgatttcacgcttgggggaaaaaatgaaactgttttaaaaaaatactatatttctgtggcccgaatttgagctcatttgcccatttccctttttggggcggtttcctg

SEQ ID NO: 587572 - DNA, 213 bp, Homo sapiens
tcgaagtgtccagttggtgacagaagaggcggctgcaccgtgaaggagcagggctcaggtctgacgacaaccagggaagggacagggcagggatggcttggctcacgagaggcacccgagtcaggcagtcacatacttcccgctggggtctaccatgtgaggcatggtgtgggatcctgctgaagatgtctccagagaccttctgcaggtact

SEQ ID NO: 587573 - DNA, 224 bp, Homo sapiens
atattacgaaccacatcccggaactggtcaggtttctgaatgacaccctctccaccttagatacgcagagaaagccaagtcgctcctcgctgtcctctgggcatcgcaagccaacaccattccggcgactttctggtgcttattccaaacgattaggtaatgactagtagctgaagtcatttatttattctagtagaatgcagaacattcaagccattctaact

SEQ ID NO: 587574 - DNA, 287 bp, Homo sapiens
ggtggagagcccaagttgagaacaataatgaacaattattgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataagtctgcccttctttacctacaactatcttggtaaatggctttaccacctgcaaaactgaccctagg

SEQ ID NO: 587575 - DNA, 257 bp, Homo sapiens
gtgctgcctgtaatgggaaggagatgtccccaaccaggcaactccggaggtgccctggaagtcattgcctgacaataactgatgtttccgtccctgtttatgccacaacgagaaaaccccctgcccaaaacagcaaggaaatgcatccttaatagcccccttaagttttttgtcaaggtctgactaggtcaagggtaatgggccagtatcatttggtgatttggtaaaccaataaaaatggtggcccctttagatta

SEQ ID NO: 587576 - DNA, 632 bp, Homo sapiens
gcgtgctgaatgtactggactcactgtggcatcttcagtgtgcacccatgtatcgggatggcctcaggcgagagagcgtgtgtcttcaagtacggtagactattgactggccggacattatacaatttctctctatgtggtcaacttatactatctataaggcacagtcagcatcttaactgatgttcctcgcattcgacgaagtttccgtagtactactttatggatctgaacggtagtcatgtcgagtatcactgtcctgtacggactgtacttactagaactgccttaatcgctatatgttagctactagtgataagactctgatattgcgctatacatcctgacaatgtcctaacttacattgactcaatctgtccatgactcatcggactgatgagaattctgcggtgatgcctgataccttgagatcctaggtatgtacctataggagaccattggccgctgaatgcacatctatatcagtgcagaacaactgcgttaccgcacacttgcacagacggatgctagcttttagtagtctaagaccgtatgtatacgtcatggctaatatctcctttccaccttatctgatccttaacataaggccattataggccttcactggcttc

SEQ ID NO: 587577 - DNA, 286 bp, Homo sapiens
cggcggcggcttgagaacatcgagtcaggaagtgtagcgaacgggtcataggccgggtgtcgctgaacttgggtaggtcttgaggatgtcttgatcatgtagcggtggtcttgtacgtgtagctggcgtgctggcgatacttgcgcatcaccacgtcaagggcgtcgatggtgtagcccgccgccgtgatcttcagttggatcagcaagtcttccacgggaatctgcgggtcgaaaccaccgacctcctccagcacttcgcgaggaatcagcatggtcggcgccgg

SEQ ID NO: 587578 - DNA, 1919 bp, Homo sapiens
gtaatgtttttttggttgctgacaaatgtctttttattccaagcaggactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaagaacaaatgctggggtcatataaaatatatttatgataactatttacatataataaatagaaatttgttaacatggaatttaatttatgtgaaagagttctggattcaaatgtcagttcataatatatggaagataattttatgtgttatagtaggattaatttatttagttgtgcagtcagtgtcaatccaatctgtaatttcactttagaaggtgtattaccttccacttccatgttgtcttataaacaatgaattgtatgtttgtcgaaagtaaagttatatctacaagtcagtatttgtccaaatatattaggaaaattttctcgaggactttaattccaactgaagaattttacaggtattaattcatttatcaaagggtctaggtagtgggaggcgcaaaaattaatgcgggaatcaaatggggtggtggcctttgttatcctagagtggggctggaagtgtataaggggacgcgtagagaattaaaaagtcggg

SEQ ID NO: 587579 - DNA, 518 bp, Homo sapiens
  misc_feature (261)..(261): n is a, c, g, or t
gcattggacctgatattgcccatggttgagcagtgaataaaagactggtgctcttggtggatgagtttaaggagcttgtataccaccagattacaatcctgatgggtgaaagttaccaagagaaaacacgataatgaaggttctggaagcaaaaggcccaaggtggagtattcagaagaggagctgaagacccacatcagcaagggtacgctgggcaagttcactgtggcccatgctggaaagaggcctgccgggcttacngggctgaagagtgggctgaagaagcaggagctgtgggaagcacttcaccaagcacttccaggactgaccagaggccgcgcgtccagctgcccttccgcagtgtggccaggctgcctggccttgtcctcagccagtaacgaggtgtatctccgtgagctaggaagattcgacccgacataagtcgagggacgtaatgtcttagaggctttctgtaggcatggtgatggtgtatgcctcgcactttgcttgttccgctg

SEQ ID NO: 587580 - DNA, 2142 bp, Homo sapiens
  misc_feature (144)..(144): n is a, c, g, or t
agcgggttctcgagacgccgttaaacccccgccccctcttccccaccgccgcctccaggtcctgctcccgctgctgccgccaccgccggggtgcaggagcgatcgcgctgggccgcgctcccgggagcccaggcctgcagcggncggggcgccccgaggtctgctcattgtgtttttcaggaaaaaggaagggaaagggtgttacaaggaaaggctatcggtaacaactgacctgccacaaagttagaagaaaggattgattcaagaaagactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaagaacaaatgctggggtcatataaaatatatttatgataactatttacatataataaatagaaatttgttaacatggaatttaatttatgtgaaagagttctggattcaaatgtcagttcataatatatggaagataattttatgtgttatagtaggattaatttatttagttgtgcagtcagtgtcaatccaatctgtaatttcactttagaaggtgtattaccttccacttccatgttgtcttataaacaatgaattgtatgtttgtcgaaagtaaagttatatctacaagtcagtatttgtccaaatatattaggaaaattttctcgaggactttaattccaactgaagaattttacaggtattaattcatttatcaaagggtctaggtagtgggaggcgcaaaaattaatgcgggaatcaaatggggtggtggcctttgttatcctagagtggggctggaagtgtataaggggacgcgtagagaattaaaaagtcggg

SEQ ID NO: 587581 - DNA, 2274 bp, Homo sapiens
  misc_feature (144)..(144): n is a, c, g, or t
agcgggttctcgagacgccgttaaacccccgccccctcttccccaccgccgcctccaggtcctgctcccgctgctgccgccaccgccggggtgcaggagcgatcgcgctgggccgcgctcccgggagcccaggcctgcagcggncggggcgccccgaggtctgctcattgtgtttttcaggaaaaaggaagggaaaggagaggtctaacacatggaatggagacacaaatctgaatttagactcaaaactacattgtctctattaccacaaattgtgctgcatcttctctttcttcacacaacatctcggaccagccaattttacactaagtgttacaaggaaaggctatcggtaacaactgacctgccacaaagttagaagaaaggattgattcaagaaagactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaagaacaaatgctggggtcatataaaatatatttatgataactatttacatataataaatagaaatttgttaacatggaatttaatttatgtgaaagagttctggattcaaatgtcagttcataatatatggaagataattttatgtgttatagtaggattaatttatttagttgtgcagtcagtgtcaatccaatctgtaatttcactttagaaggtgtattaccttccacttccatgttgtcttataaacaatgaattgtatgtttgtcgaaagtaaagttatatctacaagtcagtatttgtccaaatatattaggaaaattttctcgaggactttaattccaactgaagaattttacaggtattaattcatttatcaaagggtctaggtagtgggaggcgcaaaaattaatgcgggaatcaaatggggtggtggcctttgttatcctagagtggggctggaagtgtataaggggacgcgtagagaattaaaaagtcggg

SEQ ID NO: 587582 - DNA, 1632 bp, Homo sapiens
  misc_feature (144)..(144): n is a, c, g, or t
agcgggttctcgagacgccgttaaacccccgccccctcttccccaccgccgcctccaggtcctgctcccgctgctgccgccaccgccggggtgcaggagcgatcgcgctgggccgcgctcccgggagcccaggcctgcagcggncggggcgccccgaggtctgctcattgtgtttttcaggaaaaaggaagggaaaggagaggtctaacacatggaatggagacacaaatctgaatttagactcaaaactacattgtctctattaccacaaattgtgctgcatcttctctttcttcacacaacatctcggaccagccaattttacactaagtgttacaaggaaaggctatcggtaacaactgacctgccacaaagttagaagaaaggattgattcaagaaagactataatatggatttagagctcgacgagtattataacaagacacttgccacagagaataatactgctgccactcggaattctgatttcccagtctgggatgactataaaagcagtgtagatgacttacagtattttctgattgggctctatacatttagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaagaacaaatgctggggtcatataaaatatatttatgataactatttacatataataaatagaaatttgttaacatggaatttaatttatgtgaaagagttctggattcaaatgtcagttcataatatatggaagataattttatgtgttatagtaggattaatttatttagttgtgcagtcagtgtcaatccaatctgtaatttcactttagaaggtgtattaccttccacttccatgttgtcttataaacaatgaattgtatgtttgtcgaaagtaaagttatatctacaagtcagtatttgtccaaatatattaggaaaattttctcgaggactttaattccaactgaagaattttacaggtattaattcatttatcaaagggtctaggtagtgggaggcgcaaaaattaatgcgggaatcaaatggggtggtggcctttgttatcctagagtggggctggaagtgtataaggggacgcgtagagaattaaaaagtcggg

SEQ ID NO: 587583 - DNA, 853 bp, Homo sapiens
  misc_feature (77)..(78): n is a, c, g, or t
gatcgatgaagacccggccaaccggctgagggagcatcgggaccccctttggagtcggaggaggaggattccgacannaggggaaaaagtcaataagcatatagactactctttccaaatgagtgaggtaagttaaatatatatgcattaacttccttataagtcagaataaaaaatcaagataaggttaactaagcctttgtacttatttacttataatacattcgtattatgccctctaagttgtattcattgttttaagtagctaaagcaagttccatgattccatgcagatttaatacttggatctttgtctagatgttataagggaacaaatagatctttgatttgttttgaggctccctgtgaaataaactcagatatgctgatcattgatatgcaagatactagtatttggcttaacattttgctataatataatgttagtgtagtctgtgatagcttattattttacagttattagtatgattagtgcttatctatgactatactggagttcaacctgaattgcataacacacattaccatagaataataaataaattaccctactacttgtcaaaacatacagaactttcttttaaccaaaggacttcttactataaaacttttaagaaccatacaaacaattcatatcgcttctatactgaatatacacgcatgttacagggcatctccaatgacatcattccctgatagactctagttgaatcacgaactccatgcatagcctctcacagaggtaagacgtcccttgtactggtttcaggaatgtcctgccagaatatacacaggaactttaacaaacgaattccccacgaactgattgcac

SEQ ID NO: 587584 - DNA, 417 bp, Homo sapiens
  misc_feature (77)..(78): n is a, c, g, or t
gatcgatgaagacccggccaaccggctgagggagcatcgggaccccctttggagtcggaggaggaggattccgacannaggggaaaaagtcaataagcatatagactactctttccaaatgagtgagagcctgagcagcagagagaccagctttctcatcaatgaagaaacaatgtttcaaaaaaatcagcaaagcaaagattctatcttcttccgagatgggattaggcaaattgattttgtgctttcctacgttgatgacgtaaagaaagacgcagagttaaaggcggaaagaagaaaagagtttgaaactaatctcagaaaaacaggtcttgagttggaaatagaagacaaaagggactcggaagatggaagaacttattttgtcaagatccatgccccttgggaggtattagt

SEQ ID NO: 587585 - DNA, 214 bp, Homo sapiens
agtgaatacgactcgggtagtggaggatctctagatgtcgaccagtgctccatgctaaacgatattatggaggtcagcactggtgctcactgtgtctgactggacacttgtacatgggagtgcatgcacctgaggtgggtagaatacactgtctgaccatggctccagtgttaactgatattttggatggtcatgcactgtgtgctcactgtgt

SEQ ID NO: 587586 - DNA, 576 bp, Homo sapiens
ggcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaagtttattattaatctgttatataagtacgagatggagtttcagcatctgtttcccaggctggtcttgaacctcctgggcacatgcctggccagggacatgaattggtacaaagaaatttccctcccgtggctgaagcaatatcacccatggactcactgttatccaaagaaagttatccatggtgaatcggccagattctgtctatattcatgggatcatggcactccttcctaagccttccccatttaccaagcaacactgggagactaatcctttgagaatagatagaattattggagtgctcaaaaaacatcacatgtaagatttaggttgtaaaaatatgttttaacatttgggtgtcaaatgggagttgaggaatg

SEQ ID NO: 587587 - DNA, 634 bp, Homo sapiens
tgctggcttaccaatggcaggattcctttctgcttcatggaagctggtaattgaactggatatatcaacaatggtatgtatccttattattggattaatgattgccattgtgagcctatatagcaaacagtcttttctcgacgcatcttgaatgtgacaaaggctcgcatagcgtgcgtggcttaccaagtggcagggatacctttctcttcaacaacagactttaatcttacagtatgtttggtaaagttttcctttgaatacaggtgattgggatgtgtgaaaacctgtaccataacacggagtggacgttgacgtggtcttgttatgggtggtctataccctgttttcttggctatacctgtaaagttggtggtctagcagccaggtatcaactcagctctgttaccacacaaagggaacatcttaagttacgggattagaacttctaagccgtgtctttaaaagagatgttattctcctatttgggctccagaactatgtttctcagctataccttgggtctgaacaatataaatctacttataagggcccttcagttatctgacccctggcaaagaaattcatcgtgattttaaacatatttgtaaccaaaattaatgggtaaaccccg

SEQ ID NO: 587588 - DNA, 153 bp, Homo sapiens
acgctttcttaagttggtggctgctttagtgcctacttatagggtgttaaattgatttactctactctaccaggtttattcgatatatgtccaaagagctcgttcctcttgtgcgactaacagttcaatttacccaagcttttgggatcctct

SEQ ID NO: 587589 - DNA, 307 bp, Homo sapiens
acggaagtgaacactctccatcatgaaacagatttagactctggtctgatcacaatattcctcattagtatcgtgcccctgtggagagatgcacttccagacggcccctgttgaggagtattgcataatagtgcctgtacagtctgccttcgtaaactcctaggtaggtgctggtagtccctccaatatcccaaaagaatgatgccggactcattcttggtgcagaatgacaggttgatttctgtacctacatcaattggcacaggggagagctccacaaaaccaggcttaggaaagctaactgtgt

SEQ ID NO: 587590 - DNA, 124 bp, Homo sapiens
attcctgtcatttaattagatttgccacaaaaagcaataaggttagctaaccacgctgctctcctcctccacctaacccccacctcccttcatatcacaaacacaggaacccaaagcccctcct

SEQ ID NO: 587591 - DNA, 1130 bp, Homo sapiens
ctgtgggtgtcccccacaattcgtggggactatctgcggtccggggtgatacgtgttccgcgctcctggggggcgctcgtctctcttgtttcgggctcccccccggtctttccgcctctccctggggtacccgtgtcccagaggcggtacgccttcctggtgtattgatcgtctccttccgctgcggctcccgccctgcgtggtctgggcttcaactggtcggtgctcatctggtccctcttattgtttggccggtcttctctgtgctggcccggcacgttcaaggggtccccctcccttggtcctctgctcacatatgccgcgtggtggcctagcccgtggggttcccccttcttgggggttggctttcgcctcttgcctttggtcccccgtgtgtccgcgcgtttccctcggggatctattctctctcgggtctttctcttcgcaatccgagtggctagcgtgcttgcgctctccgtcgcgtgtctgctagtctctctggatacttctctgggctgcgccccctttcgcggtgatttggcctctgacgtcatcgacgacctggtcacggcagcttgtgctggctgggtcgccggggccttctgggtgtctgctgtgcggcgtaccgtgtcccctccgcccctctcccatgcccggcgatctgcatcgggcccaggccgccaccctgcacgtgcgggcgtgagcctgcttcgcccgcggggaagcgtcagaggggcagccctaggaggactagtgacagtcagtcgcggaatcctgcggtgtgactacccacgcacccttgcccagcggattatgggagttgtcactctggtaaaaggatttctgggctgcttccatgcttggggccctcatccctgccctggcaggccttgtctagcaccgatctgcattctacgctgtgggggtcagtcgtgatgcagcagcgccgtgagttcctgtaggctcaagaaccttctccacttgagaagccttcctgggggaggtctgagtgggccaggcctggagccacgtaccaacactttatacccaggggaatggatcgccaagggccctagataacgcccccaacttcttggggttcacaatactcctgagacatctggaatctg

SEQ ID NO: 587592 - DNA, 124 bp, Homo sapiens
cgtgaacgaggagtgagctcacagacagcaggcaagttccatgggacgacagaggttcagactatgggcagcccctcatactgaccttccgggtgccccccggggactccccactcccgtgtac

SEQ ID NO: 587593 - DNA, 293 bp, Homo sapiens
tggtgctgtccaatcatgtcgatcgtggtgccgtgtattcgtcgtagtggtgccaggaatacgacgtcttggttgccggagagttcactcgtgtaggtgccggaattcgtcatggtcagtcaactggggtcttcatcaccatgaagagaggctggggctctttagcaggggggatgccaagaggtgtcataatctctgccccctctactgatgcccccatgttcgtcatgggcgtgaaacatgagaagtatgacaacagcctctagatcatcagcaatgcctcctgcacgacg

SEQ ID NO: 587594 - DNA, 443 bp, Homo sapiens
tcaacgcacacacacctctgaagccgccggggcagtgcgcgaaacacagcggctgtcgtgaaagagtcaatgaccgagtgccccccagacgctgggctgtgcgcaacagaccaagaaaaaggtgttccagtgagaaaacagatatatgcggtatgttagaaagtggttttacaaagtccagccatgagatgtacaagtcattcgctaggaaacagcccaggaatggccatctgtctccagccgcgtacgctgtgcgcagtacccaggcacccagcaaccatcccctaggagaagcgggcaaggaccctcgtgggaagatcgccaccacagcaacacctttcttcagggcggggctcgtcggcagtgtgtgagtcaaggcaatccattccattcaagagggaatttgctctcaaattttgccaacacggaaatattagccttaa

SEQ ID NO: 587595 - DNA, 139 bp, Homo sapiens
gcggccgcctactactactactactgctcgaattcaagcttctaacgatgtacggggacatgaggaaagctgcaattaagaaagactgagcccctcccctgccctctccctgaaataaagaacagcttgaccgaaaaaa

SEQ ID NO: 587596 - DNA, 845 bp, Homo sapiens
gggcaccagtggttgcacgtgggttgggctctgatgcacgagagtttctcttttgaatgtgaagaaataactaatacaatccattgtgaccagaatgtccttaagctgaggaattgggtgtgccttaaagatacaatctcgggatagtctagggggaacctttgttagccatgatagtgcccttgtacagtgctgatggcctggtagttgcagcctaacggtaggagcacgacgttgggacagggcatgggtgtgcaggaaacatcccactatctatccgggagtgcctatcatggacggaaggatactctgggccctttgaggtgtccgtgggtttccgctgctaacttgagccagatggggaattgagggcttgagtatattggatcaagataactttcaatgaagacttaggttgtggccagcacagtgagatatttccattgacgagtatttgggacacctgaggggttctggggggatgaaagagatatgttaaggaacgtctcaagttgtgatgagaatggcccaggggtttcgtaagagagacaaggttattcggggttgaatacgatatgggcatagcattgaaaatggggaggaaactgaagcaaatgtgctttcaactttgtccttgtgcatcggagcgaggtcaagtttttcgtgaaggagcctaacattccacattttgaaggagaaataaattaaagagaaccttaaacaaaggcgcaacattgtccatggtgaagggtgtgaaagccagaagtatgggaatttgcccccataaattgttgttgaaaaactgttatagaagggaataagtacaggaaagttgtttggaagaa

SEQ ID NO: 587597 - DNA, 806 bp, Homo sapiens
ggagagaactagtctgagtttactttatatctttttttttcgccaaaaaaaactttattaccaagctataaattaaagtgcggcggggtgggcggggtgacagccgagcagtcccgtatggggcatctgccctattatctctgtcctcctggggcctggattagagagtcacctcatccaggcgctcctattgctggctggaccacctttgactgcaggtagaaggagccacccacggatcaatcatacacctaaactaagtgtcatagtcctactggacctcctcagggctcacgcttggaccacgtatgaaaatctgttgtgcctcctggaaggctgaggccgagacaggttgaaagcggttgcaaacctggtgtccagcgccgtcccacggagcatcagcatgaggcacccggagtaagacatggaagtggcgccaatgtaggagtagactcaagcccacaacacatcaaaaaaagcaccacacaactacaacacctttgagccctatccacagaactaggatcagggatacacccacgattggaacaacatcgctcgacagaaaaggcccagtcgaaacagtgcctattagcccaaacacaacatatgaaaagcccccaagtcagaaactgtgacatattgggggccacgagtaactgtttggcccacattgagacagcgcgcctccttgcagctctccggaggtcttcaaacactccggagtttacgcttgggcccccagaaggcactgagtgaaaataaacgattatgtaacagaaagagatcaagaacagaaagaaaag

SEQ ID NO: 587598 - DNA, 134 bp, Homo sapiens
aggatcccaactgacagccacgagccattttacaactctttattgatgttaagcatgttcctatgagggaatgggtttcatgttgcaagaaaactgaggtgatatggggactctgaggctccttagcctcctgt

SEQ ID NO: 587599 - DNA, 271 bp, Homo sapiens
  misc_feature (25)..(25): n is a, c, g, or t
  misc_feature (29)..(30): n is a, c, g, or t
  misc_feature (47)..(47): n is a, c, g, or t
  misc_feature (72)..(72): n is a, c, g, or t
  misc_feature (86)..(86): n is a, c, g, or t
  misc_feature (89)..(89): n is a, c, g, or t
  misc_feature (91)..(91): n is a, c, g, or t
  misc_feature (94)..(94): n is a, c, g, or t
  misc_feature (111)..(112): n is a, c, g, or t
  misc_feature (173)..(173): n is a, c, g, or t
  misc_feature (180)..(181): n is a, c, g, or t
  misc_feature (183)..(185): n is a, c, g, or t
  misc_feature (206)..(206): n is a, c, g, or t
  misc_feature (217)..(217): n is a, c, g, or t
  misc_feature (253)..(253): n is a, c, g, or t
  misc_feature (262)..(262): n is a, c, g, or t
  misc_feature (270)..(270): n is a, c, g, or t
tttaattgaagttaatatgaaattntttnntcactttcattaatganttctactctgcatttctctgttgtntcccagaaattganctntnggnattctaaatcatttaanntcaaaacctagtcttagtcgatgcacaatatggggaaacttcaggtcaaggaagagaaganatatttnncnnntagtatggactatagagtctntcacctatttntagtactataatacacagatactgtgaacaattaanacctcagantcctacanc

SEQ ID NO: 587600 - DNA, 141 bp, Homo sapiens
acgcttcggtcagggtatcttttaccagacactgaagcatatggagatagaatagaaagattgcttcgcctcagtttgaacatcgaccctgatgcagaggtggaagaagagcctgagaagaactgaagagacgcgaaaacc

SEQ ID NO: 587601 - DNA, 915 bp, Homo sapiens
gacctgtccggcgaccgaagaggctggacttgacaccagtgcatatcacggccatggggtctcagcatccgctgtgtcgccctcctcctgcaggcgaaagcaagaaagatgatcagggacggttggctggctgaagcgagagcaggaagaagccattgctcagttcccatatgttggaatcaccgggagaagatagcatcaaccttgttctcaatgtgccagggggacaggctaccatttccaacagcagcaatgtaaactggacgtgcgggtggcttgtgatcccacacaggtgaatccaagagattgcgccctcagcaaatcttaacgcaattatgtccctcctgttccatccctgcttgggtctcctgcattctgtggggggtaacttaccttgtttccggcaatcagtccttgtgcatgatgacgggcattcaacagttgctgaaccgtcaccttttacctaaggcaagactcccttgtaattctcaccattaatggcccaccctggaaatcaggaactccacatttctacccggtggcaggtggccagtctgtccagccagatccagtaccttgaacaccatggtggtccgtacattatgttgactactaggggttccttatcacctcggagtgagcaactgggtgaatttaccggggaaggccggaattggaaggaccggttcctaatggacttgctctgcggaacctgcaccctggtgccaccatagtggccttctgcaacgcagggaggattaaaaattgcccagacccgagtccttggaccctactttgttgggggccctccccgcttaacgcatggcttcccgctgtaaaacatttcagcttggcccctggtagggcgttccaacctgagaccgtgatttacagtgcagtacaaacgcgaccaat

SEQ ID NO: 587602 - DNA, 353 bp, Homo sapiens
  misc_feature (221)..(221): n is a, c, g, or t
  misc_feature (241)..(241): n is a, c, g, or t
  misc_feature (244)..(244): n is a, c, g, or t
  misc_feature (314)..(314): n is a, c, g, or t
aaccgttaccgccgggggaaccaacgctttaacgctggcgattgacaaaacggcggcgctgctcgtcgttcataaaggtccaggcaataaagcgactctgcttttgcccctgggccatctcttttttaaccaccttcaccgcgcccacgtccgtcagggcacgatacaacggcggtaagttttcaccacgagataccagtgatgtaaaccacatcacctgnttcgcgaagcttttgctctnttnaatcatctttttgataaaggtgacttcaccgccttcacaccacaactcctgttgctggccgccaaagttnagtgcatcgtctttgttcagccccaggtttacggcgttt

SEQ ID NO: 587603 - DNA, 413 bp, Homo sapiens
tgggggcgttcctgagtttaattgggggcacacccggacgagggccctgcccctaaaaaaaggtgtggggcctcttggtggtgaagcgtggcttgtgctgacggcgcaggacccggtggggcagccgggaacttgatctgggagtctgtggaactggtttgacagccgggccggcggccacttgctgggcctggatctcctccaccttcatcccacgcgtccgggaagtgaattcactatctagacagggatgagactgggtatagacttttaccaaagctttccccacctcaaaaacctcggctggggggagaatctccagtagggggcactgtggacacggttcggcttctgcctcccaagggctggggcttccccgcggtcaaaaaacaaacaagcacacaacaaagcgg

SEQ ID NO: 587604 - DNA, 283 bp, Homo sapiens
  misc_feature (7)..(7): n is a, c, g, or t
  misc_feature (217)..(217): n is a, c, g, or t
ggccgancagcaggatccccggaatcacccgaccctacaaaaaatagaaaaataaaaaacaaacatagattagcatgtggcccagtgattccactcataggtttatacccaaaagaactggaaacaggtattcaaacaatcccttgtatacaaatgttcatagcagcactattcagagtagccaaaatgtggaaggaacccaaatgtccaccaaggngattaatggagaaacaaatggtggtatacataaacaaagggatattattcagccatcgctggtgta

SEQ ID NO: 587605 - DNA, 426 bp, Homo sapiens
gtagctaagaacttcacccctcacctcaatgcagccagtagctgggatcctggtgggcatgatccataatcggttccaaggtaacgatggtgtcgaggtcttgggtggggtggaactatgtaagaaaaggtcattaattggcctgcaattggtcaccagaagggtattaaaaccacagctaagtagctctataataatacttatccagtgactaaaaccaacttaaaccagtaggtggagaaataacatgtccaagaacggtaatgcggggtgggaacatgtaactggtagactggagaagataggcattggagtggctgagagggctttggggtgggaatgcaaaatttctcggctaagacttttccaggtgaccttaccagactgggccaagctagcatctaagcggaagcggatctccaatca

SEQ ID NO: 587606 - DNA, 503 bp, Homo sapiens
acaaagtggccatacgcgggtatcaaaaacccttgttggacacatgtgggaattcaaagacaacagagcaggatgtacattcacagtgtaatggaaaagctttttctgacggcaggaattataactgttactcttttattcctagtctttcatgcgatcaacctcccggagggctcaaatataattgcgaaatcccaattatgcgcggtgcgcgtgatactgttgtgggaacttacacatcttgagagtagtggaaagtggagtagcccatgaccggcttcagctgtgacaggtttagtgtcttgtttttgacacaggtgacagcggcacaggcaatctttacgatatctgtgaaggcatcagtagtagcagttaagtgcggtatgaccttcttacagggtaggaaccaaggcgcgtagaacatgaccaacgggcgcgtcttgttcttcagggtctcccggcagttggacatcaacatgtgcaacacgcttgaccgctggtat

SEQ ID NO: 587607 - DNA, 810 bp, Homo sapiens
  misc_feature (58)..(58): n is a, c, g, or t
  misc_feature (227)..(227): n is a, c, g, or t
ggatcggcttcgttgcggtctgttactgagcagaaatcggccgagaatggtgtccgangtacgacgttgacaaagttgtacgctcgcctggtctaacgatttccacctgaactgagcgacgtcgtgcgatgaagctcggcaataatcccctggtgaaacgattcctgcaagagagaagaattggtacgggtttctgtcttcgtcgaatctggagtgcaatactgaanttccaaacgaggaccctagttatgagtggtatcttttacatcaatgacctgcaagcgacggtagtaaccatcagtacacatcgcatcacgtacttgtctactggtgcctgtgtaggtgtcctcatcgaataggttcgcgatgattctggaaatacattcctgaaagtacagaagtgcttatacacttctagagacattcgggcagctcggggactcattcctatcagtgtcgagaacagtctcgatacaggagagtgactcgattctatgtgccaatcagccatcggagatgatgccatgatattatattatcatagtgtgtgctttcgtctcacttgtgacaaatcctgtctggagaattgcaaaaggaacagagcaaacaagcagagcatgaagaatgcatcaagtccagagagcaggagcagagcagcagctccgtgacaggaagagatgagactaatgtgaagatcgggagtctgagggggcgtgccgggtgactctgcgcgagggacgccggaacatgacggggatgaatgattgaccatgcaagcaccggggtggctcgaccagctgagccggccag

SEQ ID NO: 587608 - DNA, 316 bp, Homo sapiens
ttgagacggatttcagtcttgttgcccaggttggagtgcaatgtcgcgatctcggcgcactgcaacctccaagtcctgggttcaagcaattctccagcctcagcctcctgagtagctgggattacaggcgcccgcaacaaggcccggctaatttttgtatttttagtagagaaagggtttcaccattttggccaggctggtctcaaactcctgacctcaggtgatctgaccatctcaacctcctaaagtgcagggattagaggcgtgcgatcacaccggggcaattagttatttttaaaacatttactttactgat

SEQ ID NO: 587609 - DNA, 588 bp, Homo sapiens
  misc_feature (446)..(446): n is a, c, g, or t
  misc_feature (471)..(471): n is a, c, g, or t
ccagcgccccccacgggtggcagcagatcctggaggatgtgcggggtgcgccggcagaggatccagtgttcaccatcctgggcccggaagaccccccagttcccttcaggatgatggaggatgcgtgaggcccctgggagagcagttctaccagtcaaatgccgggcctacgtgggtgccaacacagcgtgcatgtcgagtcaggcggagcaatgtgctgaggcgataggtgtgagctcctgcagcgaggcggcgacggcacctggagcgggaggtggcccagatgaagcaggcagctattaccggtgcaagctcagtaaagcatgccatcactcaggcgtgactctctcgagagtgcctgacaggtcttgtggtcagcgcagcgaaggtggcctgcacccaggtctttccctgggcggtccgtcggccccagactggcattcacnggggttcccagctccacgagggtgntagacactagggctgccctctcctgattgctggggctggcggttcatccgtccgtctcattcatgccgagttggtgggacccacccagtcggctccgtcctgcgtgacctgagggcc

SEQ ID NO: 587610 - DNA, 127 bp, Homo sapiens
cacccaggcgcacttctggcccctctgagtgattccctagggctgccccgcagaggggcttcccctaagctctgttttgaagcctgcaatgtgcaacagtgagaaggtcagcagggaacacggacag

SEQ ID NO: 587611 - DNA, 216 bp, Homo sapiens
  misc_feature (68)..(68): n is a, c, g, or t
  misc_feature (94)..(94): n is a, c, g, or t
  misc_feature (169)..(169): n is a, c, g, or t
  misc_feature (182)..(182): n is a, c, g, or t
  misc_feature (195)..(195): n is a, c, g, or t
tgaaatttgagagtccttggattatctgacatgtaaagttgtgagccagatgtggtggcatgcacctnctgggattacaggcatgagccaccgnacccagcctggttattggatttatttatttattttgagatagagccttgctctgtcaccaggccggagtgcagtngtgtcatctcagntcactgcaacctncaacttccaggttcaagcgat

SEQ ID NO: 587612 - DNA, 1216 bp, Homo sapiens
tgtgtctcttgccattgtgctctcgaagaaccaatccgcttggtagttgtgcgctgggtaagtgtctggtgtgttccgggggtttccatgcccccctatggtactaaggggttcgtataaggtgaatttgttccctctgtgagtccctcctgtagagtcgccgaggggggctttgttccggtcgtatgagtccgtagttttcttggcgactactagttgagttttgggtgtagagacgtgttagcgcttacgcctgtctctggggagactgtctgactactacgtagaagcgcacttgctttgggcaattacgccaggtacgaggttaatttgtgctcgcttggatgcccttactatgaacgtagtcggacgcttgggggcctgtgcgcgctacgcgggcttgtgtagtccgctgctgatggcaacagctcatgtagtagctgtgtactaagctacgtgaatgtaggatcggttatgaatcatgcgagcgtaggtcagtagatgtgtgcagcgcgtcgcgtcgtactcgagtagagtgcagtgcgcctactccgcgcagcgcgggcgttcataagttacgtttaggcgtgacgctgcgcgcagcagctgcgcaccggagaggcgaagtagtgataactgactgctgtctgtcatgctgtctgctgaggccgctatgcgagttcagtgcttgtcgttgttgcagccgctacggtgggctcgtgagactgggcaatgtgtactatagcagaagctcagtccagctagagcactgcgtatcgtagcagcgagcagcgctagctactgttgttagtcgccagctgtcgtgtagccatcaaggtcaacagcgctacagcccgcttatcgccgcatagctagtgtatgtagtgcgaaacgcagtcagcgctagcgtcagttcaagccaatgatgccctggcgcgtagcgcgctaagcgcgcgtaagcatgtagctgcaggccacgctagctcatgcacctaagttggaagcgccagccgctagcaatagtcaagcgcagttaaccttccctctacacgtgtatcatcttcacaattgctaagttcgtactgagctagtccgtagaaagtcgctgtcgccgtaatccaagcctacgttttacagcttgctagaagcctcaccgacggtgcgggggaggggtgggggtcggtggcgcggggggggggggggggggggggggggc

SEQ ID NO: 587613 - DNA, 313 bp, Homo sapiens
  misc_feature (53)..(53): n is a, c, g, or t
  misc_feature (103)..(103): n is a, c, g, or t
  misc_feature (178)..(178): n is a, c, g, or t
  misc_feature (209)..(209): n is a, c, g, or t
  misc_feature (269)..(269): n is a, c, g, or t
  misc_feature (279)..(279): n is a, c, g, or t
actggttccttttataaaaagattgtggatccttcagattgataattctgccnaaaagtcagggtcggcttgtgaaaagttgttaaaacaacatccttaatgngaaatgtcaaccctcactctaagctacttcccccttttcaaagcattgaatgaagacttcattgggttttatagnggctttctgattttggtagtctatacaagangggaatttggaagttcttgtatattgttgattgtctgcccatgtcctgcctgaaataccntgattgtttntgaaaagaatctttaataaagctggttacagtta

SEQ ID NO: 587614 - DNA, 341 bp, Homo sapiens
  misc_feature (1)..(1): n is a, c, g, or t
  misc_feature (5)..(5): n is a, c, g, or t
ngtangaaaaaggactagatatagctacttatatagtagctgtatctacttataggcatctcttcctgaatcatttacataaagttgaaataacaggattttagaattgaaatttttttttttttggaaatggattttggctctgtgtggcccagaataaaatgcaggggcttaatctcggctcaccacaacctctgcctcgcggttacaatgtgattctcctgcctcagcctcctgagatgctggaattacaggcttgcgccaccatgcccggcataatttttattattttaagaaaaagacggggtttcaccattgtggcgccacggctagaatctcaa

SEQ ID NO: 587615 - DNA, 130 bp, Homo sapiens
tctcgtctttctgcagaagagaggcaaagagaggagcagctcgtctcatttgacaaccatgaggagtggaaccagatgcagaaccaggaggatgaggtgtccatcactgagcaggacatggaacgtatta

SEQ ID NO: 587616 - DNA, 90 bp, Homo sapiens
aggccctcacatacctctgagtacctctgtgccagcaggctagggggagagacccagtacttcgggccaggcacgcggctcctggtgctc

SEQ ID NO: 587617 - DNA, 176 bp, Homo sapiens
  misc_feature (160)..(160): n is a, c, g, or t
gcgtgttgggactttgtactctgccgtgtggactgtcctgggcagcgatttctgctgcagtgagaacaacaagcccaaagacaggtcctggatgaagcctcctcagacgcctccacctgaccccctcccaggctgcccatgctgcccttgcacctccacnctacatctggctccct

SEQ ID NO: 587618 - DNA, 508 bp, Homo sapiens
actcgctattcatcggcaccctcggggcctggctagggaaaccctattacctccaggctcgcttctcatatgtgcggatgaaatatgttgtatcttgctggatagcggaatcagttgcaagctggattatatatgtgcagcattctacctatacagaattatgcagaggaaagggctgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacccgggggcctggctaaggaaaccctattacctccaggctcgcttctcataggtgccgatgaatagcg

SEQ ID NO: 587619 - DNA, 419 bp, Homo sapiens
  misc_feature (260)..(260): n is a, c, g, or t
  misc_feature (316)..(316): n is a, c, g, or t
  misc_feature (357)..(357): n is a, c, g, or t
tagtctgtaggaggcaccatgaggggagccgtgttgaccactggtcaggtgtcatcagtgccaggcaccttacgggtgatgtcacctgatgtatttttaggcagatggccatctcgttccctttttactcaaccattgggagtttgaaaactgaaaggatttttcctaagatacgagcaggaagcagcagagcccagatgggaacttgggcctgactccagggccggtccttgtcctgcagggccgctcgccgtctccangggctgtgcatgctcggctctcacactgtgtgcctggccgagctcttgctcattangtccccccttggctccagagattcctgctcccttcaacaangcctttcctcagattccagtcccaggctgaccaggacccacgtgtcggctttgagcctcagt

SEQ ID NO: 587620 - DNA, 419 bp, Homo sapiens
  misc_feature (26)..(26): n is a, c, g, or t
acatgactcagcctgagcaaaacagntgagactgtctaaaaaaaaaaaaaaaaaaaaagagagaatggggcacccccgtcttagaactgaaaaattcagttctactttgcttagcagtgaatacttttgtccaaggtactctggcaggaggaaaaggcgtgtcctcttgagttcttgacttgggctctggcctgtaaatattcccatgtgggtgaaaccagaggcagcactctaggtgcccgaacttttaggcagcgcagccctcctagtcttatggaccattcttgaggcagaagaaacctgagttccaccctttttcatttttattagattgaccaaacagatcctggtgggacagtgtacccaaggtcacccagccaaaaggctgagcaggattgtacgtcaaatccgttaacctc

SEQ ID NO: 587621 - DNA, 391 bp, Homo sapiens
ggtagactatagtgacaccgagtcaagtacacctagtagtccttttcctaggtcgaaggaagacttttccgctagaaggacaaacacctattctgtcagggtgtcaggtcggattgataccctgtcgaaatgctcttcctttttctacttctacctaagaatatacaccggatgtcgcctctcttgtgaaaaccgaagactcccggtaacgacccgatccacgtggcattgacgaacacatagaacatttatcggtcggtaaaagtcaataatatggtcttggagaagtgtatctggataatcacgtaaacattgacctaaataaagaattatataaccttccaaaacaaaggaatctgatcatttaatagtatgtctcaaaataaaactc

SEQ ID NO: 587622 - DNA, 305 bp, Homo sapiens
cttctgggcataagagcttttatgcacaggtgccggagacgatgccagttgccccttggttcatgcattaggcgtccagcacagagccgcagtcggcgtgtcaccttgccagggacagtgtggggcttgacgatcctgttcccccagtagcctctgtgcacggggacgatagagagcttggccaggatgatggccccacggatagcggttgccacctccttggagcacttaacacccagaccgacgtgggcattgtaatccccgatagcgacaaatgccttgagctcttattgcccaggctggag

SEQ ID NO: 587623 - DNA, 145 bp, Homo sapiens
ggcttatttacttagctatagatgtttcaaatcatccatattatagcttctgtatgaatttccttatttttgttttttgtttgtttgttttttgagacagcgtttcactcttgttgcccaggctggactgcaatggcaggatctc

SEQ ID NO: 587624 - DNA, 151 bp, Homo sapiens
gctggccggtggccccgtaatatccgaacggggcctcgcctggctcaacaactcaagaacctccgaagctggacatatcggacctcccatgccgtgtccatccttgacttaagtaagttattgggtggaggagatgtgcccaattggaagg

SEQ ID NO: 587625 - DNA, 188 bp, Homo sapiens
  misc_feature (156)..(156): n is a, c, g, or t
tgtggctctagaggatcctaaattgaggtccgggtggacacaagaggaccatattgaatgaccgctgccgaggaggggggcctgcaagcagcagtgccgagacacgggtgatgaggtggtctgctcctgctttcgtgggctaccatgctgctgtcntgatggtgtctccctgtgacagatgtcaactg

SEQ ID NO: 587626 - DNA, 344 bp, Homo sapiens
ctgtctggttcagggtcagtttttttgcctcaggtctgaccagccaaggtggcccaggaattcactgcaggccaggtccggtggctcacgcctgtaatcccagcactttggaatgctgaagcaggaagatcgcttgagccccaggagtttgagaccagcctgggcaacacggcgaaacctggtctttacagaaattagccaggtgtggtggcggacgcctgtagtcccagcaactcgggaggctgaggtgggaggatcacctgagcccagggaagtcgaggcttcagtgagccgtgatcatgccactgcactccagcgtgggtgaccgagtgagatcttttctc

SEQ ID NO: 587627 - DNA, 212 bp, Homo sapiens
acccggcatctggaccttcttcttcctcctttcccccttcctcttctttaacttcaggtgcagttgctttcagtggagacttttgggcagctacttcttcttcttcagctctcgggctcctcttccttttcttctgctgctctctttcttctcttccttcatggaaacggccaattcctctgtcatggctgtcagggcctcttccattcctg

SEQ ID NO: 587628 - DNA, 158 bp, Homo sapiens
atcccctccgcgttgatgagcatgcacctgtaatcccagctacttgggaggctgatgtgtgggatgattggaggatcgcttgtagttcaggaggttgaggctgcagtgagccgagaatcgtgccactgcgactgttagcctgcagtgctagtgacatc

SEQ ID NO: 587629 - DNA, 139 bp, Homo sapiens
gccagcatggatgacatctacaaggctgcgggtagagcagtgacaagaggagcagaaaaatgacgttcaaggcagcttctgacatattcgtgctggcgctgaggatggctgcatcagcaccaaggagctggcaaggtga

SEQ ID NO: 587630 - DNA, 1014 bp, Homo sapiens
cctgtcgtttctgtgtgggtggtttttgtcttctcctcctctagcgcgtcgggcgggcgctcggccgcccgccggcgccgtgagttgtgcgttttttcggtgggtgtttacagttggcggattgcttgcgctgctccgcccacccctcttctgtttccgtgttacggcggtcgctcggtggggcaagtccctgccgctcctcgcgccgtgttcgcccgccccttgtgtggcgttgttctctttgtcttttggcgtccagtcgttgcgcccgccctctctccccctcccctcatcttgggttttctttgtttgcttgccccgcgctccgctaacgtcttcctcctcttctgtgccgcccctgtgcgtctttgttgtattgcgcgctctctctgtcgtgccgacggctttgtcttggttctgtcccccgggtccgcgctttttttattagtgcaggacgggcgcggttctcgttctctcttcctcgctcggggtagcagtcgttccgcgccgttggctgtttccagatatgtggtttccctctcgctcctctcttctttggctcgcgcgtacgcctaaatcaatcggtaattaatcttactcttccaccacgtctctccacaatgcttctatccactctcgttctctctatataagaagaccaatgccttcacacgtggtgctcttccagatactagatatttccttttaaactttttgtaaaaaagtcacaaatatgattggctcatacaaccacactttcacctcttttcaatccatgcatctcccacccagttccacgattagaaatatttttgcttaccacacacactcacggtgactcataatctcattagaaactgaattgatgagaagtataatgggaaaaggaatgagaacctgtggctctagcgcacgcttacagaagggaaatcatctatatatagagccaatggatttatttcatgacagggaaaaggataaaaccagtgcaatttaattagaacaggaaagagg

SEQ ID NO: 587631 - DNA, 609 bp, Homo sapiens
tggaaacggaatcttgctctgttgcccagtctggattgcggggcttgatctcggctcgctgaacctctgcctccggggctcaaaaaattctccctggcttctgcctccagagtagcggggattacagatgcccgccaccacgcccagctaatttttggtattttaagtagcgacggagtttcactatgttggccaggctggtctcgaactccgtggcctaagggtggtctgcccaccttggcctcccaaagtgctgggattacagggcgtgggccagggcgccgggcctccaagaaacttttttatgaagaccacctccgtgggtaccccattgttgacttgaaacagggtctgctaaaaatcaggggctctccaacagagccgatatgcaggggacattctcagcattctctaatgggacacttgtcaaagggaccagaatgttagaatcatcttggcctaggaatgggtagtttaaaattttcacatttatgcggggagggtgtgtatacgttatttttcccgcaaaccaaaaataacttctaaatccccaaaagcggtgaatggacccctgtctgggcccagggatctcaaaggaacctgaaaacg

SEQ ID NO: 587632 - DNA, 167 bp, Homo sapiens
cagtattcgaatcgagctggtaccaaatgacgattgggtatctcctagtagcgcgcaaccatcaactgtcatgtccagttcccaatcagcacaccccctgatagttatctgtcttcgatttggtagtagttagctacgggcaatagcacgagggggatagtcccata

SEQ ID NO: 587633 - DNA, 173 bp, Homo sapiens
cccttgattgccaggggctgggggttaagcagggtggtggaaatagggaatgactctttatgggtataaagtttactttttgggactggaagtttattccagtgttcattttagttccggacctgcaccaagtggtgattggttgtgcaacactgtacgtgtactttagggta

SEQ ID NO: 587634 - DNA, 202 bp, Homo sapiens
gccgttgtaactcagtccttgttcgaggtgccgcagatgaaaatacccgtcactataagagaattctgaagaagtcagaaaaaaaagtcgattttgtcttctccaacaaatagaaagtgggtcaggtaattctgcgaaaagacagcctttatgcatagggatttcgccttctggattacggagccctactacattataataa

SEQ ID NO: 587635 - DNA, 352 bp, Homo sapiens
tctagatccaagagaacaaagaaagaggctgtgacagtctaatatatggttccccagtttcagccttggagtgtaccatccgtctgttagcaaagctctaagaccaaatgggctcccactccagggaacgtcccccttcccacaggggcgggggagatggagtccggggctgtgccgccctctggtagcagcacgtgaaggcgcacaggaggcctcaatgttctccggggccctgggatagccatgcagagaggcggaggtcctttatgtgccagagtaggctgctgtcgagggactgcggttctgctcgaggtgtgccgtatcggtgtatagaagcagaacgtcacatcag

SEQ ID NO: 587636 - DNA, 896 bp, Homo sapiens
ggggaaaatggtagcgatggcggctgggccgagtgggtgtctggtgccggcgttgggctacggttgtgtggcgactgtgcttcaagcggtgtctgctttggggcagagttttcatcggaggcatgcagagagttaggcttttctagcaaactttgcttgtgcagctctggtgatcttctcggacagttcaaccctgcttcagtgtggatcctgatgtgcagaggatgcttgtcaggaggaagcacaattgtgaaacccaaaaagctgtatgcaggagctattcttgaagttgtggatgaacaatggggaaggttccctcaagtccaagctttgttaggagtgataaaccaaatgttcagaggactgcaaaatcaatgtaatgtccgtgggttaagacccgtgtattaaaaggctttggaccgacaattgggaacaatttgcttgaagaactgagcattctcaaattggaacacagacagtgtagaagaattcctgagtgaaaagttggacgcatataaatctgtgttaaattttgtcctatccttttgttaccttatccaatgaatattacatgactaggaaaataatttagttgtgttgttcccattggatcagtcttttactggaggcttaaatatctaattaactcgtgaaaggcagtatgtcagattctaggagttgcaggttaaaaaaccatttttaaatgtcatcttcgattggtggtacactataaaatgtttgaaagacggtggtatatgacatgtggtgggaatgtgcacttggacaccgatttaatgaggggtagagagtaaaagggcgtgggggctggaaggggaaagaaaaatgtggaagttgtgaactttgtgggtaagtatgatgggaagtgtggtaagaag

SEQ ID NO: 587637 - DNA, 1093 bp, Homo sapiens
gttcttgttcttaggggatttgttcttttgctagttgcttgttcttgtgtcttgccttgatgttatcggtgcagtggtgatccttgtgttacatcgttctgctggtgttcttggtgcgtttatggtgtggtgttttgctcttcttatccggtggcttgtttggtgtttgtctgtgtatctctctgtgttgtgtcggcttgttctctttgtgggtccttctttttgggtttgcattataggtcaatgtgtaggagtgctttccggtgtggcttatacgcgctgccctaccttgggagattcttaatggttgtcgttctgcactgctatgtgtgttgtgttagggccagaatatatctgttggttctacatgactgagttgctccaacatgcatctgcccgccggagtaaggaagttttccatctagggtacctctctgtttcgcttatccatggagacttaggcaattgagtgtaagtggctggagtatttcttttacaagatgggttctagatataaggatactcctccgtgagctgtactgtcacaaggttacattggaggcgtcgcatgattgagggccttatggatagcttctgttaatgtctcgcttgctagtcttgatgtctcgaatgccatggttttggaaatcaagatacccgcatgggaacttggagatgagtctgtgtctgggtcctggagctggtgattgacatcgagtttgagctgctgacctgtggattagtgatagtgagagtttggacgatcctggtagcagaagtccatttaccttctgggccagataccaccagtatgcccgctccagattccctcagaccttttccggtcccattattggtccatggtggtacagccagtgccaacttctctgccaactttggtgcctttggtttcttctgggcttgagtgagatgttggatattgctatcaatcgcagtagtctttcccctgtgtgagtcctgaagcctcagattcacttcgtaaacacagctattctagagagccacatcctgtgaactgatactggcatgcaagataaatttattgctgttccttaatcctgtggttgtcccc

SEQ ID NO: 587638 - DNA, 327 bp, Homo sapiens
tccagaatagtcaccgcggcaaattacctccaccacctccaaagttccctccgcgaccataaaattgccagatccacctccacataaaagggaaaaaaggcaaagaaaaaaaaaaaaaaaacaaaaaacgaaacaattgaaaaacaaaaacacccctaaaccccccaaaacaaggtagtgcatttccccagggggaaggggattttacactggagccgttgggaccggaacggagatctcccggctacagaaccctgcgaaggaaagacactcaaagacagaaaaagaaccacaaagggaaacaaaatagatcaccaggcaatctgg

SEQ ID NO: 587639 - DNA, 939 bp, Homo sapiens
atacggcaggtcgaggcccggttttaattcggcaccgaggcttagcagcaaagggtgatcagatgatttctgttaactgtgtgtataaaggtggcccatgtcgccctcagtgatggtgcccattgatgctgtggacggacacagaaggacctcctgggagccagtggggctcatgctgctgcttccccccaaaatgaagagtgaggacatggcagaggaggacgtgtactggccgtcggcttgatgcggcctcatgcagctcctggctggctaagcccttccagcctgcgcttcctctgatggttcttgtgcctagcccaggagggtgacgccgttgagaaggaaggtagaagatggtctgatgctacagggacttggtttcagctaagctgatgtcaaattacactgttagccggaggatccctgataccgattaatgatctacaaggtttcaactaaggttctgcaagcagtgctgtggctggtttcgccaactgcgccccattcccttgagctctgctgccagactctcattcagtacgtcgaagacgggattggccatgagtttagtgggcgcttcttccatgacagaagagagaggcgtctgggcggtccttgcttctcaggatgcctggggccatcattgactgtttaacaggtgtgctgcagttccttggttctgtggtgttcctcctgaacaagctggtgtgaactgtcccttggctgtcacgtgagtttgtgaaggcaccagggggccagcccgggttggtttcctcacctggggctgggaattggcccagaagagactgggcctgtgttaaagccacggcttgtggtccgggtacccacagttcccgcgaatgggccttctcaccccttgggggcccctcggttccccgcgtggtcccctgggtggcacaacccgtccaaatccccgtc

SEQ ID NO: 587640 - DNA, 644 bp, Homo sapiens
agtgccgggtgttgtgtcgccttttttcgctggcggtggcatctccttgtcccccattgttttgttgccattgattgttggggttcgtctggtgtgtattgggggaggcttttctgcccgttgtggttgtgccggcctctcctcgttatggcgtccttgtcccccttttggtggtgccctctttgcccgctcgatgcccccgtgtatcgggaacccagttcgcgcctccgctcttgttgattgtttataaggatggctgtttacgcggactgcgtctcgtccgcggcgatttgaggtcacctctgctggtggaattctttcgtgctctcccccgccacatttcatcctctggtttccctcctactttgtgccccctcgcgctactcgtctacgcgccttccctttttacgcgtcctacccgcacgtcggtcggtgcacactcgtgtttccctctcctcctgtgcactatcagatctagtgtggcccccaatggttgttggaccactgtgggctcctgctgcgatgttgtgggtggacgtatattcttttctcatgtcgcctaccgaagatttctccgccgctcgtttttgctctgtagcccccggcgggcactgtggctctctcggccgaacaatagtcagaaa

SEQ ID NO: 587641 - DNA, 390 bp, Homo sapiens
tgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctcgcaaggggcccacaaaggggagaaggccagccctacatcttcagctcccatagcgctggctcaggaagaaccccaagcaacattcaacacaccacaagggaatttccaatatataaaacatgccaccctctaaatacacaacctaaagttgtaaagagataattaattaaaaatgaaaacagtattccc

SEQ ID NO: 587642 - DNA, 107 bp, Homo sapiens
gtcccatcagccttgcttttagcaggcaatgccaaaatctacccaatttgtgcttgcatctctttctccagaatacagtactttttatttttgagattctaaaccta

SEQ ID NO: 587643 - DNA, 295 bp, Homo sapiens
cataactgccactaactgctctctcctcaggattcctggcctccatttggccccagtccctgccaatccccttggaaataaaatttctgctcctcacagagtgcccaggccgggccttccttgcagccttcttcatccatgtcactgacgcctctggattctctcaacgacgaacctctcacctctgtgcggccgcgctgagcatcagatgtcctcagcaaatccttagtccacactcagtttcagtatcacatattctaacagtgggcatcatcagaaggggggccacggtaca

SEQ ID NO: 587644 - DNA, 819 bp, Homo sapiens
  misc_feature (344)..(344): n is a, c, g, or t
  misc_feature (377)..(377): n is a, c, g, or t
  misc_feature (379)..(379): n is a, c, g, or t
  misc_feature (383)..(383): n is a, c, g, or t
  misc_feature (393)..(393): n is a, c, g, or t
  misc_feature (396)..(396): n is a, c, g, or t
  misc_feature (406)..(406): n is a, c, g, or t
  misc_feature (420)..(420): n is a, c, g, or t
  misc_feature (427)..(427): n is a, c, g, or t
tgctggcggaggttcgaggacgggcgaggccctctggccctggcctcagaacttccaaactccgaccagcgctacgtcctttagcccgaacaactttcaattccagtacgatgtcagctcggcgtgcaaggccgggtgtcagtcctcgagcgagagccttccagcgctatcgtgacctgcttgtaccggctccgggtcttggcccgtctcttacctcacagggaagcggcatacactggcgaagaatgtgtggtgtctctgtagtcacacctggatgtaaccagcttcctacttatggagtcaggtggagaattataccctgaccataaatgatgaccagtgtnactcctctctgagactgtctggggagctctccnangtcnggagactttnagncagcttgttnggaaatctgctganggcacantctttatcaacaagactgagattgaggactttccccgcttccctcaccggggcttgcgtgtggatacatctcgccattaactgccactctcatagcatcctggacactctgagatgtcatggcgtacaataaaattgaccgtgttccatggcatctggtagatgatccttcttccatatgagaggttcagttttccagaggtcatgagaagggggtctaaaccctgtacccacatttacagccggtgtgacggggtcttgatacgccggtccgggttccggtgtggcaagttggaccctggccctttgcggggcggtccggtatggcctgactgggggcctggttgcggagccagcaactagttggcgcttaaagcgcccttttcggggggc

SEQ ID NO: 587645 - DNA, 792 bp, Homo sapiens
gataaaccacgagtcacctgcctgtcgtatagtagaagccggtgcaggtagcccataaccggggccatctaaggctgacctagtgagctaggggattatgatgtgatttgagctatctcggtccatgagagagaacatccgtcagtacaatagaggcgtacttactgaatgacagctagccatatacacgaggtgtcggcgctacatggcacccgagacagcacatggcaagggcgacgaaggagaactgtccgataacatgggtgcgttcggggtgactaactccctattgtctctttcgtcatgatgttgcctgtgcgtccagctgcgcatctaagcctgcaggcgcttttccacccatgtccggtggctcagccggttcaccagccaccgtttgggatgccactttgggccctgaagtcgtggcatcaggcgctcgccttttatctgccttaccattctccctctggtagcctctcttcgcccttgggtccaactcccgggtgtgagggggttgacccttttcccaggtgttatttagaacctgatgggggctccacccctaatagttattcaaaggtagctttccgtaatttcacgtgaggtctcatatatttaccctccatacaaagcctcagagtacttcgagttctccctttcaccatttccgacggaatctacggctcaaaattatttgtaggcacaggctttccacggaactccaagtcattataggatcaagtgtcgtcacatctgctacaccgacaataatattcagttacatccaactct

SEQ ID NO: 587646 - DNA, 794 bp, Homo sapiens
tcgccgtgtaccaggcagggttctgccaggctctatcgccaatggagcaggggctccacctggggcctaggacgcctgaaatagccctcttttagccccaagggcctggggcttcagcgctccccggatccctcgctctgcagtggtcttcccggtaccgcgcaggccgcttggggaagctgctttcgctcttaaccttgcaggtgcgtggtgccgcgggcgcccggggcaggcaggacgcagaggaggaggcgcccgccaatgcccggcctgggttccccgcctcggttcccgtccgccgcccccgggaacggcctgttgcagccccttgtgaccgaggaagaggctggcggctggcggcggagggatggaggagggtgccgcccctttggcaagctccccgacccggcggcctcggataggaacccattggcggattcctcgcccgactgtccctgcggaacggcgggcccccgggcgccgggccctcggcccccctcgcgagacgccgaggcatcgcgctcccgggctccgagtccggagggagcgccgagcttgtcgtttgacgccggggccccgtaaccaaaggaccccggctcgatacggggaaagacactgccagctgttgagggctgcccgttggggccgcgggcgtccatcgaagcacgcccagtgtggagcaccgggtcccgtgcgggccgaaccccgttgcagagcatcgggctcaagtaaggggtgtcacattggacacaggattacaaggggcaaaaaactgttcccaagggatgggatat

SEQ ID NO: 587647 - DNA, 188 bp, Homo sapiens
acaccgtgaccaatgtccactcagaacacctgagagcaccagacaatctactctacacatcaaccaggatacagaatcatcattctgccatcagcacatatcagacttgcatacaagtaagacctgctactatcccttcaacgaggaaaaacaaaacaaaaccccaaaaaacaaacccaccaaacccc

SEQ ID NO: 587648 - DNA, 392 bp, Homo sapiens
  misc_feature (128)..(128): n is a, c, g, or t
gtatatgaggccataccttaattagcctcaattataacccattcccacaaatatacatatttcaaacatcctgcccttcccatgcaccctacacatcaagaattactgggagaataggccgggcacgngtgtcacgcctgtaatcccagcacttcgggagactgaggcaggcggatcatgaggtcaggagttcgagaccagcatggccaacatggtgaaacctcgtctctactaaaaacacaaaaattagctgggtgtagtgcgggcgcctgtaattccggctgcttgggaggctgaggcaggagagccgtttgaacccaggagacggaggtttcagtgagccgagatcgcaccattacactccagcctgggcgacagggtgagattctgtc

SEQ ID NO: 587649 - DNA, 860 bp, Homo sapiens
  misc_feature (24)..(24): n is a, c, g, or t
  misc_feature (70)..(70): n is a, c, g, or t
  misc_feature (98)..(98): n is a, c, g, or t
  misc_feature (101)..(101): n is a, c, g, or t
  misc_feature (114)..(114): n is a, c, g, or t
  misc_feature (146)..(146): n is a, c, g, or t
  misc_feature (148)..(148): n is a, c, g, or t
  misc_feature (168)..(168): n is a, c, g, or t
  misc_feature (194)..(195): n is a, c, g, or t
  misc_feature (211)..(212): n is a, c, g, or t
  misc_feature (219)..(219): n is a, c, g, or t
  misc_feature (222)..(222): n is a, c, g, or t
  misc_feature (228)..(230): n is a, c, g, or t
  misc_feature (233)..(233): n is a, c, g, or t
  misc_feature (241)..(243): n is a, c, g, or t
  misc_feature (250)..(250): n is a, c, g, or t
  misc_feature (257)..(257): n is a, c, g, or t
  misc_feature (284)..(284): n is a, c, g, or t
  misc_feature (288)..(288): n is a, c, g, or t
  misc_feature (305)..(305): n is a, c, g, or t
  misc_feature (314)..(314): n is a, c, g, or t
  misc_feature (321)..(321): n is a, c, g, or t
  misc_feature (332)..(333): n is a, c, g, or t
  misc_feature (337)..(337): n is a, c, g, or t
  misc_feature (342)..(343): n is a, c, g, or t
  misc_feature (365)..(365): n is a, c, g, or t
  misc_feature (395)..(395): n is a, c, g, or t
  misc_feature (399)..(399): n is a, c, g, or t
  misc_feature (481)..(481): n is a, c, g, or t
  misc_feature (493)..(493): n is a, c, g, or t
  misc_feature (495)..(495): n is a, c, g, or t
  misc_feature (634)..(634): n is a, c, g, or t
  misc_feature (641)..(641): n is a, c, g, or t
  misc_feature (646)..(647): n is a, c, g, or t
  misc_feature (650)..(650): n is a, c, g, or t
  misc_feature (696)..(698): n is a, c, g, or t
  misc_feature (700)..(702): n is a, c, g, or t
  misc_feature (704)..(705): n is a, c, g, or t
  misc_feature (708)..(709): n is a, c, g, or t
  misc_feature (712)..(712): n is a, c, g, or t
  misc_feature (730)..(730): n is a, c, g, or t
  misc_feature (752)..(752): n is a, c, g, or t
  misc_feature (773)..(773): n is a, c, g, or t
  misc_feature (784)..(784): n is a, c, g, or t
  misc_feature (806)..(806): n is a, c, g, or t
ttgaaagtacaagctccagagganaattgggtctttaaatatacacaagtatttccatcaaatgaatttncacccttacatccaaatagacctaggcngtnaaaaacataaganaaataagacctattagctatgtattaactgananaccacatacaaaccaaagantatggaagccagaaagacggcctggnnggccacccgttggcgnnggggggnggngtgacnnngtngggggcgnnncccatcncacttgntgtactaatggctccaatccatttaantgtnggccagttaaacttagnccttaaaangcggggnggggggggggnntaancgggnngggcatagctttcacctaagangtagctccttcggggtaaaatggatacagncacngcttcatgttcttcaccttgcttttcataactgttttgtgtttaaatggattccacttaaaaataatctcctataggggagnggggccttttcncncccatccaagcacacaccatacccaccacccccccccccccttgctgttatccaaatttaagtcaataagaaaagcttttagtctcacacctaggtaatgcctgtggagctggtcttgtcacacacacacttctctgcnagggggnggtgnnggngcgagaagtacagtatttctagtttgttgttccaagtatgtacaannngnnntnntgnngtntcaggtaaacatgtgcanaggggaagatgaggcgtgggcncatagaaagcagtcaaatggnaatcaaaaggnctttctctttcagagttccccnatctttatttgtagaggttatccaataatttctttaattacatcgcattttttt

SEQ ID NO: 587650 - DNA, 340 bp, Homo sapiens
aaggatcccccctggcttgctcaggtctgccacagtttctgcagtccattggggcctggaagtggccagggcactctgggccggggtccacggagcagactccagtcctgagtcccctgtgccccatgtacccactctgcccaccatgatggtgctgcaggctggttcctcccggccctgtgcacgaggtgctgaaggacactggtcgtcttcgatcccctgccatgccctcccgctgctcaatgtatcttcctcccagtcaccctgtgtctgcaggatgcaaatcctgcagaccggcgatgtccttcgctggcccctgtaccaatcgtacccgccgttg

SEQ ID NO: 587651 - DNA, 1416 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaa

SEQ ID NO: 587652 - DNA, 1407 bp, Homo sapiens
gattgcctcgagccagattcgcacgacggagacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaa

SEQ ID NO: 587653 - DNA, 983 bp, Homo sapiens
gaaccggtgtttgacttgtcggagctcgcacaatttccatgaccactattgaaccgctgcgtgcgttgtccctggcatgccagtctactccggaagtcacagcagttatcgtgaccagacattgataattgcacctctatatcgtgcctatcgaccatgttctgctcgttggactaggatgatcgccccgctggtaatgctgactgcgcatcgtcaaatggccgaacaaggaacatcacccaaaggaaccatggatagaataaatatgctattctgtggaacaagtcgtactagctcacccagtcacccgtacatgctcgctacaaggtcacctcctggagtgatcatccccccttggaccgcaactgaacggtcagcctaaggatgattctctctggaagatccatgcatcattaaacgcaaggcaccgattctagaagagccattggatgcaaagatatcttgattgaatggagaatgagcaaggaacgagagtcgccgaaaaccatacgtgggattttccctccccaggaagagcctggccaggtttctcaaggcatggctcctaaggtcttttcgattgcagttgacatcagttattcaaagggaccgaggacagatgtagagcccgggaggccaggcaatggccttatagttgtctacgcacgtggcagagaggaccctcagggacgttactgacttctatcacgcgaactatttcctgtggtccccgacgtggcgtccccattataagttccatttgctttttttggtactttcaccccagtggttgtggacgcggacgatttacaccacaccgttggggcggccctggcgcaaaaaaacgttgtttacccttgggggggtcccctgggggatagggacccttccccttctgtttggtgtggtgcccatttggtgcccctatttgcctacgaatatttagcggctgcctacggccgtcgtaatcagcgcgactggga

SEQ ID NO: 587654 - DNA, 1308 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaactcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaa

SEQ ID NO: 587655 - DNA, 129 bp, Homo sapiens
caatatgagagtgctggagcatgtgcgagagcgtgtgcgtactgtgaacgtgtaacagacatgtgagatacatgtggtgtagagcctgtgaacatgtaatgtgtgtgagagcatgtgtaggaggcgtac

SEQ ID NO: 587656 - DNA, 572 bp, Homo sapiens
gattgcctcgagccagattcgcacgacggagactctgcgctgtctaccctcccctcccgcggtaggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaattattaaaaagctttttttctccagtattttctgtattatcttaatgtttatggcaaataaaatgtaaaggaacatgccaaa

SEQ ID NO: 587657 - DNA, 1264 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaa

SEQ ID NO: 587658 - DNA, 1663 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaa

SEQ ID NO: 587659 - DNA, 326 bp, Homo sapiens
tcagaaccccctgcatacgcgtagcttatagtagatctcccgactaaacacataagataggtggcctagactaacagggaatgtagggagccaggtagagagccttcccggatatttaagcgtaaaaaattctaccgggagatactccttggatcaatataatgtctctcagtcaaagatgtaaaagcactttagccttaaaaagaatgttctgtttctaaatagagtcaacgttgtcctcctcattggaattcactatgagtcagaatcattagactgacttttttttttccatagtaatagtatatggcagagtctcacagagc

SEQ ID NO: 587660 - DNA, 982 bp, Homo sapiens
tgcctccgggtcgcggtcattttgagcccctgtctggatgacttcttgcggctgttctacccctccccctccccgcgtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaacgtatgtatcaaactttatttgatgacctttttctgcttggatatcacctgtgtgttctaccatcaatcatcaagctaaagtcagcatgtttgttccatttgtttcttcattccttcaacttttcttgagacca

SEQ ID NO: 587661 - DNA, 1699 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggtgggagacggacactgggtggaggatggagtgcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaa

SEQ ID NO: 587662 - DNA, 1309 bp, Homo sapiens
tgcctccgggtcgcggtcattttgagcccctgtctggatgacttcttgcggctgttctacccctccccctccccgcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaa

SEQ ID NO: 587663 - DNA, 397 bp, Homo sapiens
gtcttagtcactggtgtcactgtactgatctctctttgatatagcaagtatatttattttctctattgaaatacattttatatttgattattttcactgtaatttcattatctttaccctaatgtaggccctcgttcactcatgccaagattacttccacagttggccatccgacctttttggttctaacttctcctttctccaagccattttcactatagctgttctaataatttttaaaatgtttgtttattgggaaaaaagtctatctattgttttaataaactttttgtttttgaaatagttagagatgtatagaaaatctgctaagatagtacagaaagttcttgtagaaactttacccaccttctcctgatgttaacatcttacataacta

SEQ ID NO: 587664 - DNA, 203 bp, Homo sapiens
ggggggggggggccccctttttcccccccttattcccccccccccccttggggggggggttttttcccccggggggggtccttttttttgggggggggatttccccccccttttttttttttgggggggcgggggtgtggggtttttaaaaaaggttttttttttcccccccccccccctttttcccccccctttgggtgtta

SEQ ID NO: 587665 - DNA, 731 bp, Homo sapiens
  misc_feature (552)..(552): n is a, c, g, or t
  misc_feature (721)..(722): n is a, c, g, or t
tgcgtgtgttcacaaacgtgtgcagctacaccccaggatgtgtgagcaagggaagtcctgccagttccccagcctggcatccggaatgggctccggctggccctgctgctatctgggtctccttcctctcacttcccggtgctggcatcggcctcctcctttcttcacctgagcctctttcccaaagaacattagatcctaaaagaacctaaggtaaaggaatatacttctgtcattgaatggagtcagctctacttacaacccacagcccagactcttggtaacactgttcttcgaattgcatttctggaaaaccaagggtcaacccagagcctcttttctatttttgattcctttcttgctgtagtaggcaacgtctatgcagcgtttcttggtacagagaaaagaacagatccgggtttccaatttagactcctccaagctgtgtgtcttcagtctaatcacccctccactctggtcttcccttccctcacctctagtaataaaggaaatggagtaatcagagcttctcgaagttctccatctaaacanccctcagcagagggggccagctgattggcaaattgggggcagaacactaaagaaatagcccaaagtaacctatctgtagtgtaaaactctgaagtctcctgttttggctttgaaattcatgcttctgcattctattacataacatttgtcttaatataaaaacatcgtnntgatcgaaa

SEQ ID NO: 587666 - DNA, 386 bp, Homo sapiens
cgattatgttagtattcgggccccattgggatactgggcaatcattctgtgattctcacgtgtgcacgttaataaatctgtatgctttttctctatgtgcctttttttttcttttgagatggagtctcgctctgtcgcccagtctggagtgcagtggcgcaatctcggctcacttcaagctccgccttccgggttcacgccattctcctgcctcagcctccagagtagctgggactacaatcgcctgccaccacgcccggctaatttttcgtatttttagtagagacggggtttcaccgtgttagccaggatggtctcgatctcctgaccttgtgatccacccgactcagcctcccgaagtgctgggattacaggcgtgagcaacg

SEQ ID NO: 587667 - DNA, 527 bp, Homo sapiens
  misc_feature (392)..(393): n is a, c, g, or t
  misc_feature (401)..(401): n is a, c, g, or t
  misc_feature (421)..(421): n is a, c, g, or t
  misc_feature (431)..(431): n is a, c, g, or t
  misc_feature (512)..(512): n is a, c, g, or t
attgcaaggcccctctggtattgactgtgctggcccactagtaaggagagccctcttcctggtgatatcgagcaagcgagatggacgtccgattgtgcggtacactcacttgacgaacgtacgtagtcgtcgcgattgagtcaggacacggagacagaggctggggctgatagcccacgcagctagcagctgtgctggcggcggctgtcggagcgcggtgtgagtgctggctggacctgctgctgcagtgcatccgcagggcgcggcatgatggaggtgacgggggtgtcggcacccacggtgaccgttttcatcagcagctccctcaacaccttccgctccgagaagcgatacagccgcagcctcaccatcgctgagttcaagtgtaaacnngagttgcnggtgggcagccctgcttccngcatggaacnggagctgtatggagttgacgacaagttctacagcaagctggatcacgaggatgcgctcctgggctcctaccctgtagatgncggctgccccatcca

SEQ ID NO: 587668 - DNA, 108 bp, Homo sapiens
  misc_feature (73)..(73): n is a, c, g, or t
gcagcggaaggtgagctccagcttcagcacctgtccttgccccatccagtcgcggaatcgtgtcatcaccganacgtcggcaccggcaaagcgattgatcggctgcca

SEQ ID NO: 587669 - DNA, 157 bp, Homo sapiens
tagatcccctcacgcacaaaccccctctcacccacaaaccccctctcacccacaatccccctctcacccacaaaccccctctcaccgacgaactcccctttacatcggggtcatctgcgggggtttgtgggtgaagggggtttgtggggggtaccga

SEQ ID NO: 587670 - DNA, 143 bp, Homo sapiens
taattgagattgctcgggggaataggttatgtgattaggagtagggttaggatgtgtgggaaaaggcacataaagaatattgcggcgcccttggcgtgaaggtagcggatgattcacccatattttacaactcaggtggggtg

SEQ ID NO: 587671 - DNA, 230 bp, Homo sapiens
agcatcattcatgaaccaacagtttctcatgcacatctttgtacagtcttagttcagcaacaatgtcttcattttagtacagcatcaatcacttcaggagtggaatcattgggtcatctggttcactcatatgtgtgcacttcagaagcacctttcaaagtgcttcctgaagtggttgtcaccgtttgaaaacattccttccttcacagagagctccagttgctctgtat

SEQ ID NO: 587672 - DNA, 655 bp, Homo sapiens
gagcggaggcagctgcgtcagcccaagggccccggcgccaaggggcggcatgggaaccccaaacgcaaccgggtctggagggatccccgagacgagccagtcttcgtcaccgccatccggcgcagcgacccatgcgggacataggcaaggatgcactggagactgcacggagaagtgagattttgcagagccggaaatcacagagagaagaacaaacgaggaagcacgcacaggaaccaaagacccaagatgaaaaatgaaaacggacggcagagaaagcagcagacgagtaggaagacagaaagacaagagacacaagaatggacacaacgagaaagaggacaagaggacgccaatgggacagcggcgaacggagacaagaggagacaagagccaagaaaacagcgatgcaagataagcaaagcaaaaagaagtagaaccgaaaacaaccacaccacagaaccagaaagagcgcggaaggagaagacgaaaagaccaagagacagacaaagagagaaagaagacacaacaacaacgagaaggaaggaaaactagcacgaacgaaaaagcgccagataaaaaccgtaccgagagcaagcacggaagcaccgaacacagaagtgaaacgccgcaaaacacaacaacaccaaccaca

SEQ ID NO: 587673 - DNA, 430 bp, Homo sapiens
  misc_feature (162)..(162): n is a, c, g, or t
  misc_feature (232)..(232): n is a, c, g, or t
  misc_feature (354)..(354): n is a, c, g, or t
  misc_feature (401)..(401): n is a, c, g, or t
gaaaaacaaaggcccaagaaaagccaaacagtgtccctcccctcctaccgtagcaggcccagatggcgttttaggcaaatacacccacaactgcacagccaggtccccatctcaaagggctttccacggagcaaaagcagtttcgatcgtattgtcatcacncaccatcaactttttttttccactcacatgatgtatgccaatatcattattctcgttatttgtataaccntcatcatcatcaatgtctcgtgaatttttgcgtgttatttttaacatagcatgtaaacagcacctccccacaaaaaaaactagctcaggataaacatctctaagagtatttcataggagctnatagtttgaccaacaaaaaaatgttttcttttcccaaaataaagttnctgtggtttgtctcaggaaaaaaaaaaaa

SEQ ID NO: 587674 - DNA, 826 bp, Homo sapiens
agcggagtccgactggaaagagcgagctgagtggttgtgtggctcgtcgtctcgggaaaccgtgtggctgctgtgctggatggctgtaccgaactgtacgtgaagcatgtcacgattgctgaattcatgagaagcttattcactatttgacacacatgatggtgatggaactataacatacaaaggaccattgggatactgttacactcgagatctcttggagtcagaattcccacagaatgcagagttacacgtgatcatggactttattggtaacgtaaggatggcgtgtagttggttagatgtgctactaatttgaagtatactccgtgtaactatgtcgttgtagcaataatagaattggcgaaagtacaataattgacaagcactacagaactagggaatgaaagcacaattgagaggaaggcagttccgatgtgtattgattagatggatggcaattggctattatttaagtgctgcagtaatttcgtgcagtgttgattgtacaagacgctttgtgatgatgaacgttaatcagactgataggacagttgatgaacatgatcatggggaagtcgagaagtattgagtgagtgatggtcacagttagaacgtcttggaagaggttaaggtacaaactgaatgtctgccaaagatgaagagcttgttacgagacatgtgtataaaggttgcgttggtacaaccatgtcgctttacttgggccgtctttcgtttgtcagtagacttatatctgtagcaacggttactatcctatctgtcaacaataaatatgcgtgtatagtacataggaattcattcctcc

SEQ ID NO: 587675 - DNA, 185 bp, Homo sapiens
ctgactacggcggaagagagcgcttgactgatagagaggctcttgaactgatatgaaaaacaagagcatcccgagcggagggaacatcactcacagctcagaggcgggacgacactctgaggctctaagaaatgaagagacaaatgtggctagattggaggatcgaggcagggctaagagagtaa

SEQ ID NO: 587676 - DNA, 154 bp, Homo sapiens
attggacggagaggtctccgttgagagtgctgtgggagcccaggctgaatggacgtggtgaagggactggacagatgtcatgtgtggctcctcagtgggtgactgctgtcctgtggaagtgtgctgtgattgtgcagcaatgctggcgagagtg

SEQ ID NO: 587677 - DNA, 124 bp, Homo sapiens
gccccaccctaccaccagacaaccctagccaaaccaattatccaaaaaaaggatatggcgaaagaaaattaaaccctgcgcaaaatgaaatatgaatccgcaagggaaaagaggtaaaaatttt

SEQ ID NO: 587678 - DNA, 292 bp, Homo sapiens
cgagaggggccaaccaaaatttttattttattttttttagtttcagggtctcactgtcacccaggctgctcgagggcagttttgtgatcagagctcactgcaacctcaaactcttaggctcaatcaagtgatcctcttgcctcagccccctgagtaatgaggactataggcgtgtgccaccatcctcagctaattgtttttattttttgtagagacaggggtctcactctgttgcccaggctggtctagaactgctggcctgaagcaatcctcctgccttggccttatcgag

SEQ ID NO: 587679 - DNA, 365 bp, Homo sapiens
  misc_feature (4)..(4): n is a, c, g, or t
cganctctgctctgcgtcgaccttctgctctgcgtcgaccttctagctactaggctgacctgtctgatcttcactttccgaacttcattggcctggaattcaggtagtacagtatgtggtggatgaagccaactaccgcctgtaagctacaggatagaaaagagactactactaagtgacaagaagcaggactgaatgcctttgggggaaaggcggatggagtccttgctccttttccccaaaccccatggggctcaccgccattgctatggccatcccaggcttctgttgactgtgtccattgggagaaggaaaaccagtggggtcttaagaagtgattttcttggtcagagcagaaagtcgag

SEQ ID NO: 587680 - DNA, 332 bp, Homo sapiens
gtccttgcagtccttgtgtcacctaaatatccctcagttctgaatcgctccgcacctcggaggggaagtgtcactggagcgctgtaactcagcccgcattcttaaggatcccattcactgcttatgatggtagagctttgaattagatgtcaggctgttcacgtcatccagactctggttttcacgcttctgtgctgagacgagtgttttgatacgtatcagaggatgatgttcctattggacaataacttgctgtatgttctgagatactatactgcgttcatattgtaggcaccatcatcgtataaaacgggcgcctttaacaggtttca

SEQ ID NO: 587681 - DNA, 111 bp, Homo sapiens
gtacattcgcgtggggtcgtcttcgcgtgggtcgttcttcgtgtgggtcgttcttcggtgggtcgttcttcaggtgggtctgcttctcgctggtgtcatctccaagaaaca

SEQ ID NO: 587682 - DNA, 280 bp, Homo sapiens
ctggtgggagaaaaagagattgagggccccaggatctttcaccattgaaaacccaacagtctcactgcccctgcagataccacagctttagctgctcaggaccccctggaatctttgttaatgttgacctcagctgacagaaatgcatggagggtacactgctctgtcttcaccaaagctggaaccatccaactctacccttctaacagcctttttcccacccatggagtaagatttttttttttttaaatcagtgaaagcattctgtaaagtttcaaaa

SEQ ID NO: 587683 - DNA, 845 bp, Homo sapiens
gcagtcctagctgctggcatcactatactactaacagaccgcaacctcaacaccaccttcttcgaccccgccggaggaggagaccccattctataccaacacctatctgatttcggtcaccctgaagttacatattcttatcctaccaggcttcggaataatctcccatatgtaacttactactccggaaaaaaagaaccatttgatccataggtatggtcttgagctatgatatcaattggttcctagggttatcgtgtgagcacaccatatatttacagtaggaatagacgtagacacacgaagcatatttccacctcccgtaccataatcatcgctatccccacggagtcaaagtatttagcgtgagttcgcccaactccaggaagcaattatgaaatgatctgtgcagtgtctgagccctaggattcatctttcttttcaccgtaggttggcctgactgcttggtattagaaagtcatacattagacatcgtactacacgaaagtactacgttgtgttcacttacatatgtcctatcaataggagtgtatgtgcaacataggaggttcatcacctgtttcccctattctcaggtacaccctagaaacaagctacgcaaaaacccattactattatatcatcgggtaaatctacttgcttccacacagttctcggctatcggaatgaccgagttactcgaatacccgaggataaccaatgaaatccatcatcggaagcatattccacagagattaacactcagaggagctgtccagaagccataggacctaggtggttttgccccaccatgagcgttacacaagggcccccgtgcgcgttta

SEQ ID NO: 587684 - DNA, 486 bp, Homo sapiens
ggctccacgtttctgagcgtcttcttcgcttttgcctcgaccgccccttaccagacatgtctcgggatcggtcggatcggtggcggtggcggtggggcttccacaggcgtgaggaggcggcggcgggggctccagattccgttctccgccgcccggatgggcctcaatcagaatcgcggcccatggttcctggccgggccaagcggcctaagcctccgatcccgccaccgcctccagaccaacagcagcaacagccaccaccgcagcagcaccgcgcagagccgccacgatcagccgccgcgcatccacaggcgcatcagcagcagcagccgccgcaccgtcgaggactcttccaagcccgtcgttgctcaggacccggccccgctcccggagtaggcagcgcacccaaccaaggccttccaggcttcggggccccccggcccccggggccaaatttccccaagccaaaaaaacccttcggggggg

SEQ ID NO: 587685 - DNA, 292 bp, Homo sapiens
tccccacttaacacagcttgcttaatagaggtaatgtgcgaaaaatggggaaaaaattaaaacactgacttaagattctggttccttatctatccacttttggctgagtaaattataccagatatttaacctttgtgtgccggggctttcatcagtggtcctagtagttcgcctcctgcactgtgtcaggttaggctaaactctgttgcaataacaagttaccctctgaatctcaggtccctaggccatgagtttggttcccggttcccagggaatccaccatcatcggcag

SEQ ID NO: 587686 - DNA, 146 bp, Homo sapiens
cgctgctacaattaacgcacactcctccccatgcgccgattactccgctgcctgtatattgttggtgaccctagtgtaggtactggcggcgagccgcagacgtccggatcatccgcaccaatacacaagccgcttcacgggtaccg

SEQ ID NO: 587687 - DNA, 475 bp, Homo sapiens
gccacatgcaggccaaggggtgctgctgactgatggctccgagaaggacaagatgggcaaaggcggcaccaagaccctgatgaacaccatcatgcagctgcggataatctacaaccatcccaacatgttccagaacttcaagagagtcctttgtcgagcacatggggctcactggaggcttaatcagctggctggacctgtaccgagcctcgggtaaatttgagcttcttgatagaattcttcccaaactccgagctaccaaccacaaagtgctgctgttctgccaaatgacctccctcatgaccatcatggaagattactttgcgtatcgggctttgaatacctcaggcttgatggaaccacgaaggcggaggaccggggcatgctgctgaaaaccttcaacgagcccggctctgagtacttcatcttcctgctcagcacccgggctggggggctcggctgaacctccagtcgg

SEQ ID NO: 587688 - DNA, 259 bp, Homo sapiens
cccagtattctcgagctctgacatgtcgggcgagcgtacgcgtatcgatggcgcagtgaggcggcgcataagcatctaggccataaatattccggatatacgtagccggaatgtaacaaccgtactctagaatatagctagatgcgcaaattaaagcgctgatatcgatcgcgcgcagatctgtcatgatgatcattgcaatgggctccatatatagggccggggtaataataacctcaggtcgacgtcccatggccat

SEQ ID NO: 587689 - DNA, 367 bp, Homo sapiens
tgagacagagtctcgctctgttgccaggctggagtgcagtggcatgatctcggctcactgcaacctgcaacctccacctcccgggttcaggctattctcctgccttagcctcccaagtagctaggactacaggcacgtgccacctctcccagctaatttttttatttttagtagagacggggtttccccatgttgggcaggatggtctcaatctcttgacctcgtgatctgcccgcctcggcctcccaaggtgctgggattaaaggagtgagccatggtgcctggggagcaagtaaccattttaaagaaatactctcaacgagttctttttttatggggtatttcagttgttaacaaagttaaaata

SEQ ID NO: 587690 - DNA, 484 bp, Homo sapiens
gcttgcgagttctcgacggcgagtataacgtgctggttttacatgtgggtcatctatcacaggccagtagctcgtaagtcacgtcgcggcggtggacaccggggcagtgtgcccgagggctcagagggtcagcacacgatgccatgctgctggagggacatggaattggccctggacgtggcgagccgcgatgtggttcagaatcctacacagccccatcaaagtctccactgtactgactcccccacactgccgatcactttctgtgtacctcatgggctcacaggcctcagtttcctcatctatacagtgggtgtaccaccagccccacgcttgtggggagacaatagcccatgcttcagcgcccttggcatcaggctcaaatagtgtaagccattactagagctaattataattgaatgtttccacatagtccaggaagtagggaagattcccctcaacattttgccgaccaggaaacagg

SEQ ID NO: 587691 - DNA, 315 bp, Homo sapiens
  misc_feature (124)..(125): n is a, c, g, or t
  misc_feature (169)..(169): n is a, c, g, or t
ggtttggggggggccccttccccaaaaaataaggccccgggtggtatgtccccaaacccccccaaatttcctttttaaaaaaaatctttccccttgaaaggcccgccccccccccccggtttgnngccaaacttgttaagggaagggccggtttgttttggatttcccnccccccccttaaaccagggtttgggccccagggtgttcccaaaaatttgttgcgggaaaaaaaaaatgaactaaacccgtcttttagggatttccttttaccccccctgggaaaattaaaaaaatgcggggaaggaaaccgttcta

SEQ ID NO: 587692 - DNA, 538 bp, Homo sapiens
  misc_feature (435)..(435): n is a, c, g, or t
  misc_feature (457)..(457): n is a, c, g, or t
  misc_feature (510)..(510): n is a, c, g, or t
ttttttttcctgagacagagtcttgctctgttgcccaggctggagtgcaatggcacaatctcaactcactgcaacctccaccccctgagttcgagcaattctcctgccttggctcccgagtagctgggactacaggcgcccgccaccatgcccggccaatttctgtattcttagtaaagacggagtttcagcattttggccaggctgattttgaactgctgacctcaggtgatccacctgcctcagcctcccaaaatgctgggattacaggcatgagccactgcgcccagccgagagttttaaagaaaggttgaaagctcttcccttttccctaacctagcctggcttgattctgtttaataccaacctgtgttgaattggagttggaaaagccaaaattgcctgaaaggggaacccattgcccagaagggaaanaaacacaaacttccaaggccanatgctccaccggaactcctccaaaacagcccaagcccaggaaagaacagtccnggaaagaaccattaggcccagccccacc

SEQ ID NO: 587693 - DNA, 182 bp, Homo sapiens
tgcggtcatctagagagatcccgtccacatgtagcatagtacccatcagcatgcatgagagttccaggtgctccacatctttgccaacatatgatgttgtcagctttccgtctttaattaatcagctttattgaggtgtaatttgtgttcgaaaaaaacccttttaaaagtctgcacataca

SEQ ID NO: 587694 - DNA, 498 bp, Homo sapiens
cactgcatggtaagagccatgttaaatgaacctacattgctctaaagggatttcatatgctgatctttgaagacgatatataagacatagtccctgcttctggcgttttgggagttaacaatcgggattggaaggagttgggacgcctggagttattaaggactgactacggacatcattagtttgtttttatacttaggttaccaaaaaaccgtttctccatctttataacgcagttagtgcagcccacattccaagaacattgcaaaaaataatttgaacagctactacattcagcgagattgaagacttctatgggctggtccatactccatagataacggcttctgtggcaaaatgcgtttgaatttccaataaacaagtttacagcggcattcctggaaaataactccgaaatatgggaagcacttacacacctgcatggaagtactgactgagacttactgcttacttgctgcattttttagatgagttcaa

SEQ ID NO: 587695 - DNA, 731 bp, Homo sapiens
tatttcactgtcagcaaaaatcttttaaataaaaaagtaggatccaggtttagttttggtagcctcggttggcccgtcggcctctggcacgcctcgaccttctccggccctttggagcggacgttagggttgggtgtggctgtgcggggttcccgtggggcctttgccgaaattgcgcggtacaccttctcggccctttgcgaggacccggagagcaggcacagctgcccacagccccttagggggagctccaggggcccaagttgggttccaaaaggttgcagggattcttgtgcccctctgtgccctgtgaggatttgcggcttgctgggccccggtgtggttcaacgccgcgagtgtgccacattaccttctcacgttgggattaccctcctgtgaacccggcacattcatcgagttagtgttccccgaaaaccagcggccgtcatgagtttatcccggcacagaaagcttcatcttccggatcatccgggaaagagggacagaaggcggccggttggtgcgactcataaacaacctcttcaacacaaccgggtcgaatgtgcgcagtgggtactcctgggccaagaaacctgtataacttgtgacccaagcagccctacaggtaagatatccgggctctgggggctccttgcgccagaaccattcggaccttgatatggcgagatgtccacatcccatgatgggcgctccctgctccgggggagaca

SEQ ID NO: 587696 - DNA, 375 bp, Homo sapiens
ggccacttgccaaacctagattcccatcactgctcaaatgctccttttaaaaactaattttaaacattcatttacttattcatacagtcttttaaatcaagcattaatcaagtgccttggcagtaagaatatagtaatgattaagttagacaaaatttcctgtccccatggaataaaaatttctagctattggagacagataagaagcaagcatgggacagaaatgggagacagatgggtgaagctggaaaagcagctgtggttcccaattgggtgtcattaggggaggttgcccagccctgaaatactggagtgagtgaccatgccattcaccagcacaaccacaccactaagcatgccactaccagtcgacgc

SEQ ID NO: 587697 - DNA, 985 bp, Homo sapiens
  misc_feature (17)..(17): n is a, c, g, or t
  misc_feature (152)..(152): n is a, c, g, or t
  misc_feature (380)..(380): n is a, c, g, or t
  misc_feature (387)..(387): n is a, c, g, or t
  misc_feature (391)..(391): n is a, c, g, or t
  misc_feature (397)..(397): n is a, c, g, or t
  misc_feature (406)..(406): n is a, c, g, or t
  misc_feature (818)..(818): n is a, c, g, or t
  misc_feature (835)..(835): n is a, c, g, or t
  misc_feature (838)..(838): n is a, c, g, or t
  misc_feature (905)..(905): n is a, c, g, or t
  misc_feature (907)..(907): n is a, c, g, or t
  misc_feature (980)..(980): n is a, c, g, or t
gtgtctgtttgttaatngtggtggttgggtgggtattccgggatgcttgatacgctccatactgggagaggcttctgggtcataggtcagtctgcagagggatcttgtggctggtagtgaggtggctccacacggtcgttgctgctaccggngctaggttctgggcatcaggcacggccatgatccttcgaggctcttctgggtgtggctgctggttgctggttcccaaggtgtgatcgatggtgatatgtggctggtcgatgggggtgctaccaaccagggttgcgtggtgatgttcttttgaggttagtggggtactgtgtgtgatatttgtgggatttgattgatgctagtgttgtctgctgggttctgggctttgngaacgcnaccnaggctntgggcaganctgccttcgggcaaggatcaggccccatcatgctggacgaggtccagtgcacgggaacgaggcctcactggccgactgcaagtccctgggctggctgaagagcaactgcaggcacgagagagacgctggtgtggtctgcaccaatgaaaccaggagcacccacaacctggacctctccagggagctctcggaggcccttggccagatctttgacagccagcggggctgcgacctgtccatcagcgtgaatgtgcagggcgaggacgcctgggcttctgtggccaacggtcatcctgatgcaactggaggccaggccctgtggaaggagccgggcagcaatgtcaccatgagtgtggatgctgagtgtgtgcccatggtcagggaccttctcaggtacttctactcccgaagnattgacatcaccctgtngtnagttaagtgcttccacaagctggcctctgcctatgggggccaggcagctgcagggctactgcgcaancntctttgccatcctcctcccccaggacccctcgttccagatgcccctggacctgtatgcctatgcagtggctanagggg

SEQ ID NO: 587698 - DNA, 413 bp, Homo sapiens
  misc_feature (344)..(344): n is a, c, g, or t
  misc_feature (357)..(357): n is a, c, g, or t
  misc_feature (373)..(373): n is a, c, g, or t
  misc_feature (411)..(411): n is a, c, g, or t
aaagtaacaacattttattaaattaaacgtgaatgaaattattgtgaaagtgtgtttacgtttaaaatgttggattcgcttgcaggaaagaaaaacctgtaagaaagaacagttgcatttaaaatggatgatctgacaccttccggttccttaacacaaaattacaaagtaagttccctttaaaagacaaaatgtaaatactctttatatcatgcaacaattcccatgtttaagtctaccattcatcttttaaatgaaaaatacacattttaaaatgctaacaacggttttgacagaggaaggcaaggctgtatccaattaccgaggatgtttccagtgttaantcatatatttccnctatttcggggtaccntttttctacccgtaggggtacccagtccttaaggtttntg

SEQ ID NO: 587699 - DNA, 171 bp, Homo sapiens
ctatctagagtatccccccgcatctgggggccaggagaagttggcgcttgctgcccattcctccgttggcgcactcactcacccgcctcgctgatgttgtcatctgggtgctccgcctgggggctgaggaccctcagacccaggtggtactattcaacgctttgcacgatg

SEQ ID NO: 587700 - DNA, 786 bp, Homo sapiens
  misc_feature (181)..(181): n is a, c, g, or t
  misc_feature (188)..(188): n is a, c, g, or t
  misc_feature (192)..(192): n is a, c, g, or t
  misc_feature (198)..(198): n is a, c, g, or t
  misc_feature (207)..(207): n is a, c, g, or t
  misc_feature (619)..(619): n is a, c, g, or t
  misc_feature (636)..(636): n is a, c, g, or t
  misc_feature (639)..(639): n is a, c, g, or t
  misc_feature (706)..(706): n is a, c, g, or t
  misc_feature (708)..(708): n is a, c, g, or t
  misc_feature (781)..(781): n is a, c, g, or t
caccaaccaagggcccgcgtggagatcttctacaagaggccaagtggggcacctgtgtgtgacaacactgtgggacctgaactgatgccaagcgtcgtcttgccgggccctttttttttctttctcttgtgtttgtgttttgtgttgttgttttttttttttttttttttttgggctttgngaacgcnaccnaggctntgggcaganctgccttcgggcaaggatcaggccccatcatgctggacgaggtccagtgcacgggaacgaggcctcactggccgactgcaagtccctgggctggctgaagagcaactgcaggcacgagagagacgctggtgtggtctgcaccaatgaaaccaggagcacccacaacctggacctctccagggagctctcggaggcccttggccagatctttgacagccagcggggctgcgacctgtccatcagcgtgaatgtgcagggcgaggacgcctgggcttctgtggccaacggtcatcctgatgcaactggaggccaggccctgtggaaggagccgggcagcaatgtcaccatgagtgtggatgctgagtgtgtgcccatggtcagggaccttctcaggtacttctactcccgaagnattgacatcaccctgtngtnagttaagtgcttccacaagctggcctctgcctatgggggccaggcagctgcagggctactgcgcaancntctttgccatcctcctcccccaggacccctcgttccagatgcccctggacctgtatgcctatgcagtggctanagggg

SEQ ID NO: 587701 - DNA, 329 bp, Homo sapiens
catcctacccgacgaggtgtcctcacattgaagtcactatgacatttatgccaatggtatactcaatgtctctgcctgtggacaagagtacgggaaaagagaacaagattactcatcactaatgacaagggccgtgtgagcaaggaagacattgaccgtctggtccaggaagctgcgaagtacacagctgaggatgaccagcagagggcctggtgtcatccagcaattcactgtagttcctatgccctacaacgactgaaagcaactgttgaaaataagaaacttcatgagtcatgattaacgagtgagggacgtgcagaacattctgg

SEQ ID NO: 587702 - DNA, 447 bp, Homo sapiens
cagtctagaggaaattccttaatttgattgggaacttgtatatttttgttaaagcctgtaaatttctcttcttgccacatctttacaagcaatagtctttgaacgtctgtattttttggtgttaatatctgtgctttttttccttttgttaggaagtgaatatgaggttattactttctttaaggattgtaggatgagctggtcacggtggctcacagccgtaatcccagcaccttgggagaccatcgcagaattgcttgagctcaggagtttgagaccagcctgggcaacatagggagattccatctttacaaaaaattagtcgtggcatgtgcctgtggtcctagctactcgggaggctggggtgggaggctgcagtgagccatgattgcaccactgcactctagcctggaaaacagagtgagaccctgtctcaaaaaaaaaaaa

SEQ ID NO: 587703 - DNA, 852 bp, Homo sapiens
tcaccgcgtgagcagacgcggagtgctgtgtggccctgtggcgagatgccgtacgccaaccagggtaccgtgcggatcacggcagctcactgacgagaatgtcaagttcatcatcgagaacaccgtacctggtcggtggccaacttcgattcggagggtcttcatcgctgaggcttcccataatagccattgactgggcttcagattgatgccagattcctcagtcccttcagtgagtgaattcatatgctcacagtgcttgtgattagattcccctctattcagtgatgagcattgtggacaacgcgtgcagtactcgtcgtggactgcgacatgtgacggagttcctgcgccccgagctgcctctggtggaggttcacgcctcgactgtgccggttgcaactgaatgaccacgacgcggaactcttgtcgaccgttcgtcgatgcacgctcattctcgcatgacaagtgcgcctcgggatcgatatcgcgtgtgtactattccctgtgaagccgcagattaacttgatgcgcccaattgaacgtacctgtgtgacgctcacggcatggacattccttcagctcggtccaatgtctgacgcaacaggcgccatagggatggcttgaggaaccttcccgcaggcgcctattgtcccagtaaatggcgcctatttgcggccaagcgtacggcacttgtcccagaggattgtggagtggcctcgtaacgtcgtcaagcggcgatagggcctttgtctggatagtagcgactacccaagaagccaaattggccccgtgagggggcatgtcactagtgttgttaggccccccatgtgcgcgccgatgggtaacttg

SEQ ID NO: 587704 - DNA, 179 bp, Homo sapiens
  misc_feature (40)..(40): n is a, c, g, or t
cggttcctgtctgttataaaaggacaacgaatcaacaggnatatactagtggaaaacacaatataaaactaaaatgccatggcttctttaattggctaaaagcaaaaatgtaacaggcagaaagtctgtgtcacccacttaacaaagctaggggtttttttaaattcgttcccaaactc

SEQ ID NO: 587705 - DNA, 395 bp, Homo sapiens
gcatcgatgaggcttggctgcccatctcagtaggccaagtaagtaaactaggtaattgtagaaaactgacagaggagattctcccagtgttgccacatgggaaaaggagcaaagagagccagtgacccctataccagattttagggtccttaatacaaggtttaggcttaaacagaggagaagacagtagttctcaccttgtaacctctttgggggcatctaatgacttttcacaggggtcacatatcagatatcttgcataacagatatttatgttacaattctttgttcgtttgtttgtttgtttgtttgttcgaggtcagtctggtctacaaagtgagttcccagacagccagggctacacagagaaaccctgtctcgaaaaaagtcgacgc

SEQ ID NO: 587706 - DNA, 269 bp, Homo sapiens
acacatggcatacggctcatgcagacattcagatacaaaaatgggtgtgacatatttccacgaagaggaacagagaaggacttgcaaaagatatgtaggcttgccattcattctcgatatgacgacttcgataatggatggcttcaatgtgttatataacaagaagcctgtcatatatcttagtgctgctgctagacctggcctgggccaatacctttgtaatcagctcggcttgcccttcccctgcttgtgccgttaggccgatctga

SEQ ID NO: 587707 - DNA, 101 bp, Homo sapiens
atcttagaggaccccctcctttcctcccttctctctccttcatatcatccaatttctgctgcaccattgtatctgaaaagtctaatttttgaacagcactc

SEQ ID NO: 587708 - DNA, 181 bp, Homo sapiens
tagggcccgaaaaatattcccgcccctaaaaatatttatttttttcccttttgagaatgagaaccctggataaccccttttgttttcccctttgcccctgtcctctgattttatgcttttcttaacctacccatatgttctttttggtagaattaatgccaaaattaatatatagtggtga

SEQ ID NO: 587709 - DNA, 350 bp, Homo sapiens
tgagtggcatgtgaacagtggatgactgtaatatgcaaagaaaaagatactgcattagagatcataccacttaaatagtctcaaaatgagatgactagactttagataatgaagctggataattatgcagcagattagttatgggtaatatagggtaatacaaatgatcattttaaaaattctttttaatttcttcaaaagacaacagctaaaaggaaagttgcagtgttatattatgggttgtatcatgtatgtacgttaacatatataacacatggctgggcgtaagtggctcacgcctatatcccagcactttgggaggccgaggcgcgtggatcatgaggtcagga

SEQ ID NO: 587710 - DNA, 676 bp, Homo sapiens
  misc_feature (115)..(115): n is a, c, g, or t
  misc_feature (170)..(170): n is a, c, g, or t
  misc_feature (199)..(199): n is a, c, g, or t
  misc_feature (236)..(236): n is a, c, g, or t
  misc_feature (285)..(285): n is a, c, g, or t
  misc_feature (361)..(361): n is a, c, g, or t
ttagtaagcttccaacttcttagatatcatgcctaatactgccatctagcgttctaattagatatttaatcctcagagtaaagattgatcaaggaagcaagataacctaattatngtctaggtgctgtaatatctcatgtattaaggtaccaaaaggataggacataatntaagcaagatgtatatgcgttccaacttntcactcaggaattcttctacactgtctgtgttccatntagaatggctcagttcttcagcaatgttcccattgtcgtccaaaagctntaatacagagtctgaaccacggacatactagagctggtgaggatgtggagcaataggacctcttaatcacttgatntgcagtcctctgaacagtcatccacaaacttcaagaatagctcctgcatacagctttttggtttcaaattgtgcttcctcctgacagcatcctctgcaatcaggatccagctgaagcaggttgaactgtccgagaagatcacaagagctgcaaagcaagttgctagaaaagcctaactctctgcatgcctccgatgaaaactctgccccaaaagcagacaccgcttgaagcacagtcgccaacaacaaccgtagcacaaacgccggcaccagacacccactcggctcagccgccatcgctaccattctctcgtgc

SEQ ID NO: 587711 - DNA, 723 bp, Homo sapiens
  misc_feature (67)..(67): n is a, c, g, or t
  misc_feature (70)..(70): n is a, c, g, or t
  misc_feature (74)..(74): n is a, c, g, or t
  misc_feature (78)..(78): n is a, c, g, or t
  misc_feature (81)..(81): n is a, c, g, or t
  misc_feature (91)..(92): n is a, c, g, or t
  misc_feature (102)..(102): n is a, c, g, or t
  misc_feature (113)..(113): n is a, c, g, or t
  misc_feature (116)..(116): n is a, c, g, or t
  misc_feature (119)..(119): n is a, c, g, or t
  misc_feature (128)..(128): n is a, c, g, or t
ccacgcgtcgtcgacccacgcgtcgctgcgtcgctccgggagctgccgacggacggagcgcccccgnccncgcncggncgncgccggcgcnncatgcccttntccaacagcanagncantgaagctgngccccggccgaggacgagattccccgacactgagacgcccagcaacaagccacatggccaaggatgctgacccccgagactgatacgcggagctgcgcgccaagagcacagccgagcggcatacaacgctaggacgacagatacaatccagacaggcgtggacaaaccgggccacaccgctacatcactgaccagttgggctgcagatggacggagacgcacgcggagttccataacgaagcagataacaaggactctcatgtcgaccccagatcagtcgaggaccggccaccagcggactacgaaggccccacgcggatgagcaccaacggaccagaccactcaaccgccgcaaccgaaacccatgcaacggcgccaggctcaagaacagaacacatggcgagaccccgcgaaacgtaacagttttgactgaagccatcagccagcgagatgccgccacatcgaggcccagaaaggcaaaatcacacgagtgagcactcgacgaccatacccaccacggccaacgtagaacgcaccggacgggggaggcaagcgcagcagcacaacaaacaacacgccgtacaaccgcgcggaa

SEQ ID NO: 587712 - DNA, 258 bp, Homo sapiens
aggatctgggaggcaggaactgcataacaaagctttcttcccctgcgacacagtctcgctctgtcacccaggctgagtacagtggcgcgatctcggtcactgcaatctccactcccgggctcaggcgattctcctgcctcagtctcccgagtagctgggactgcaggcgcccgccaacacgccctggctagttttttgtatttttacgtggagacggggtttcactgtgttcaggatggtcttgatctcctgacctcg

SEQ ID NO: 587713 - DNA, 892 bp, Homo sapiens
  misc_feature (2)..(2): n is a, c, g, or t
cnaccgcttgtgggtcgggcggccccagcccggctgtttagtcccgcccgccaaccagctggggaaacgcccccgttgtggcgcaggcacgtttttcggccgcagctgggagaaccgctttgtgtgcgcggccacaacgattcattcccggtgacttgcttccgccttatgtgtgggacacggtggtcgcggtccccccacttgttgtggacacagctcctgcagagaatgtctttcttcgggccggcgcaatgtagaccgttacgggccacccgcgctgcgaggggggggtcatctcctccctgttctcaaccgcgcccctcttgcgggccccttccttgtagtgcacgtgccgctctgggcggtgtcctcaacgtgagggagaaattgtccgcggctgctgcagacgagtaaaattgctattaacagaggggatgttttgttctggcgacccgcaagaatttatagactatgcgtccttcccgctccctggccgaactcctccgctcctttgtccgtttattatgccacacccccctgcggaggccgcgtctgttctcgtaggggcgccctgtttcaagtggcgcgcccccctatgtgaataagggtaaaaaagcgacccgcgggtgcacaacggggcgcccccccccctttgtggtttaaaacggcgcgcacggatgcgtctgtaaaattcgtgaggcgctgcgcatgttctgcctctttctcctcaggaacagaattgtgcggggctcacctctgtcgtcacagctctttctgaagctgcggaatgtcgcgtctgacaaactatcacgccagcagcagtcatagtcgtgaccgagtggccggtcgagtgtattaaaaaaaaaaccactttctttttttcaaccataac

SEQ ID NO: 587714 - DNA, 266 bp, Homo sapiens
  misc_feature (157)..(157): n is a, c, g, or t
  misc_feature (191)..(191): n is a, c, g, or t
  misc_feature (212)..(212): n is a, c, g, or t
gctgcgcgcgttctagaggatccctagcccagcgaacaaagttccgtgcagaggaggttttttaggggggtggggatggagagcagtagggaaggcataaccaaggaaagaaactttctagcttttcaattctactatcttctaaagtcttatcctngtcttcacaccgtttggttcacattggtactcangtgttcagaagagtgtctccnccttattttactcaatcatatggctggttattcatttaagtaggatttaccaaa

SEQ ID NO: 587715 - DNA, 574 bp, Homo sapiens
  misc_feature (109)..(109): n is a, c, g, or t
  misc_feature (113)..(113): n is a, c, g, or t
aacatagggcaatctcacccacttccacctggttgggttttaaagctcgcttggtctccacccaggttcccacgaggggtacatacctcctttctggggcagagactgntccntacccatatagttgaaagtcgtttaggaactttccccctccctacctacctcccctttaatagcagaaatcctattctcccccgtgattatgcgtatgatcacccctgcaacactattatgtatctgagtgtgcgtgtgtgtgtatgtgtgtgttctgggggaagggcggcgtctcctaaaatttctgcggtttgtgcctttttcttccatacattcgttcacaccatcccatgcccagggaccactccctggcactatcgcatgctgggatcatccgggcgagcgtacgcacgctcaccactgtcctttgttttcgacatttttatcttcgcataagtactccatcccatccagatacctgactaactgtattcccctttcccctctggctgctggtgtaaataaactccatctccccattggtaaacagtaatcaaattttaaaaaatgaaaaaaaaaa

SEQ ID NO: 587716 - DNA, 254 bp, Homo sapiens
tctacccagaaagatcaccaatcattgattcgctcatttaacaaatatgcagcctccgcacgatgagctctcctgcagacaagcatggtctgaaacattctttgagcaatatcatatagagtgcctactatgtgttaggtactgtgccaggaactgataagccagaggtaagggacaacacagctctaaccgtcacctcattctccaggtaacaaaggccaatgtagcccctttgaatctagcagagaaagtta

SEQ ID NO: 587717 - DNA, 961 bp, Homo sapiens
gtcattggtatacagtcccaggtgtcaaatgctgcagcctgccaagctgtgattgggtgaggctcgtccctatgtaggatgctccagaggccgcctggcacacatgaaggagtgtagcaagagagagctgtgggtctacccatatgcggtgccgaccaaaggtggcttgcgtcaagcaaactaacctgatgtacactctgtttggaactgtctatgttccccgtactgtaggatggacgtctcgttttctgatggagagagtccgaggatgcggatggaacaatgtcctgggttcacatgctcaggcatcccccactatgggctgttcgatcatcttcagtgcctgaagctgcacgacctgaagttcgcctgcatttatcaggccctctttgtgcgtgtccttgccaccttggggttcctgctggtgaccatgtgtggttgtggcatgtgtgagcagaagggaggatgaggacgaagagcagaaagcccggtactgacaagctgttatgagtgccactgtgtgccatcatctaagccactgaatcaagtgtatttcaggcttatgtcaacattccaatgccctggttttcctgcctgaatctgttcgtggtcacggttggggggaatttgtgaccctggaaatccccagagtgaaagatggagctgggcacatcatgaataggcttggccccgatctctcaaagcctaaggtgctctgcgggactgctgactgccctgattggaacaggccggaaattcctcctctggttcaatgtcaattccccattctaaggcaaacgggttacagctccgtatgagggggtggggaggcttggacctcggttaagaggggcggaacttacaggcagttgacaccccacacagtagggttgcaaacacggtgaccagacacaaaggacattctgcaacaggatgagggaggagaacacagagaggagga

SEQ ID NO: 587718 - DNA, 1098 bp, Homo sapiens
gagtgcgttggagcgctggaaatctggaacctgggatggcgacgtctacactgagtcgtgagtgcgaagtgagcttattccacgtgtgaacagcctctagataatctgagttgttgaaaatacgaagcctgttactctgtgaacatgtggctgacaacagtgttgtttgtgagcctggctgtctgcttggacccagaggtttcgtctgccagtggttttttggttgtatttatggatttcatgggaaaagtgtccaagctttcagtgttggagcagtgtatgtgactgacaaatggctgaccctgagcaatgagtgatggcacctaatgtgccatcaaacccaccagcaaagagttcaggaaaacatggggttttcgaatggaccactatctgccaagcgagagggcgcaggggactgcggagtgctgacccactggagccgccacccccacagcagctgcttgggcctgtccctgctggctgcagttgggaggcatgcccaagctgcactgagcgctgtgggagcagttcctggaccatttgctgctggctcctgcgtgcatggcaggagcatgcctgtctccctggagggattcttgtgtgagcccactgtcctgcccctgacacatgacgccgagacatgcctccgaggggcaagacgtggaaagctgcttctgagaccagaaagcggccacagtctggttccacagatgtgaaggaacgaccagactcttctgaacaggtgaccggaggggatgaccacgattgaccctccgatggtgacagctatggcctgatcctgaaagagcttcagaatctggcttcgcaggagccgtgaacaggggcccaactgagaagccccgaaagggaaccagaggcgcctcggaaagagctccgggcagcaaggaccggagacaaatgtgagaccgaaggcagtaaacttagtgcgaggcgccagcccagatacagacacggaaacacgagattgtgcacaagggtaacatgtacaaactaagtagaaaagatacgcaaacagagaaaggaaagaggcaagcaaataggaaacccagactatatacagacaaacagatgaagcca

SEQ ID NO: 587719 - DNA, 1281 bp, Homo sapiens
tggtacctctttttgtgaagctggcagctgatggagactccgtgctgctctgccatggccctgactgaaaagcccaatggaaggatgtcaatgacctgacgaacacacgactcatactctaactcttgaacggtggctggggcaggcatggcttcctgtgcgctgcacgctttacacgcactctcacgcaggcactaccacccacctctacgctaacacctaacttgcaacgcctacttgctgacactgacacgggcacttcgtcacactgagcgcacgactcacgacttccgactcttgaccgtggcataccaactcaactgcaaacacgaccacactctgcgacagctctcggacacactggacgctgcactgacacgcactaccacactctgactgctgctctccacacatgcacatgcacccggcgacgggttgcctccatactggcaacccacggcgacacactgcgtctcatccctacctcgcagcacatcacatcattgctttcttctctacccacgcaaccccacaggcaccttaacacattccctaccacctctacgcacagcaatcctgctaagttcatgcgtactcgctacccaagcaattcgctttgaatcgaaccatcacgcgggttacttagcctattctctccttccattacgtatagcgcatctttcaaccctaaccaaccacgtcgaccatttccacccccagaatctccgcccgtctacaaccttcagggtagaccacttaatacaccgtctaccacgcctgggggcatcaatatattaggttagccacccaccatggcacgcactaactctgagcccagcttcactacgctacacagagctgccagcaaccagaataccccccgctgcacgacgtgaccgacccccaccccaccaatgcgggaccgcaccagcgagcacccaccggcgggacgctgtgtgaccccacccctgcacacacatctggaccaaccaccccacacggcgtgccaaccgttgcggactacggaaccaacatagacgacacgcggagcaacaccgtacacggagccggaagacaccccaacacagcccgccgccacacatacccaccgccacgccacaacaagacaggggcacacaacgcagccaccacacaccacaacggaagcccgacagctcaccactcatgtgcagcagacaatcactgaccacagccgacgcaacacagccgataccaatccacacagctagcctcagccacccaccggcggagccccagcaa

SEQ ID NO: 587720 - DNA, 500 bp, Homo sapiens
  misc_feature (24)..(24): n is a, c, g, or t
  misc_feature (96)..(96): n is a, c, g, or t
  misc_feature (105)..(105): n is a, c, g, or t
  misc_feature (111)..(111): n is a, c, g, or t
  misc_feature (136)..(136): n is a, c, g, or t
  misc_feature (142)..(142): n is a, c, g, or t
  misc_feature (146)..(146): n is a, c, g, or t
  misc_feature (149)..(149): n is a, c, g, or t
  misc_feature (167)..(167): n is a, c, g, or t
  misc_feature (194)..(194): n is a, c, g, or t
  misc_feature (205)..(205): n is a, c, g, or t
  misc_feature (221)..(221): n is a, c, g, or t
  misc_feature (228)..(228): n is a, c, g, or t
  misc_feature (288)..(288): n is a, c, g, or t
  misc_feature (361)..(361): n is a, c, g, or t
  misc_feature (425)..(425): n is a, c, g, or t
  misc_feature (493)..(493): n is a, c, g, or t
aaaaaagcaacaagaaaataattncagagtttatacaaaacatctttacattattttttttccaaaaagactagtatttacacaaatggcaacagnaaacaaaancaaaancccttccgactgccacccggaaggngctggntgtnctnctccctctcccacctggnactggggtgggcagctggccagggggnagtgtggaggnggatggtgagaggttnagcaccntccatggctgctcatgggagagcctgcaagggcactcaagtggcagtctgttagcaccgngctggcaaggaactggggtcaaagtgcacagcgggctggcccagccccaggcagcctcttcctctttccaggncccagacccaagactgggacagcagcaggagcagggttgggtgggggttacccacctgtgctanggcccagaaaaggagcaggccacctggtctaaaaccgctaggtcctccacccctgggccccatgtttncccacca

SEQ ID NO: 587721 - DNA, 231 bp, Homo sapiens
  misc_feature (12)..(13): n is a, c, g, or t
ttaaactgagcnncggaacagcggggtgtctccaaaaaccccctggtgggccttaaaacgtggcccaataagcctctttggccaagggtttccaatgcaaatagcttttaactgtaaagatgtttgtaagaatgcattgagaaaaaaaactcgtgtaagtttcctctttatctgcccccgtaaaaaaattacagtggtagatttttctgataataaaataatatgatgttg

SEQ ID NO: 587722 - DNA, 180 bp, Homo sapiens
  misc_feature (1)..(1): n is a, c, g, or t
ntagctgtcagtcgatctcagagttagctgagtgatcagcagacagttcctatgaagtgaacaagtcccagaggaccttactgattaggtccacaggtcttcctctataggctcagtagatgaaggcgtttctgagggcttgcttaccacttcaaatgcacgtctagacactcaatgctc

SEQ ID NO: 587723 - DNA, 267 bp, Homo sapiens
ctgcgggcgactcatagaggatcccggctgcctagcactaccgatggtagtcgccgtgtctaccatggtgaccacgggtgacggggaatcaggtacgattccggagagggagctgagaaacggtaccacatacaaggaaggccagcaggcgcgcaaataacccactcccgacccggggaggtagtgacgagaaataacaatacaggactctttcgagggcctgtaattggcatgagtccactttaaatcctttaacgaggatacata

SEQ ID NO: 587724 - DNA, 955 bp, Homo sapiens
tttgccgatccgccgcccgtcacatgccgaccggcagactcaccatggatgatgatatcgccgcgctcgtcgtcgacaacggctccggcatgtgcaaggccgggttcgcgggcgacgatgccccccgtggccgtcttccccgtccatcgtggtggcgccccaggccaccagggcgtgagtggtgggcatggtgtcagaaggattcctatgtgggcgacgaggcccagagcaagaagaggcgatcctcgaccctgaacgtaccccagtcgagacacggcatcgttcaccgaactgggacgacatggcagaaatatctgggcgaccacacgcctttctacgagagagctgcgtgtggcgtcccgaggagcatcccgtggctggtgaccgaggtccccctgaacaccgcaagggcaagcgcgagaagatgacccagtatcatgtttgatcgactccttcatacacgcaccagcacatgtacgttggctagtccatggctgtgcgtctccctgtacgctcgtctggcgcgtgccactggggcatcggtgatgagactccgggtgcacgggtgtcgcccaccagtgtgccccatctacgacggggtatgcccgtcccccgatgccgtccgtgggtctggacccttggctggtcagggtagctggactggactatctcagtggatgatcctcgaccgaggcgcggggtacaggttcggcacccgaggtccgacgcgggaaatcgtgtgtggcatggaaggggaagctggtgctacgtcggcctggtaattggagcgagagatggtcacggctgtttcagctcctgcctggggaaagggctaggagctgactgaggccgggtaatgccattggaacgggcgggtcgttgcctgaaggccctttacaagcgtcttccgggtgggggcctggggggccgggaagaccttaggccgactgaatgg

SEQ ID NO: 587725 - DNA, 219 bp, Homo sapiens
tggagtggtgggaggatgacttgagcacaggagcccagagtagcctgggcaacacaggaagacctcgtttctacaaattataaaaaaaaaaaaaaattagctaggcattggtgcctgttggtcccaactactcaaaaagctgaggtgtgaggatggcttgaacctgggagttctaggctgcagtgattgcactactgcacttcagcctgggtgacggtg

SEQ ID NO: 587726 - DNA, 111 bp, Homo sapiens
tttttttcttttagccaacgtaacggtagtatatttaacgaaaatactacaagcacaaagttagtctggacgtataatatggatcacaaaataatatttaatttcaccagg

SEQ ID NO: 587727 - DNA, 346 bp, Homo sapiens
ccaggtgggtcacgcgggtctcgaactcctggacttcaggtgatctggcccacctgggcctcccaaggggtggggattacaagcgtgagccattggtgcctcgctgagtcacctttttttacataaacaacttctataatacatagtccagagtttccgggttttaatcccataagggggatcaagaaacggagtatacaagttcaggaattttccctccccatctttaacctaattctatagctctttttctttctttctttttttttaaagcagctcatcggtgggttccctaaaacattctaactttatcagttatcaaaatatcaaaacttctttattacac

SEQ ID NO: 587728 - DNA, 538 bp, Homo sapiens
  misc_feature (184)..(184): n is a, c, g, or t
tcttgaaaccgggactttatttacaaatatttagattaaatagcattttgttacattaaatgaagagtacagcagtctgaataaatcctttagtcaaaaaacaataaaccactgaactaacttgggagtcaggtattgacctaacaagccgcagtcttttagttgtgattgctacctttatatnccaatgggtgggttggtttgttttgttttttgaaatatacacacacaccagcaggtcatgtcccctgggtgagtcccttgtgatgcaacagtgtaagcaaaatggatcactgtaagtctttaacagaatataccaatctactccagaaatcttattttttttcgtgccgaattcggcacgagggaacactgatgatcacttaaaacatttaaatttaaaattactactaaaaaaaaccctgtacaatcacacaaggccaatgcctttgtggtttttacagacatagaatttttgtaggttttgggccctataaacaattttatttaggactggaataccaaataccggaataaa

SEQ ID NO: 587729 - DNA, 402 bp, Homo sapiens
atttatagactattgccacataatttttttttgtaatgaaaaaaaaggagacaaagactttacggctaacgttaatttctgcagattccaacttaaccagcaatggggtcaatccaaaaactgagttaagcatctttggcaaaaaccagaaaaccacagtcacaaaaaagactaaaaattctatccttatatggaaaagataggactttattcaaattagatggcaatattttacagttataaagctatatagtttcatggaattgatggggtacaggaagtgctaccccaaaatatgtcatctaggcattttagaaaacagaagcagaaagaccactctcacaaaccacccccaaaatctcctatgaagcaggttataaacctacacctgtaatccctgct

SEQ ID NO: 587730 - DNA, 264 bp, Homo sapiens
atccccagtttaggctattctatagaaaaacgcatatactttctatcaaaaagtgagcaaaagagatttagaaaaggctgcaaattaagtgaatctaggctcagcgtctacctttagctacaacaagtcataattagaaccaagccatgtgttgtggcacacacctggtgtccacggtagtcactcctttttagcaatctctccccactcctttctctcagcttcttacaaccatttatctgctttctgtctccattgatctcg

SEQ ID NO: 587731 - DNA, 386 bp, Homo sapiens
atgtgcctgtggtctcagcagctcaggaggctgagttgagaggatcacctgagtctgggtggtggaggttgcagtgagccgagatcacgccactgctttccactctgggtgacagagtgagaccccatctcagggaaaaaaaaaaagatccagtatttgatagcacagcagggtaactatactaaaaaataatcatacattttaaaataattgaaatagtataattggattgtgtgtaacaaaacggataaatgcttgtgatggagaccccatttaccctgatggtgataattatgcattgcatgcctgtatcaaaatctcatgtaccccataattatttacacctactatatacccattaaaattttttaagttaaaaacataaa

SEQ ID NO: 587732 - DNA, 845 bp, Homo sapiens
  misc_feature (305)..(305): n is a, c, g, or t
  misc_feature (451)..(451): n is a, c, g, or t
gttttttagggggcaccacaaattgatttttcgcgtgggttgataaatattataattggccaaaggagagtagtcctctgataactctagcactctatcatctccatcatgtagagaagaatgttttattggataattaggggcgatatacaacacacattactacaatagggtgccccaccaccattgggggtgggtagcacgggggggttcaactacacacccccgtggttgggaaatattctcgtatggccatggagaagattctttggtgatacttacccacaataatactagagagcacncgccgcttgaggagagacacccgtcttgccccacccctctgtggtgatatcacaaagcccatcacagaggaggagcgccgctctctgtcccgacaaggtaaatttgtcctactatgagaaaagcgtgagcccggagatcgcccctnttctccctgtgatattgggaaatatagtgagatgctataaaggcgcgttatacctgggggaggggaccacgcgcggttttcttggcgcgcacacagtgtggttttctacatcctagagggtatatagagagttaaaggaatggctcaagcacacttgctcacttcttggatggctcttctgggccacaaaactgcacgtcacctgagatgagccacagaggcacgcaccgaaaggagacttggagacctatccctctgtaaaagagtttcctctgatgggtaatggggagccacaaagcctcccttttcagtgacctttgtgtacagcaaccaagtgggctactcataatgggcttgattttttggggataataaaatgaaaaaaaacttttta

SEQ ID NO: 587733 - DNA, 253 bp, Homo sapiens
agggatctttacaggacaatccaggactacctttaagaattatccctgaacgatatgcattcaaaactcttctcagtgcatccccagggactctgagggctagaagcactgtctgattgctttctctactagtaactccatagccctagcttggaaaatcagcaccaagttggaactcgctgacagaggtctcgaacaatgcgtatgataatcacacaggactgcagcaccattagctctagcctggaaccac

SEQ ID NO: 587734 - DNA, 221 bp, Homo sapiens
gctgagggtcgattcttacacgatcttgggagggcagcacggtgctcacgtgtcgacggaacttgtccaggaggcatgcaccgcagtggtgaatacacgtcgaccaggctccatgtttgcgttattgggaggtgagcatggtgctcatgtgtctaaggaacttgtctagaaaggtatgcccggccgtggtgaatccacgtcgagcatggaggcatgcattg

SEQ ID NO: 587735 - DNA, 428 bp, Homo sapiens
cagactgttgcgcaccttcagtggagctggaggtgggaaaccttgagagagaggaagacaggttcactagagaacttagacatcatcctagagatctctcttccccacccctcacaagcagcagttcagtgagtctcctaggggcagaggcagagggatagggcaaagtgtatactatacataggtataaacagtatgtcagtctattgacatgtatatggagctgtcagactcacttcacactgaaggatactaaggataataatttggtctcttaggagaataggatttaactacatcagttcatgggccaagcatgatgactcacgcctgtaatctcagcactctgggaggccaaggtgggaggatggcttgagctcaggagttcaagaccaacctgggcaacacagcaaaaccctgtctcttaa

SEQ ID NO: 587736 - DNA, 126 bp, Homo sapiens
tataatacaaaagtgcacctctaatctacattaaacatattagaaataactgtgtaaatgtttgctgtacaactccaaaaagtcaggtgcgtctgctcctgccacatcagcgggctggtcttggag

SEQ ID NO: 587737 - DNA, 365 bp, Homo sapiens
  misc_feature (351)..(351): n is a, c, g, or t
gaagaactttcataattcatgaaagcccagttttgaagattcacgtatccctctggagacctacaggaagaaagtgattgggttcctctggtttttgcctgcttccctgtggatgggaaaaggtgacaacctcagtctccctttggggcctgttccaggggaggcaaccccctttccctttccccaaattgaggaggccctgggctttttacccattttttttaattttcaaaattaaaattggggttacattgatgagaacaagagttaaagccccaccctttggtgggctgtttgtattgagttgcaatgtgaccagcgaaagctgcatttaataaatgaaagcccagnctgttaaaaaaaaa

SEQ ID NO: 587738 - DNA, 168 bp, Homo sapiens
caaagaccctactggcctgtggacaatcataatgaaggacctggaccagtgtatgagatcgcaaagtgggcttccagagcttcttttccctaattgcgggcctcaccgattgctatgcaactgactagttttagtagtacacattacaagcagtaagggaaaagaagt

SEQ ID NO: 587739 - DNA, 1318 bp, Homo sapiens
gcgggaaatcgtgcgtgacattaagcgagaacgctgtgctacgtcgcccatggactctccaccaagagatggccacggctgcttccagcctcctccctgcgcacacagagcctccgacgctgcctgaccggcccaggctcctcaccacctggcccctgcacgcggcctcccgcctgcccctgacgccctccttcccgcctctcccttcccctgggccctgcgagtcccctgcggcactacccgactacctctccttctgcctcacctcacctgaccgtgctgacgctggctccctcccgctacgcaaccctgtccggccaaccacccgccctgctcgccctgtgccggaccccccccgcggtgcccttggctactctgcccgccccggcctcgaccgacggccccctcccctgcccctgccgccccccatcgttcgcgtctgccaccctcgcggccgcaccttccgcttgttccctggcgccgtccctgctgctccccctgcggtcggcccttggccagccgtatcacacttcagctgtgggccccctggcgcgtgcttgccgtgcctgctgcgctcgtcgtcgacctcgtcgtgcctcgctggcatgccgcgcacccgtggctgctcccgaccctcccgctcagccctcccgcccgctccggcgcgcccgcgccccggccgcccgcctccccgccccctcctgcaccgccgcgccccgccgcgcctccccgcgccgccccccgctgcgtccccccgtcgccgctctgccgcctgtgccgccggcccgtccggcgctgccgcggtcgcggtcgtccgtccgtccgcgtcggcccgcccccgccccgccgcgctcgccgcgctccgtctctcttcctccgcgccccgccgcgtcgcgctcctcgtctgcgtcgtcgtctcgtctcctctctcgcccgcgtccgtgtctcgcctgccgccgctcgccctccgcgcgccccgttgtcctgcctcccgcctgcctctccccttctgccccccctccaccaccccgcgccttacgccgtccccctccgcgctcggcgtcgtccgtcctcctcgccgtcgttctgtcccgccgccgtcgtcgccgtcgcgtcctctccggtccgccggccgtcggtcgtcgcgcgcgccgtctgtccgggcctgccgccggccgcgccctccgccgtcgtcggcgcgtgccgtcgtcgtcgtctcgtcggtctgccgttctccgccttccgtccccggtcgctccgtccgctctcttctgctgccgccgcccgctcggcgcgcgccgtccgtgctgtctcgcct

SEQ ID NO: 587740 - DNA, 399 bp, Homo sapiens
gtctcattcttctagtataagcaaggaaatgtatatttatacctcaaatcacctaaatgatacatgttgccaaccaactcatatatatttagtcctcacttgccctattgtcaggctgccttccggccctacacttaattttctactttctgattactaaacacagtggaatctaatatgctgaggtgtgcagctggtacctggccccagtaggcactctgtgttcttacctttaaccggcccgagtgtatcaccaccttgtgaggttaagtggcactgaaaagaccatttcattttgtggctgttccctaacaccttccagggcttttcatctactgggcactggtaagcaagtcttaactctttaccctctccttaatacatgccttctgcccaccc

SEQ ID NO: 587741 - DNA, 288 bp, Homo sapiens
ccgatcaccgctggtcaccatgaaccacatttgtgcaaaccttctcttcctgtcaacagcggccagctctcccaactacgagatgctcaaggaggagcaggaagttgctattcttggggtgccccacaacccttcttccccgatgttcaacgtgattcacaattcgcagcgagacacttcgcttccttacacaagtgtggcttggtccctgtttcaaacacacctctttaatgagacacactctctggctctgggctttcatatgccatattgcggggtctctcgcgt

SEQ ID NO: 587742 - DNA, 507 bp, Homo sapiens
atagaaaggtctcgaatggaatgaaattaatggaatggaatggaatcgaataaaatgagtcaaaaggaatggaatcgaatggcaatgaaatcgaatgtaatggaattgcaaggaattgatgtgaacggaacggaatggaatggaatccaaaggaatggaatagaatggaatggaatcgaatggaaaggactcgaatggaaatcactcgaatagaatgcactttaataaaataggatcaaatgtaatggaatggaatggaaaggaatcgaaacgaaaggaatggagacagatggaatggaatggaacagagagcaatggtatagaatggaatggaatcatctggaactggaacttgaatggaatggaactacatatgaaatggaatggaatggaatggaatggaatgcccttgaattacatggactggaactggacatagactcgaacagagtggaatggaaagtgatgagatagaatggaatggactcctttggaatggagtagtat

SEQ ID NO: 587743 - DNA, 139 bp, Homo sapiens
cacaagctctaacctgcaatttgggcatagtcacacatttcctcaatgcgttgggcctcttcacatcttatcacctgtcagttcatctatcctctcttctacgcctacgaatgctggtattcaactctttacactttct

SEQ ID NO: 587744 - DNA, 561 bp, Homo sapiens
  misc_feature (76)..(76): n is a, c, g, or t
  misc_feature (80)..(80): n is a, c, g, or t
  misc_feature (95)..(95): n is a, c, g, or t
  misc_feature (99)..(99): n is a, c, g, or t
  misc_feature (140)..(140): n is a, c, g, or t
  misc_feature (152)..(152): n is a, c, g, or t
  misc_feature (156)..(156): n is a, c, g, or t
  misc_feature (158)..(158): n is a, c, g, or t
  misc_feature (164)..(165): n is a, c, g, or t
  misc_feature (184)..(184): n is a, c, g, or t
  misc_feature (196)..(196): n is a, c, g, or t
  misc_feature (202)..(202): n is a, c, g, or t
  misc_feature (215)..(215): n is a, c, g, or t
  misc_feature (219)..(219): n is a, c, g, or t
  misc_feature (224)..(224): n is a, c, g, or t
  misc_feature (235)..(235): n is a, c, g, or t
  misc_feature (259)..(259): n is a, c, g, or t
  misc_feature (267)..(267): n is a, c, g, or t
  misc_feature (294)..(294): n is a, c, g, or t
  misc_feature (299)..(299): n is a, c, g, or t
  misc_feature (308)..(309): n is a, c, g, or t
  misc_feature (315)..(315): n is a, c, g, or t
  misc_feature (326)..(326): n is a, c, g, or t
  misc_feature (329)..(329): n is a, c, g, or t
  misc_feature (383)..(383): n is a, c, g, or t
  misc_feature (405)..(405): n is a, c, g, or t
  misc_feature (418)..(419): n is a, c, g, or t
  misc_feature (424)..(424): n is a, c, g, or t
  misc_feature (445)..(445): n is a, c, g, or t
  misc_feature (449)..(449): n is a, c, g, or t
  misc_feature (451)..(451): n is a, c, g, or t
  misc_feature (455)..(455): n is a, c, g, or t
  misc_feature (553)..(553): n is a, c, g, or t
tggctggcgccaccacctggccgaaagggccgagtttgagcccagaggaaggagctggagcaggtgtgtacccccntcancaccggactgtcccngggncccggtggtcccgggcctgggggcttggggctcagggtccncagggagggttngggncnggcccnnccattaggaggtggattangggcccttgttntttagnatgtttgtctttnaggnggacngttgggacccnaggactttgctgctgttttcctangtcatttntgcttcagctctttgcggcttcccttntttgnaaagttggnncccgangggaattagcnggnttccttatttttgtaggcccccccaaatgttccttaaaattctttgcctttaangttgaaacgggaagggggtttngttccccttaaannaatcncccccccccccctctggacgnggtngnttgnttttttttttttttttttttgcttggcgaaacccccccaaaggctgggaatgtatgtttttataatttgtttatttaaaaatgaaaaataaaatgttnacctttta

SEQ ID NO: 587745 - DNA, 423 bp, Homo sapiens
  misc_feature (375)..(375): n is a, c, g, or t
cgccagctgaaatatcatgattgttattctaatatttcctccacaaagacttagtgaactgcatgtccattttagaaagtaggagtagatattttaattttttcttgcttcttgagaactactatcaacaataaaaaaagctttgattttaacgtgtatatcttaagatttcttttgatcaatactaatgaaaataaacctgaaacgcgaatcattggacaaatgtgagatttttcctttaatttatacattaattgatgtaagatagtatttagaaagtttcaatcctttccagttacaattgtaattgtcacttacctcaaactaaacaaacggactctttcccatatttttctacttggtgaaggacattcnaatcatctagatgcctaagtcagaaacctaggcatcatcccttcattc

SEQ ID NO: 587746 - DNA, 227 bp, Homo sapiens
tcgaatcgagccggtaccataagaataagcgtacaggaactagtgctcaatatacatgtataaattggtggaaatctctgggatgtgaatggttacttcaagtggcttttattaagattttctcagacttactgggaggttaaagcaaacccaaatgtgtattatttggttacagagctctgctttataatttggtaataaagtttcaatacagacacctgtcctgt

SEQ ID NO: 587747 - DNA, 739 bp, Homo sapiens
taagagacaagtcctggaatgggcattcccaagaaccattgggtgctttactgtcctgtgttgagctggtatctaaggtgtaagacaaagcccactttacttttccctccacttttctctagcaggaatctgtgcctgtgtaaccaccacagctgggaatgtgctggctgaatctgaacctgaaaccgaaagaccgagtctcacccaaggccctcagcatagtacccaggtatctctgctggttattcagggaccaagggctcttcagttaacaggcaatgaatgcagccaagactgggtcctttccttcaaggcagggggttccctttcaggccagggtggtgtttaaatatggtgggccagagagaagagaaaatcgtgaaaatatgtggaagactaaatccagcagcatattaaaagcattatacaccatgaccaagtgaaatttatcccaggactgaaaggtcatttaatatatgaaaatcaggcaagcacagtggtcatcatgctgtaatccccagcacttgggaggcaagggggtggatcacctgaggtcagaagttcaagaccagctggcaaatatgggaaacctgtctctataaaattacaaaaattagacgggtatggtggtgggtgctgtaatcccagtaatcgggaggtaggaggagaatgttaaactggagggggggttgcagtgagtgagattgtgcatgatcagtggaaagaatgggattgtttt

SEQ ID NO: 587748 - DNA, 362 bp, Homo sapiens
ataatcagtcttttgtccaatcacatttctacacggtcatagtgcctatgtaatgaagcctccataaaaacccaaaaggacagcacttagagagcttccagatagccgaacatatgggtgctcctggaaggtagagtgcccaggaaggacatggagactctctactccttcccccataccttgccctacacatctcttcattgtatcctttgcaatatcctttataatatactggggtaaatgtaagtaagtgtttccccaagttctgcaagccactccagcaaattaattgaactcaaggagaagctggatggtcagaagttctggaagagtagatcattgactgatctataggagtggtg

SEQ ID NO: 587749 - DNA, 445 bp, Homo sapiens
  misc_feature (30)..(30): n is a, c, g, or t
  misc_feature (33)..(33): n is a, c, g, or t
  misc_feature (35)..(35): n is a, c, g, or t
  misc_feature (37)..(38): n is a, c, g, or t
  misc_feature (40)..(40): n is a, c, g, or t
  misc_feature (52)..(52): n is a, c, g, or t
  misc_feature (60)..(61): n is a, c, g, or t
  misc_feature (63)..(64): n is a, c, g, or t
  misc_feature (72)..(72): n is a, c, g, or t
  misc_feature (76)..(78): n is a, c, g, or t
  misc_feature (258)..(258): n is a, c, g, or t
  misc_feature (338)..(338): n is a, c, g, or t
  misc_feature (344)..(344): n is a, c, g, or t
  misc_feature (383)..(383): n is a, c, g, or t
cacccctaacaggctttggagcgaggagancgnantnntnagtgcttctcgncctcgacnncnnactggaanaccnnngccctgagaaaaccacatcccacactccccaccaaaatcagagtttctggaaacggggcttcttttgttttgtgcctgaagcttctctggtgattctaatttgcagctaggctaagaaccaaccacgaccccaagtccaggttttatactgcacccatcatccggtccaatcccggcaangacaaagaggagacccagagaaaacaggaagtcttttccccacgcagacaggaagagctaaaggctgtaggtccgtctgncacaancacaactggaaggggaaagcccgtgagccaccctagcanaacacacactgcatctgacatcaagacaggaaggaaaactctttagaatggctactgctgga

SEQ ID NO: 587750 - DNA, 223 bp, Homo sapiens
gggggggggggtttttaacccccccggcccttttttaaaaaccctttttccccccaaaaaaccaagggtttttcgggggggggggggggccccttttttccccccctttggggggggtaaaccggggggtttttttggcccccggaatgggggggccccgtggtttggtttccccccttgccccccccccggggggggggggggggggggccccctttcccca

SEQ ID NO: 587751 - DNA, 126 bp, Homo sapiens
agatcctgagcagaatgtgaggcaggaatgattcgtctgatctgtggatgcaggtaatgtggtgcgcagacagcatgtgttgggtacaggtctttggggatgtcagttacattatgatggagttga

SEQ ID NO: 587752 - DNA, 360 bp, Homo sapiens
tggtcttgtgctggtacgaccatgtggagttcgagatggcttctggaggaaggcgcccctccgagggcccaacactggccaggatgacaacctggtatgggagccaggagtcctggcatcattagtcccagatagctgcattactcacttgctgcgagacttcaggccgcttctgcgggtccaaactccctgagcctatcgtctccactgacagccgcctctgggttgaattccgcaacagcagcaattgggttggaaagggtttctttgcagtctacgaagccatctgcgggggtgatgtgaaaaaggactatggccacattcaatcgcccaactacccagccagacaagaaccacacg

SEQ ID NO: 587753 - DNA, 105 bp, Homo sapiens
aggagagtgggctctagcaggtggagatacactacggctttgacacacttatagaatggtggagagaaaagaatggttccctttgttccccgcttattatcgtgt

SEQ ID NO: 587754 - DNA, 1408 bp, Homo sapiens
  misc_feature (139)..(139): n is a, c, g, or t
  misc_feature (389)..(389): n is a, c, g, or t
  misc_feature (637)..(637): n is a, c, g, or t
  misc_feature (641)..(641): n is a, c, g, or t
  misc_feature (782)..(782): n is a, c, g, or t
ggcagagttcatcaaacgcacaggcactccatggagcatgcgagaggcccatgcagtgagaaggaagagcgagtagagacgcatgagagtcatacaacagtgcgagcacaaagttctggcgcgtagagatggtgcgagnatacttcgactatcgacctacgcgaggaagagcgtgcatgatggcgcttcttcaaggtggcagaccaagccgaataggctgaccatccatgtgggatcgctgtagctcactgatggggaagggacgttcgaagatcaacgatccttgagagggtagaaggatacgctcaggtaggattctgtactgaatgagggcgtaaggactttaccattggaagagtgcgcaggtaggcaccttagagagtgcctcntacacaacggtgtccctcgcctcgcgatgggtgtagattggcgccatgcgagcgcactattggacctattcgcctcgatcgtaatccctagaggctggaagaatccgcgttggggctttgtaacttccgtccgcactccgcgtgaggagcgtggttacctctatgtgagtcacgcagtggcctgggtaggcattggtggaaaacaccgtccgaggcttgcgacttgacgaacgttggtgacacacccntgantcttagtcgcgtggaactgtgtgtctttgcgaacgcaaaatgacttgcatagatatcttcgagatactagaggagcgtgaggacagaaggaatgagttcgattcggggagaccgcgttggggtgggaaaatggtgaagtgntctggattgaacgaagtgcatctaggaaaggatggaggaaggaaggatggcacaatgttgagtcgaaagcaagaatgatgcagtagtggcaggaccaggggcctttcatttgaccccaggtgcggaccaggtggggacctctggttcaagtgcctcgtgaggccctctagggcgtccacagtgcacctgcttggcaaatggctggaaccccctgtgcatgtcattgcacgactcgagggaaggcagagagagcaattgggaaggcatgagtggaatgtgacgtgtaacagattgaaggatacctttgcgagattcttgtggaccgtgtcgtttggcccagtaggaaattaaaagagactgtgcgacatgttttcgcgctgtaggtgcgggccccatgtacagtgggggagcttcaacacccaacaatttttatgttaccagggtcccccggagtatttaaggcgcgaaaggagacacgggttccacgtaatacagtcgaacgaggtgtgtcgacagtggcggccgtggggagccccgtaaaagatgtgtgaacgggaaccagatgatgacgaggaccaccacacaatcattggaagcctgctctggaaaacagaccagatatcacg

SEQ ID NO: 587755 - DNA, 262 bp, Homo sapiens
tggccccccctgtgggccccctgctcagcctgactgcctttgggccagcctccatgatcagcccaacccctgcaaggtggtttgacccccgtcccatcatcagaacttgagtttttggtggctccttccaaggttaaggccgagcccagagcctcccattgcagcccctggcagcccccccttccttggggtcctccccatttccttgcagcccctgcatttctgcccccagagtccccatttaagccctgcagttgctgga

SEQ ID NO: 587756 - DNA, 611 bp, Homo sapiens
  misc_feature (19)..(19): n is a, c, g, or t
  misc_feature (40)..(40): n is a, c, g, or t
  misc_feature (49)..(49): n is a, c, g, or t
  misc_feature (63)..(63): n is a, c, g, or t
  misc_feature (73)..(73): n is a, c, g, or t
  misc_feature (117)..(117): n is a, c, g, or t
  misc_feature (126)..(126): n is a, c, g, or t
  misc_feature (363)..(363): n is a, c, g, or t
ttagtaacaaattttaatnagtaatatagtttattagtgnctttggganatttatttagagantgaattttanatggattggattttaaatatttataggggttttatttggaatanttttaaatnggaaataatttagatgttttataataggtatatggttaaataaattatttataatttggaatattgttttggaatgaaaaggaattaattgttgatataagaatttggttgtattttaggggtattatggtgaataaaaaaaaaattagttttaaatggttatatattgtatgattgtatttatataatatttttgaggtgataaaattattgaaatgaagaatagattaatggttnttagggatagggattggagggggtgtggggtatgtatgattataaagggatgatgtaaggagtttttttgtgttgatggaatagttttatatgattatgatgattatgatgttgattataatatttgattatgaggttaagtatatgagtttttatttgtgttgaagttgtatggatttatatatatataaatgaatgtatgtaaaatttggtgatattgaataaagtttgtagtttagatagtagta

SEQ ID NO: 587757 - DNA, 960 bp, Homo sapiens
agcgggctccacgggctgcccggctccgtgcccctcacgcccaccagccgccttccacctctgcccacccgctccacactgatccgtattcctgccctccgcagctggtcctctccccagtaacgacttgccccatcttttccgcctcatcctgcgtgacccgttgccccatagccgagggggcctcggggtgctcgtgacctcgtcctcttccgtacgtgatggtgcaggatatcgattggtgctcctatgaacgttggccaacactatagtctcactcaacgctgccggactgtgaatgctgcctgacctaatccctggtcgcaactgacgacgcatagcattcctagcgtgctcctgacgggcacattgccatgacgctatagttacgcatgcaactcgagacaagtggacatttagtcgtgcagccacatattccgacggccatttggtacttgctatgtgcatacttatatcaatcgggccagagtccggtgtacaccatgccctcaagtggcccttggtggcatgcgtagcatgtaccatagcccgctcgattgcacgcctttgatgcgctattgccaggtacgatccgaggatcgtgctccgctcgaatttgatacgccacaaactttggacctaaaccaggacttgaccatggcgccacgttcgaaccaatatcgattgggccagcacgcaatccaaatcagataccaacttttgcgcataaaatgcctttaaccattgaatcaaagctacttcgcaaagggtttgacccccgaattagcggcacccaggaatgaccccaaagactaagtttctcgttgtgttgggcaccttccagttctgccgcacggatgtttaacttgggtgagaacgcccaattggttcacccccaaagcgcaccttgggcaactccttggcactttgttcctgtaccccgaaacacacaaactgggg

SEQ ID NO: 587758 - DNA, 284 bp, Homo sapiens
gtcgactccagacattggttcaggagctacgaaactggctgacactgattgctctgtggttgtcggtgtcttctcatcgtcatgccgctcagaggcttaggacattctgtttactatgattgaacactggaacttgctacaggctttccttggggtctgtaccacccctggtttagagatatatgtatgcttctgttattgaactgtgctgaaatcccaaatatgggttgactttcttaccagcttatggggaaagcgcacaacctggcgacagaaggtcgacg

SEQ ID NO: 587759 - DNA, 236 bp, Homo sapiens
tgcattctgctggtctctctacgagtatcccccggccgccacaggtctcggccgtcacagcttctcggccgccacagcgttctccatggccacataggtcctgggtgtatgtgtgggcagagtgtgcggggtgtcttctggtgcctgaagtctgcgcggcctggatggtggtgtgagttcctctggttgcgagggagagcgcacatctcttctggtccggtcaccctgatcgattg

SEQ ID NO: 587760 - DNA, 1025 bp, Homo sapiens
  misc_feature (1025)..(1025): n is a, c, g, or t
ggagggctggtggtgggagcggagtggtgtcgggcggggccgagcctgggccgttgtggccgtgtggtggtgccgggcggtgtgcggtgcctgggctggacgtgcggtgatgggctgcaccgtgagcgccgagtgacaatggcgggcggcgagcgctctaagatgatctgacaagaacctgcgggaggacggagagaaggcggcgcgggagtgtgctggggagtcagggaagagcaccatcgtctagcagatgaagatcatccacgtagggatgtgtctatctccgaggaggaatgccggcggtaccgggcggttgtctacatcaacagcatccagtccatcatggccattgtcaaagccatgggcaactgcagatcgactttgccgagccctccagagcggacgacgccaggcgagctatttgcactgtcctgcaccgcgaggagcaatggcgtgctccctgatgacctgtccggcgtcatccggaggctctgggcttgaccatggtgtgcaggcctgctttggccgctcaagggaataccagctcaatgactcagctgctactacctgaacgactggagcgtattgcacagagtgactacatccccacacagaagatgtgctacggacccgggtaagacacggggatcgtggagacacacttcagcttcatgacctacacttcaagatgtttgatgtgggtggtcacgcggtctgaagcggagagaagtggctccaaggttatggaggggcgttagagcgcatcatttcttgcgtagcctgacgctttgaatttgtgacttgaaggagaggtattagccgtgcttaaagtaggtttgcaccattggaccatatggtccgacgacatcctactctccacacacggctctggggcatccaccgcctcacctgtcactaacggtgacatttcggcgtcccatagttcgacaatgaacagtatccctgtcgcaacattttacactacaacaacgcgtgtacaccaggagaggcctccgtgttgacan

SEQ ID NO: 587761 - DNA, 1176 bp, Homo sapiens
  misc_feature (256)..(256): n is a, c, g, or t
gcggtgagtggcccctgctggaccgtggatcccgggtcgggcgtgcgcggcgagcagtgctactgaggccttctactcgcccgtgtgctgtccggttgtggcctcgccttctccctgtggatccctgtcgtcaacactctagggcactgcgagctgagcttctaccatcagtggaacctagttcgttctggtgcgccgagtagagacttgctcaggaggagctatccgttgtcgcgtgaagaagctcagtaggtgncctcgtgaagcacgtgtcgcatgtcgggaagactggatccgtgcagtcgacacgaatactatagatcccaaggatacagaaaactcacgttgcaagacacttataagagtggccaacgcaacggccaggatggatgctagttcgcatctatggcagacaatagacttggtgcgcactcctggcgctatgtgcgcaacgtttgtagttcgatgcgggccaacatcgcaggcttgtgtccctctaagaatcctagacgactctaatgtccatacagagttctggatgtgcacaaagccattgatagcggtgtcaccaaaggcgcattggagcaccctatgatacagtacatgcctggagagttgccccagagtcacagagaggattcatggactcgggagttttgaagtcgtggcaggacagcagaatcagtggcactcttgaaggcaggaacgcattgtatgccatggaatggccggtttgacaggaatggtgcatggagatgagtggaagagaaggaaatggaaataaaccgaaactctgagtggcatgatggattgacaacacgtgagggttccaagtgcaatgaagcaatggggcaaggttgcagtaccctaaaaacagaaattggacacgggtacataaggcctttcccacgtcagaacatggagggggaatcatggattaaacgcttggtatgacagccttgacaacatggttgacggtgaaaacacacatagttgcagaaggcctgggaacgacgaaacatggaccccgtagggccttcagaggtgccctcgaaagtggcaaagaaaccactacggaaggcaacaaattcgggatgataaaggagaaacccaagttgcagcaaggttgaacattgaaacattaaccacccctacaaaaatacggagaaattcacc

SEQ ID NO: 587762 - DNA, 296 bp, Homo sapiens
tagctagtgctcagtttggtctgagtgcctgagccccgcttccagagttgagtcccacctcctacctcattcccccttcagagagttagatactcctccttaatcttaagggggctgcagaagggcggagatctgttttccgtaactacttcctgctgagtttatggacgtaggccctgcctggcactggaggagtaaaaatctctggatacctgatctaaggagcccagaggcaggacgatttcattctccgtgtcagtggacaggatgggctggaagacctgagcaagccaggt

SEQ ID NO: 587763 - DNA, 119 bp, Homo sapiens
agaatacagcacccatcgtaggcctgatagcagcctccaattgagatacgcgttcaagctcaacacccactacctaaaaaatcccaaacatataactgaactcctcagcacaacctgga

SEQ ID NO: 587764 - DNA, 490 bp, Homo sapiens
ttaagaaggatgtagactgacgatgtcatggctagcccagcctggagactactgatgttgactagcccatagcacaaggacactagatctaccatccagggcgagacgctcttcccttgagctccacactccctttacaaagctgaacctgcaccttctgggggaaggagggttcctggaggctctctggcccccttgtcttccctacctcccacttctttccttcctttgcagctggcagatttgggcctgtccacatttcagggaggctcacagtcagggacagggtccggggagccagggggcaccctgggctacttggcccccagaactgtttgttaacgtaaaccggaaggcctccacagccagtgacgtctacaggtaaggatcccggaccaaacacacagccaggattcctacacttctctgggccctcccaggggatgatgtataggaaaggagtcttgccagtgattggaccgatcagcac

SEQ ID NO: 587765 - DNA, 936 bp, Homo sapiens
  misc_feature (362)..(362): n is a, c, g, or t
  misc_feature (747)..(747): n is a, c, g, or t
tgtcggcagctgtggcgtcgccgaggaggtactctttgttgttcgtggtgtgacgccgtggcgcgggttggtgcccagagggccgacggcgtcgtcctggtgggttaaaccgtactgagtggcgcgtcgtgatataagaggggtgattgctcgcgtgcgtgcgaggttgctatgaggtgtgccgccgctgtctagagcgatgtcttcgggcgtattgttgtcttgtcgcctgtttgcatcggcagtgtgtgttgccgggagggcgttctccacccaggtggttccgtctggctcgctcacatgggtgctggtctccgcgccgcagcgaacacgtgtgtccacgcaccaaccatcatcggcgngcccccacggcctgcgggtgtccgacagcccgccgggacttggtgtcgtgcgcgctcacacgggatgtttattctgtgagcagttcttatgatgggccataccctgttcccccccgtttggatgctgtataccctgcggggcctatccccgatgccctcgggtgatgtcggggaacagaagcattagtggatgttgtgcgccccgttgtcttactgtgggacacagaccagggccgcatccgacttattggccggtatgcttgcccccgccgctgatattcccacagctgtgttgtttcttcatgacatgcttcaggtcgtggttacacttagataaaagtggttgtcgtgaagctcgcgggggacgccggtgaggtagctcgcntagtgcgttaagatgcggcgttatatcctgttaggagctccacacaattaccactagtatctgactctaagtagcacaccgcacggtggcgctttgtctataccccaatgcaaagtacagggcgtttagttaccaccgatactttgttcaccagagcatcatcaactagtgatacccccaaacaaaaca

SEQ ID NO: 587766 - DNA, 669 bp, Homo sapiens
cagcaatatatggtgggcgcataggctcaaaaagaatcgccggatattactgtccatctccttatatccgcacgttcccataaaatcaggtcaacgtgacagtatccgtgtgtaagtcctcctcaatgtgattcacgacgtgaggatagtagggcagctcactttgaaccaacatcgatgacacgcatgagtgcatatccagaacctctgtcagggtgtacagcttcccacatttcaggacctgtaagactgagctagttatacgacagattgtcataacaacgggcgtcaggacagccagaccaatcatgtatcctatcagagaggcaagagtgtctcagtctatcaaattaaagtactaggtcatcaagagccagttcaattcagtcaagcattctggactataactcgttcacgaaatccagcgataataggttactggcttccatatccaaggcactggtggatacagtgtcatggccattcaggcatatgataaggaatttaggtccacataggcgtattctagtacgcatcaaaggtgactaatccttctgagcccttgatcacagtcgtatgattcagagttcatcatgtgcctgatcaccagcagagcatcccatcaggcacacacctacgctccctcacagcctgtgcacagggaatgat

SEQ ID NO: 587767 - DNA, 179 bp, Homo sapiens
acttcattaaggagtctgcgcagaagaacgaattcactttctgaatactgtggtgagctcatctctcaggatgaggctgatcgacgcggccaggtctatgacaaatacatgttcaggtttctctttcacttcaataatgattttgtagtggatgctactcgggaaggacacccaattcg

SEQ ID NO: 587768 - DNA, 427 bp, Homo sapiens
tgagctcacgcctaccatcccaccaccctgggaggtcgaggtgggcagatcacaaggtcaggagatcgagaccatccttggtcaacgtggtgaaatcctattctcgcaccaaaaatatcaatcaattatccggacatattggcacatgccctgtttctcagccactcaggatgtcgatgtaggagattcgcacgaacccgggaagcagagggttgccgtgcaccaataccacgccattgcactccagcctgtgtgagtttattttctctcaagtcacagagaccaataaaaaaaaactttatgcttagtgaaataagccagacacggaagggcatatatgttataatttcatttttatgaggtacctagaaatagttaattcagagaccggaagtagaacagacattaccaaagggtgatgtctgcg

SEQ ID NO: 587769 - DNA, 179 bp, Homo sapiens
  misc_feature (179)..(179): n is a, c, g, or t
ggacaattataccctagccaaccccttaaacaaccctctcccacatcaagccgaatgatatttcctatttcgctctacacaaattctctcgattcgtgccctaacaaactcaggaggcgtgcctctgccctcatttactcattccatacctcatacctcagcgaatagatgcccccatn

SEQ ID NO: 587770 - DNA, 528 bp, Homo sapiens
tgttgaagtggtgtacaaagggagagaaagtctgggatgggcagggcttttgaagagtgggggctggtgaaacacaagtttagaaatgaatttaaccatctgagccatgtatgaaattcacttctagaggtggcccctgatttccccaagcctcactcaggacagaaggcaccattcagttcagccttctgccccctttgcctgacccccaagcctgggtaccgcaaacaccaaggcctccagacagtgcagggcaggtgccagggcctgagatgctgacagcaggttctgcagcatccacctttgcccaacactgcctctcgtcctcttccagagagtgagcgtcctgacaactgagccacttcacttccctgggaaactcaagcataggtgtcctttctcatttaaaaatgtagattttagcatttgatgttcttatggtggggaactcatgggcactgcagcagttctcggagcaaaaaaatggccatttgttctctggggacagtattaaataaagtgagcatt

SEQ ID NO: 587771 - DNA, 322 bp, Homo sapiens
gaattggaggggagaaagtgagattggttaaagggcacaaaggcacaagttagatagagggaataagttctagtgtcagatagcacagtagcctaattcgagttaacaataatgtatgtacatttcaaaatagctagaagaaaggatttgaaatgttcccaacacaaagaagtgataaatgtttgaagtaatagatatcccaattattctaatttgaccactacatattatatgcatgtatcaaaatatcacatgtacctcataaatatgtacaattattatatatcaataaaaataataataactttttaaaaaacagttt

SEQ ID NO: 587772 - DNA, 352 bp, Homo sapiens
gattttctcaagactaattaaacataaaaatgttgaggctccaagtcgctaatatagcattggtttataaaacatcgaagtataaatatgcctcgtattactgtggtattgctcctttgtgatttatgatacacgtaatgttctttccacttaacagaagtgcagttcatcatattaagtcattatcctacctacagcgtattggacaaatttcatatatacttttcaattagtaagaaaagcaagtattgcagcagtcacctatctgatacaggtccttacagttgaatcagctctgcccatctgtaaattatgtttgaggcttgaacttttccctgtacttccagttcca

SEQ ID NO: 587773 - DNA, 166 bp, Homo sapiens
tgttttttttccccctccccctgttgggggtttttttgttttttcccctgtttttttttccttttcccccccctttttttttccctttttcctttttggtttttttagccccggtttggggtggatacccccccccctcttgggattaaattgtggggtcgggcga

SEQ ID NO: 587774 - DNA, 312 bp, Homo sapiens
tttgccattatttttatttttaaagaaaaattgttggccgtgtgggtggctcattcctgtaatcccagtgctttaggaggccgaggcaagaggatcacttgaacccatgagttagagacctgtgtgagtaacatagtaagacctggtctctacaaaaaaaaaataaaaataaaaattagtcaggggtagtggcacacatctgtagtcctagttgcctgggaggtttaggtgggaggattgcttgagcccagcagtttgaggctgcagtgagttatgatcgtgctgctgtgacagaatgagtccctgtctctg

SEQ ID NO: 587775 - DNA, 154 bp, Homo sapiens
ttgaggatccacacatgaccagcagcgagaatatcttattcaagacaaacacagacaggaagtgaccgagctgaacgtgacagctgtgaagattcagagacttctgagccccgatcttgggcactcaacgggccttgggggtagaattgtgtgg

SEQ ID NO: 587776 - DNA, 963 bp, Homo sapiens
  misc_feature (1)..(1): n is a, c, g, or t
nccttctaataccccccgttttatatatataaccgcccgtactccgggtcaaattttttaccctcagcaaatatcgctcgcaaatagtgccgttcaaactcttttacccccccatgtgttgcggcactaactctgcccgtcactattccgctttaaaatgggtctttcccccttgaacccgtagtacttgcccccctaacctcgtcgtatatttcactcacgtatctccaaaaaaactttcccggccgtgcagtcttatttcctgcctcgctaactaaagaccttatcatcacccctcttcctgtgtcatgagcaaatgctctgcctgtttacaatgcacagccgctccattttaaccacagtgattctccctcggaaggttgctcatacccctgcactcgtgcgcctggtacaccgagtggagtgtgggtttaaaggcccagtcgcgggggaagtcaagacactttcctaacagagtcattttggatatctcaacgggattactgtttgatactcccatgaagaatagttgcgagacgcacgcaattttatggtgtcgtcagcactgctctataatttctgcagccgccgcaccaatgtgacagttttcccgccccggaggattatatagacgagttagttttggtagctaggtcattgcccatttgctcttggcctctggtctctttcactcgctcattatatttctcccttacagttaataagacccgcctaatttctgtacaccccctagagtcagttttctcatgttccgttccacattcatttttagattacattttacttacctcttcatataccaaagacccatataaatagtattgttagcggaggaacaatcacccaactaagtaattaatacacacataggagataaaaataccctacaagaagagaataacacatataacaaaaaaaatataaaccaaacaccacaaaaca

SEQ ID NO: 587777 - DNA, 201 bp, Homo sapiens
aggtagactaactgtcgagggagtgagagcggtacttggcagcatattgtcactgtacctgtccacatcttgagaataaacgataatagaactagtgactactttccttacagtttctgcttggtccacccactgaagtagctcatcgtagtgcggggcgtattagaggcagtgtggtacgttagactcagactggaaagt

SEQ ID NO: 587778 - DNA, 225 bp, Homo sapiens
gggaaccatggagggtgtagaagagaagaagaaggaggtcctgctgtgccagaaacccttaagaaaagcgaaggaatttcgcagagctgaagatcaagctcctagaaagaagtttgcccaaaagatgtttcgaaaggcaagaggagtttattcttgaaaagcaaatgacttcacaaggtttaggcagttgacagatcgattcgttcgcgagtagcagaaatcggc

SEQ ID NO: 587779 - DNA, 936 bp, Homo sapiens
gccggagcacggacgatctctgccggccttgacgtgcacctcgagggtctgcagcaccctccgtgttcctctcctaggcgacgagacccattggactagagagttcaccatgtctatactcaagagccatgccagggagatccttggactctacgacgggaatccgcagctgttgaggttcgactctcttcacgctcacaagaggtctcttcagagctggctgtgcccagtggtgcttcagctggtatctatgaggccctagagctccggcgacacagtgatcatgactcgctatatggggaacggtgtctcaaagggctgttcagagccctatcaattacacacactattagcgctctgctcctggtttacgcaacgacatactgaacgctcatcactaacaccgaggaagcttgagcaacacactgattgactcgtagcactggactggacacacgcaacatataaagtctagagttcaggttgctgactcgccagtgtcgtgctgggttgtccctgtgcccgtctgcaaaacgacttggttgccctgtatcgccgacagaggcgcgtcctctccctcggtacccgccgtcactcctgctcgcctttgggcgtgcgtagggcttcgtcgactagtcattgtccttgctccgtgtttctcgcggttgcgtttgcatcgttggtctttacctaaattcgggccgggtatccttgcgatcgcgttgagccctatcggcatttgctgttgggcgccaatagggcaagtgtgacaagtgtcctattggaaattaccccttccactcgaagattcggtggattgccaaggttaatccacctattccgagcaggcaatgggcccatgtgcctggcgtttctgagcacgcccaagaaggtgtgttatatcgccacccaaagccctttcgataacgaacaatg

SEQ ID NO: 587780 - DNA, 553 bp, Homo sapiens
tggacagcttctttagactccttccacagtgctccgtggcaactttacttcattccattttttttaaggttgtatactgttgttcctggagtgttcaagtcaaccagagggcatcaaatccagtggatcttaggtgccatctgtggaggcagaaggaaggacagacatggcacagcctgcctagttctgccgtcccactgtgggaacatggagacatgctttttaaagtgtggtgttggtcagacaacttaatgtcaggaattggcaaaattgttcacttttgttttcttggacagcggggactgaaattgatgggttttgtcgcatagataaaacccatagtcagtttgtggtccaacttctgcatctgaaaaagccaaaggagaaaagcctttgctttgatttttaaagctatagaacatatttataagtatggcagcgtccgccgcagaatgatgtgtgtgaggctctttgtagcagggctttctttacctacagatcagctgttacatgtgcccagccaccccccccacccccctttcagtaacagcct

SEQ ID NO: 587781 - DNA, 172 bp, Homo sapiens
agcaaagcatgcaggaacacatctgattaggtccccacagccaaatcctgggtaggctgcctccaccatcctgccttgccatatgattaactcccctacaactgtaggattgggatactgtggcatcccagtggcagcaaagaagcaaaacagataaatctcctccccccga

SEQ ID NO: 587782 - DNA, 242 bp, Homo sapiens
agggaattgcagacgcgaagtctgcacatgcacagactaaaacaccaaccctttcgtctctcaccttggacagaaccaacaatggatagttaaaaaaatgaatgaaatgcagtgagcacttcatttacgaaaaaaaaagaatatcaaccaggaaatccttccaccatgtgatcatggcaaactgcgctcttcattaagtaaccaggagaatcctgaaggcactctattgattttccccacac

SEQ ID NO: 587783 - DNA, 115 bp, Homo sapiens
tgagtgttagtgaggtagcgatggaggtaggataggtgctgtgggtgaaagagtatgactggggtggtggttgtggtaactttaatagtgtaggaagctgaatagtttatgctgt

SEQ ID NO: 587784 - DNA, 1039 bp, Homo sapiens
  misc_feature (1033)..(1033): n is a, c, g, or t
gaaacattcagagtggcgcggctgatcgctgttcacttctctggctccgggaccgtggtgggcctgggatgagaaccggcggttggtatgctgtgaaattcaaatggggtgatgcgaaggagtcttcgaaagtgaaaactttagatgaaatgcttcacgaaaagaaacgaaagaaggagacaggaggagaaaacagagatcccatgcttaaaaaaattctgatgacctggataccataggacggagtaattgccttgtaggaggggagtcgtctgacagatcacctgccctggtagaatcgacatactaaggatacctccgcctgtactatgcacatgagaaggactctatggaagacgcagaggagagagaaaatgatcctttggcatcaaaaacacgccacggaatgtgtcggcaaaggacaaagctccatcgacagcaaattcgatgaactgagaagagcgcaatcgtagtcatctgtaccatgcaccagaaggtggaagccctgctacagtgaagcggaaaaaagaactgagacgcacgaatgtatgaaaacggcatcgcaaagaccaggataggagcctcgccatgcgagtgggcaacgacagaagcacgccttggagatggcacagggcagcattccgagtatgagaacaggtacccgcttgtacccatgttaccaagggaagctggacctcggagtccaaacttggggcgccagaagaccggaccagggtggagcggaatgaagcgaaagcgggccgaaggacggggtaagaagggagtgcgcaggtaagtgatggcactctgaaggatttatagactaggtaacaggtacgcagcctgagagaaagcgttcggctcgaaagagtatttgggaagcggacacgcaaaaaaaaaacagggggggtcaattgcaaggacgttaacacaattaaggcaaaaaaaaaaaagggtgttatagggagcagattgggtagaacaaagaaaaagggtgtgataaaaaatttttttatttttctttatgatgggnagggcg

SEQ ID NO: 587785 - DNA, 349 bp, Homo sapiens
ggagaatctatcgaatccaggaggaagaagctgcagtgaaccaagattgcaccactgcactccaacctgggcaacaaagcgaaactctgtctcaaaaccgaagcgaaaagatccagagaacactcgaagagataattagggactcggaaagacaaagactgaaggattggtggcaatgagttatggggaaaaactatgtgaacgaaccacagcgagccacagagtgagacatatttgagctcaatacgaatgctcaccagactatcatcacgaaggtgatctagatatgaaggtatgacacaatctctttcaccaggcactacattgcttgctctagccatgtaggctt

SEQ ID NO: 587786 - DNA, 966 bp, Homo sapiens
caatctggaagactggatggcctcaaagtggggaggaggaggagtgtgggataataggaggaaaggagcgtggagtgacgtgtggttactcaaatgagaagcagctaagaattttgcatatctggactgagacggggcggtggtggggctgagcaaaaggaggaggagcccggagacatcggtgaatggtacccagtgagttccgtgacgcccgtcttccatcgcagtcctcggtgggagggcggggcataagagatcccgacaggcccgcgaacaagtatatacatattaatgaggaagcatcgagatcttcgaagaaccagcttagcctagaggagcctaggaaccatctcgcttcctcagcgcgtaaccgtgtccagcgtaaggactctggcggattggttgagccatcgatggcaaaccagcttactagccacgaacgcaaaagtccctggagaatcctgatgtatagtagacaaagtgattgcatgcagataatctgagtcgccccatcgtccacaactaatcacagtgggcacttggagagcgtggactgagttgcccttgagaagtccttcgtggcatggctatcagctaatgggtcatgtgctggccgtccaagcgttgagctggaccatctggactgagtgccggggctgggcagatgcggttgcgtagtgcagagttgtactccctgagtggaaaggggtagaaggcactctgccccgggtcaggagcgctagtccctttataatttgtcgtgtaggtcaacgtctctgggggacaacccgaggggtaacgtaacgggccacaatcctgcgcaaatgagtgcaattgtgtgggcaggggtccccttgaggtgtcaccacttgtataccacggcccaaatttcgatccagctccaaatcgggcactggtcacgtcgcaagaattcttcttcccctttgagggagttgaagacaaaag

SEQ ID NO: 587787 - DNA, 1176 bp, Homo sapiens
gttcgggtaacaactcactgtgttatggtttccttagtggcttttccacaggatccactagagactacttctttgggggttactcctcgcccgtaatatccggaatcgcggtgcaacgctaccagttttcccaaggctccatgggacctcatagggctatgcatttcactttggccatacgtggtccctcttagtgccatgtgtgactatccaagtccttcctatacgggcccgttgaaattggacgctctctgtgctcccgcaagttcgtacttcccgcgttgcgtgcttcatggttgccctaccccgtcctacctggtttcacagtcagtgaaagtgtaccttgatcccgggggagtccatggctgtctgacgcctgatctcccaggggagcacggaggcagattctgagctattgtaggggactaggcccagcctgtcaaagttgtactgagattggaacgcgcgcgtccgtcctctgatgcatgctggcgctcagatgtcgtctcagctcttgcttctgtgcctgtaaaatggcgaatacccatgtcgaggtttcaagggcaaacctcgctattcattagtcaggggttctcgacgtcccagtatcctcccagggatgagttcccccctcctcgttctcgacttctgtactgacacattccttgggtgccttttggtgaggtctgcacaccctcgtccatgcttagccccctctcctaataggcccctgaatataactccgcctccaatggagactcaggcagggcagagtacaatggctgcaggaaaatcattcagagcgggacatgctggcctgccctcccacgcactagtcacgccatgtgggccctcacatgcccttcgtgattcagggcacaccttgggctcctgctagcggtatataggcatggacaggtaagaaaccactgggaacacagcccttaaggactaatatgcgtagtcacaagtgccattcttcgtcaggtctctgtgggtagccttgtgtaggcctgtaccgagctggcatggctaattttgtggtttatgtagcctatcacagtgctctacttttaagacacttctaccagcaactgtcggttacgggagtgtaaattttagcaatattgttctgcaatgtggcaatattcaaaatgtaaaaggcacacatactta

SEQ ID NO: 587788 - DNA, 260 bp, Homo sapiens
taaaataagttttattattgtggagcagagcaattaactagataaatgactacagatctaaaccttaaggtatgcgaagagtaaaatatttgtggggatatgaaagcaaacattcccttatctttatatcatatacatttttgtatattagaaggctaggactttttgcagtggcacgtagaaatccagggaagttttcttttcacccagggagatgatacacgaaataagattatattgactttttttttttttttttt

SEQ ID NO: 587789 - DNA, 861 bp, Homo sapiens
  misc_feature (51)..(51): n is a, c, g, or t
  misc_feature (658)..(658): n is a, c, g, or t
ttatccctccaaacgcattcacaatgaactgacagatccctataggactgnccgttctccccatggagccctgctgggactgaggacatgaaaatattttgcttctaccatatgcttttgttggcattatgcaggaaccattgacatccgttggaatgaattatgctctcattacctctttggttaaatctagacttaccaggctctgctcctcacaccttggaccttctgaaagaagacgcccgacaacaccattatcaagaccacgtcccccctccccgacctctcccccccaatcgccctaccacctccgccacatcacccccgcacgccgcagcccccgtctcctcacagaccgtaccgccccccccccaatcttgtcagtccccccacccgtactccaccctcaatccttaccctaccgcccatacacacgcccacctccatcgtcacgccccacccataccaccatgctgccccacctccattcagtctcgagccacgtacgagcgatacgcgcccccctcgctttttcctccccccctttcctccaccccgccagtatctcttgccagtcaggccttaggcacatcaaatctttatacagcccctccctgatccaccgcccgccccaccggtctcccccccgccccactcncacctcccccactccctaacactttcgtcgtcgttaacccaccacactcacggactccttcatgctcttgcaccacataccatacatctcgcacccgctcatgttcgccctcccactcccccctcacccgcacctcctccaccctccattcactaacagccctatcgatcataagcacgtcctcacgctctacatccccagta

SEQ ID NO: 587790 - DNA, 359 bp, Homo sapiens
ctcgagaatcgcaaatatttgagtacgtgctgttcatgcattcctcagccacttttgtgtccagaactttccagatttgtgcgagatgtatgaagtctctggcctatgattgtgcagaatgtgtgtgtctggctgatagggttatcgatgtgtgatgaggtcgatgtgacagctgctatcacgtcatctcatgtctggggtcggaatgatgcctctgttaagcacgtttgggatatttctcttcttaggcatgattagtaggcattccagtatgtcagtacacacttattttgctgtgtatgagagatcagaatattttaaacgctactataaagacttgtactggccgcgacatcgca

SEQ ID NO: 587791 - DNA, 669 bp, Homo sapiens
agtgtaggctatgcatactcacagtgaatggaacaagtgaagaataaggataagaagcaataaaatatgtgtctgaattgctagtctgtaaaactgtgatccgaaggttttcagaagaagaccagcttcagctcgccgaatgtgtctatccgttcgtaaacttatcgtggtgcattctccgccagcccagccgcgattagtataagggctatctgtcagatggctgttaacctccccaacaaataattgccaagtgtccaatgagaacttatcatgtaggtgtgtaggtaaatcgggcaaatatgatagtgtcttacatcgggccttgatttcaagtcgtcatatttgtacaatcgagtattttagaaattcacatgacacatgaaaccagtttttgcaattttttttaaactgggcatctggtttctaaacaatttatttgaaacaatctagaattttcttggtgcaaagtgtatcacgtggaatatcctcatattcttaccatattttaagaactttacagcacgattaactgtaaataattcattgatcggtgcagtctaatccctaaatcatactcttacatcaccgaatgtgtggacgaacagagccatgtcatatcactttgctcttaacattcttttgaatcaggctcaatccagcctcatg

SEQ ID NO: 587792 - DNA, 121 bp, Homo sapiens
gcggccgcctactactactactactgctcgaattcaagcttctaacgatgtacggggacatggaatcattttgaagtacattggaatggccaagagggagataaacaaacttctcaaaaaa

SEQ ID NO: 587793 - DNA, 890 bp, Homo sapiens
cagggagtcagcctcgcccccaccccctactgtgttcatgcaagtgttatgactggagggcgagaattttactagctactcatctttttggagaccagggactgcccgtgctgggcagcactggccttgctaagtgacaatcgactctgttttgcccacacttataagcgcgccaaattggggcttggaccactgggaggtgagaccacctcccccaggtccccgtctccctttcaagaagtccagtctcactttggccacttcatgccgccgtgcccgtaactgggtgttttgttcatatttgttacaagaacgagaccacccatacccatccgttataggcttcttgtcccctgtagaatagaccagtgacgttcgattacacgtatttcgtgtgttcccgcgaccacctgtcctagtgccccagactgtgcccacaccagtagccctgaacaggcagctggctgttctcagctccaatggacctcagccgccacattcacacccccgagccagaccgcgaagagggagcaggaaaccgggcgctgcggcaggaggccaaccgcacgagcgccagcactgacggcccaagcaggcccacccccatgcccaagccacgaccacgaacggagaccgaccatcgctctgcactaactcccacctaataataagatactggcaaaaaggaccacacgggacaaatgaaacctgcgacagcattgcccacaacaggacaagtgatccgcaccccaattaaacaacgccagggccacccccaagaaaaaaaatcaaccaaaaaaaacaagaaaactgaccgccacacgcaagaatgcgcccaacatacaccacccccaaaggtgaccccagaaacacgagagaaaacgaagacc

SEQ ID NO: 587794 - DNA, 177 bp, Homo sapiens
cctgactgatggatcacagatcgagtagcttcccatcacaagcaggtgggtcgtcgtcccccaaacgctcagcgatgacgcctgtacacacgcatctgggaccttcactgcaaaggactgttcatgacatggagcaattctggacagcagcagtatgacatttatgacgaggatggt

SEQ ID NO: 587795 - DNA, 168 bp, Homo sapiens
caaaaaaaaatcgcgttcttatgttgacaggatggtctcgcactcctggttctcagcatcctctcattttggcctcccaaagttctgggtttatgggagcgagccattgcacctggccactcctccccttgcttttaatgctcagccccttcactaaagtatgccctg

SEQ ID NO: 587796 - DNA, 121 bp, Homo sapiens
  misc_feature (6)..(7): n is a, c, g, or t
  misc_feature (14)..(14): n is a, c, g, or t
  misc_feature (20)..(21): n is a, c, g, or t
  misc_feature (27)..(28): n is a, c, g, or t
  misc_feature (54)..(54): n is a, c, g, or t
gtacannatacgantcagcnngtaccnnaagggggcaagcatgctggagctgancagacgctgacagttcttcaggcatttctatttcacaatcgaattgaacacattggcccttatcgag

SEQ ID NO: 587797 - DNA, 269 bp, Homo sapiens
  misc_feature (1)..(1): n is a, c, g, or t
nctggcagcatccgggttttattgacggcagaagaaaaattcttcctttccacttgtgaaaggtatttgcttaatttaactcagttttttttgccattcgttgagtgagatgactgtcttttccaccctataatctgtgtgttctttcttgagataatggtatccaccacagctacttattctacaagagaaagttggaaggttctgtcatacaggtgttccaccaatggtgtcttcacatcactcggctcggggtcttcacaaaaagt

SEQ ID NO: 587798 - DNA, 115 bp, Homo sapiens
ccttgcccaaaacagaagcctgactagatgctacttttgaataagtcaacacaaatacacagcagtccattaaaagaagaaaataatgtgtggcaaagtgtggaatggcctgatg

SEQ ID NO: 587799 - DNA, 141 bp, Homo sapiens
  misc_feature (82)..(82): n is a, c, g, or t
gtttgaagggactgaccctccaagcttctggatatcaggagctacctggaaaaaagtcgccacaggcaagactgcccatcanccaccagttcatctaccagctgcgggaacgtcttcaccctgctgccagcatgtcagcct

SEQ ID NO: 587800 - DNA, 149 bp, Homo sapiens
gtcttccagcttctagctcagtgcatttcttctgcccacaacaggactaacctggatacagggattaacctaagccttaaggttttcaatgaaaaggtcaaccaagggctttctgtttcagtaaggctagggctaagggctctcttgca

SEQ ID NO: 587801 - DNA, 105 bp, Homo sapiens
acacacggagaaactcgtctctgctaaaattacaacaaattcaggcgggcacagtggctcacgcccataatcccagcactttgggaggccgaggcagggaggatc

SEQ ID NO: 587802 - DNA, 307 bp, Homo sapiens
cctttactggccccatcattggccccagtggtactgccaccgccaacttcgccgccaacttcggtgccattggcttcttctgggttgagtaaattgtcagatactgctcatcatttgcaatagttttccctgacgtgagctgaagcctcaggttccttcaaaacacgctatctagagagccacatcctgttgactgagagtggcatgcaaaatacatttatttgctattctgtcttacttttttttttccttgtgtgttgtcaagttttggtatcagaaataaatgttgaaattgcaaagtgaaaaa

SEQ ID NO: 587803 - DNA, 734 bp, Homo sapiens
tggaagctttctagaaaagtctttattttcctgttatgaataatggcattttctaattatcccaaatgatttaataaatcccgtaactttaatgtgcctgccggggatccatgaaataaaagtatcccttaccaaaagagaagcatcagatacactggaagggcctcaaggtttaaatattttcagaaataaaagtgattggtatacccttttataaactatatgggtagctgggtaaaatttttatagaatttttaatggatctagggggtcctatgatgaggcaacattccaccaaattagccttccaaaagtggcagtatcatgtataattatgacagcagtttggtttctaaaaccagagtcagatggatatgtcagctttttaacagctggaaatttatggccttatggtggtaatccataaaactattggatcacacttaggggtccacatatatcttaactcttgggttaatactctgtctggaaaacgtcaaattccacttatcaaatggataagagtttcaggggaaatgttaaaaaaggtttttttctaagggctccagggactagaattccaggactcataaggacatcgtaagaccctttctggtagtgaaagctggagtcttaaccaaagagcgtaagccagaattggagaatctgagagtaccgcccaaatgtccaatggggattcaggtgcatttgggacattatttgacatactggga

SEQ ID NO: 587804 - DNA, 183 bp, Homo sapiens
ggtgtgctgtaatctcagctactcagtgagtaggcaggagaatcgcttgaaccctgggaggcggaggttgcactgagccgagatagagccactgcactgcagcctggatgacagagctagactcgtgtctgaaaaaagaaaaaaggccaggtgtggtggcatcgataaacaccgggtaccgag

SEQ ID NO: 587805 - DNA, 870 bp, Homo sapiens
  misc_feature (870)..(870): n is a, c, g, or t
acaatttggattctcactggtatgtttaaaaactgaataaaaggaatagaatttttttggataaaggatcacaaaacaattctaaaacctaatgttttaccatggaaatttaatggtgataataggtttaaatgtctagaatgcaactgataggcttttctttgaactggtagttttttagaagtagttttttccatgtctaattggtattttgtaaaaaaaacaaaaagcaaaaaaaattcccaaaagccagataacaaccagagcaaaactgtggtgccttctatttatcttggattcagtcttggcaatttgtttaacaaaaaaaatctagattggtttaataaggtccagagtatgtgggggaataaatagaatccctctttcatcactgtggtgtatggtcttgggtccaccatattgtgttatgcctttattctaaaatgggagtctcaaacgtgaatgccttgtgaagacagatgcttctataagaggttctgggacctaaatagtccagcatacggtatttaaatcggtatcaaatcagatttctaaatcataggcggtaagagggaatgtaactttaatatggggacttgtcatgtgcagagtccgaatttttttttctaaatcatagcccttatggaaattctatcggagggactcttaaagaaggcagcaggggtgtaaatggacagtggcatttttacaacttttcgagaaaattattctggatttgataaaaaaaaaaaaaaaaaagtggggcggccgaagattaacatgtggcggccaaataaatataagttacgaacggtgaagggttcaacacgggaggttaaagatggtttgttaggacaacgctctcgcgtn

SEQ ID NO: 587806 - DNA, 963 bp, Homo sapiens
  misc_feature (676)..(676): n is a, c, g, or t
  misc_feature (917)..(917): n is a, c, g, or t
agcgtgtggccgttgctatggcaatgcggtggaaaaacgggcctctgggtatgtcggctgccggccggctggtaagccccccagcggatgtggacctgtggaccgtgcgcgcggaccccttccgaggtgtcgatcctggaggccctaaagtcgattgagtaaccgcagttttccgccctgtgtgtcctggatattttgaggtgtgggtcgatctgatctgtgcgcctggtttctatcttccctagccgtcgtcgaacatttcaatgcgcacaatcattgtggaacggttgaaaactgttggtgagaaggttgacgaaggcgacacgtgtgacttgttgtggctgcctcactgtgtgacatgatgttgtgctgagtgcaatccatttgaagccgtggagggaagtttcacgcgaggttcagacaacttactagttgttacaccagtcaatctaggcgttgatccttattgtggtcgtggtagtgttcttactcgtcataatgaagtgagaagacattgtttcaaaggatgtgcgctaggggtagcacgaggttgaacacaaaaggtggcttgactaagatggaccttaggaatgaacaaatactcgcagcaaatattggggcgctgaatatggtattcagtcattgcgtttgctcgaggaaaacgagttgtaagctntatgggtggtaatggtatgcgcgatgctatcaacgagatgcggtctcacgtgccacgtttgtgagagatgtgcttggtagaacagtgttccagcaagaacagtgcagagacagtttgtgctacgatgcgaagacagtcatgttaaactatgccacgttgcgaacgcatgagcagcacacagtacaagagagacatatcgcaagcaagaacgactattaagcgtcacagcggaagaagattnttgaccctagacaggagaccgttcgcaagtggtgagcagcgacgaa

SEQ ID NO: 587807 - DNA, 170 bp, Homo sapiens
acctttgattggcgggcacttatgcaccttactatcttaacagctttgagtgcagagattgaagagttcaaatctgaccagatgttatgttggataagagaattctctgctccccacctcttagttgcccgccaaatcgaaggggtacccgaggctcgaaattcggtaac

SEQ ID NO: 587808 - DNA, 152 bp, Homo sapiens
cacagcgctaagctcgcactgagttttttacctgacgtaggcctagatattaaacatgctagcttttattccagttctaaccaataatataaaccctcgttcccacagaatgctgccacgcaagtatttcctctacgcaaggcaaccgcatc

SEQ ID NO: 587809 - DNA, 419 bp, Homo sapiens
  misc_feature (143)..(143): n is a, c, g, or t
  misc_feature (413)..(413): n is a, c, g, or t
  misc_feature (415)..(415): n is a, c, g, or t
  misc_feature (417)..(419): n is a, c, g, or t
aaaaaaattccacttgcctcagttgccactggtcacatttcaggtgcctcaatgtcctatatggaaatagtgtctacccatattaaatggttcagatttggaatattccccatcacagtagaaagttcttttggggccgggancggtagctcatgcctgtaatcccaccactttgggtgtccaaggcggggggatcacttgaggccagatgtttgagaacagtctggacagcatgacgaaaccccatctctacaaaaaatacaaaaattagctgggttggtgacctgcgcccttagtcccagccactgcggaggctgagggagcccaggacatggagcttgcagtgagccgagatcatgccgctgtactccagcctgagccttgagtgacagagtgagaccctgtctcaattnangnnn

SEQ ID NO: 587810 - DNA, 165 bp, Homo sapiens
tcggcccgatgttttctctgtggggacagtgaggcaaggggtttagtccagacctagtgcaaaggccatctcctaatggaccagacgctctctctgtggggagagtcagtgcccagatgcgctggtgctgagaggaagtgcatggtgaatacccacagggttgtc

SEQ ID NO: 587811 - DNA, 820 bp, Homo sapiens
ggggtcaccttcccacgggctggcacctgggcgcgggcgctgccccggagccggccggcggtgacctggcgcccaatcctggtgggaccctggtgccgtggcccagtgggcctgggcctgacggtccctggggtgcgtgtgccttgcgtggcccgtcccgtgggcggtgcctggtgggctgtgccccggctggctcctcccctctctgcggtgcccagtcgccctttggcctgggcgagctaatcgtcggctcaattgacagactgatgtgccctgatcccattcacctgtcccatggaacgctacaggaagacagacctgaacgtgatgatgcccaaggctggcttcttttgcttgtcagcctgcgccccacttgaagcaatgagctccccgggctccacttgaaacagcagctcatttaaggctttccccaactgcccgtgcctccgggacgataccttaagcaaacgaccggtgcccgcatctggaataggctggcgagatacttagtatccagagggctcgggactttggcgccatcgaggtcatggggacccaggatccagggaacatggggaaccggagtcccaggcctcggagcagataagcttgtgcccaaagaggatccacaagtttatttgcccttgaagagactgggcggaccaatggattgttgcaggttacagacttgtaagagttcccgaaagacaagccgggccccaaaaggagacggacttgcttgcaatccgggaggactcttgggcagcttgagtggtatcctattgagggtaacgctatggggtaccaaggtgccttccct

SEQ ID NO: 587812 - DNA, 200 bp, Homo sapiens
gggggttttttttccccccccccccccggggggggggggggggggggggggggctttttttttctcttttttttcccccccccttaaatttccccccaaaaaatttttttttaaatttttttttgggggggcccccccttccggggcccccttccccggggggggggggatccccctttttttttttcggggggggggga

SEQ ID NO: 587813 - DNA, 451 bp, Homo sapiens
ccccccggggggggcccctttaaaaatagtgggtcccccggggtgcaggatttggcccaagtaagggggcccaatcaaaaggtaatttaaaaaaaattttttttgggtttatgtagggggggataaaaaaaaggtttttttttaaacatggggttttttaaattcccaaaaacaaaatttttaaaatgtttaaaatttgggccgtttttttttatcaggggggcctttaaaaggggaaaaaaaagtttttttaaaaaaacccgttaaaattaaccccctttcccccagtttttttttatgaaaagtttttttaaaatttttaaattttttttgccttccccaaaggttaaggttattggattttaaaagattccccccaaaaaaaaatggggttttttttttggggggcccccttaacaaaaaagtttttttattaaacccccccccccca

SEQ ID NO: 587814 - DNA, 151 bp, Homo sapiens
agagcaactttcagaaccaaagatgggcatggtaccttcatcatagtttggaaacagcagagtgatgtagtgactttttaaaacacagattttcggtattttcaatgtagatcagtgtcctcatttaccattctgtgattcataaatctgt

SEQ ID NO: 587815 - DNA, 972 bp, Homo sapiens
cctctgtggtactcctcctgcctcagcctcccaagtagctgggactacaggcacaagccactgcacccagctccaactcctttctttatgcaaatactagggaaagactaggaggatgagccaggttgctactaaggactaagtgtcgcaccaaggtttgcctttgtatttgcataaagaaaggagttggagctgggtgcagtggcttgtgcctgtagtcccagctacttgggaggctgaggcaggagggttgcttgagactagcctaggtaacatagtgagaccctgtctcattaaaaacaacaacaaatacagggcatgtggtgggcaccgcacttgtaagtcccagctacgtcaggagagacttggaaggctaagaacgatccttgggaacctaggagttggagaccatgcctggggcagatataagtagaggacccatctcatgaaaaaaacaaaaacgcgggggggagaaaaagtaggaggccggctgtggaattggaggccatggagccccaacaaaaacacaggggaattaagggacccgaagaaggcatcaccacagcgctgggctagcggccaagaaattgcgacgacagaggggggggctctgacacaacagagctacgtgtcacaaaaagaaccacataatggaagcggaaacagcagaaagtacaacaacacaaaatgtttcaccaacacacaggaaacccagggtcacagtcgcggccacaactcgacacacgcgtgacccagggaatctcaacatgggggtcgtcgtgcacaaaggaacgagcacataacgggacacccagaacggcactgcacagcaactaaagagacaaggcaacacatgaaggacaggcctgcgaccaggaaaggaaacccccagagaccgccaattagcactgtcacaaataacaccttaacgggtttcacagaacctcagtttcaagcaaacaaaaacaaaac

SEQ ID NO: 587816 - DNA, 209 bp, Homo sapiens
ggtgctggtggttctgtgcggcgtgtggttcttgtgtgggaggatagcttgagtccaggaggctgataatgtagtgagctgtgatcgtgccatgacactccagcctaggcaacagtgtgggaccctgtctcaaatacacacacacatacaacacacacagacatgcacacacacatttctcatgtctatacatagtttattttccattt

SEQ ID NO: 587817 - DNA, 781 bp, Homo sapiens
aaaagcgggcgatgattgcaacagactcactataggcgattgggtagcgggcccacccatgagtatttatatcttatttatgggtgttgtagttgttctcagatggagtctcactgtgtgaaagaagaaagaagatgatgatgatgacacagacactcagaggaacatgcaatatgtagatgtaggcagagattagagtaagacatcttctttctaagtacactagtattgcaggcagccaccaagagctggagacagtgaaacatatattatcctgtagagccctttgagagagtacagtcctgccaacactatgatttcagacttctggtctctcaggctaaatgaagatactcctttatgccattcaccactgtgttaaatccttgcaaggtatcttccaacaggtggtgtcagacaaacacaggtgcacatacactgagacatccgaggtatctacaaatacctacatagcagggactgggagatggaaggtgtgttcagtgtgttgggtgtggtattacattattaattgagcagcaaaggagcacatgtatgcttatctctttttaggtgctgggtttttttacatattaaaaagcggttatctgagtgttcactcttcacatgtggacatatccacatttttcgtctcttattttagcatcctttctttgtgaaaaaagtagtgccatgggatttccaatgggagagagctactgtgttttactttgtgatatgcactataaagaatgatcttgtaacccatgtctgtttttcg

SEQ ID NO: 587818 - DNA, 147 bp, Homo sapiens
caggacaagttcgagcattcttaacaatgattcaaccaggaggagataagggaagctcgaggaagagaaaaaacaactggaaggagaaatcatagatttttataaaaatgaaagctgcctcttgaagcactagcagactcagctgag

SEQ ID NO: 587819 - DNA, 419 bp, Homo sapiens
agctatgatcacgccactgtactccaccacgggcgacaaagcaaaatcctgtctctaaaaacaaacaaaaaaaaaaaaggaaggaaggaaggaggaaaggggaggaaaggtttaaaattggccaccggcggtttccggattgaaatcttgtggggggggggaccgtttttcattgatttccccacggccctttttaaaaaggttacattgggccgccggtcccggtttaaattttttttttccacagaaaatttaactttaacactgggggctaatttttgggtttaaaggccggctttttttgggttaaaaaactggagggggcggggatgtttttttgtttgggacatggattttttttaagggggaagagcaggtacccgggctcgaattggaaataagggcaatggttgttcctt

SEQ ID NO: 587820 - DNA, 587 bp, Homo sapiens
ggacagcatcctccctgagcatgccacggtgttcctcatgccacacctaggatcctgctcctcccactggtccttgttgaagtttgtgctgttcccaggactctctggcgggagcaacttggtctccggccaaggtagccagaatttattgcacttcctttattggaagtcgccatacttaagactggacagcattacgaggccagcagcacagcggtctcaggcgggcagtaaatatcatcattgagaatgccctctttcacttgcagaaagaacaggcgctgagtgatgtcctgaatcaattcctcggacacatcctcagggtagaacttggcacggaacttaaagagcagggggctttccttccgcacatcctgggcagtcaccttcttattgagtttcagccaggtggagaaacctttagtgtcctggtactgcagaccaaagaaccaaacttccctcaagccaatagttttcaccacctggtcaaatagctgcttcccggtggtgttgggctggatggcaaactccagctctgcatccatggtggtcacaccgcacactgatcgttttgggcatggtggcgg

SEQ ID NO: 587821 - DNA, 1606 bp, Homo sapiens
cgaggtcagctacgtaaatccctttgcggcgggataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgactctcataaacgtagagaaatcctttcacgaagaccctcttataggaaaatactgaatgaactgtcctctgatgtgcctggtgttccaaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcgcagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaactaaggcaggagatgcagcagtcctacttattgccatgtggacttgtgggaaggacacgtgtgacctaagaatccagtttggattagtgtttgaaattgaattgggaatgttgttccaggatgtggaatgcagccgtgatcacacttaccgagcttactttgatctgtttgtcaatagcatgcaaaaaagctttgtttgccctttgcttctgctttttttcagggaagctgccaaagaatgtcgacgtcgaaagaaagaatatgtaaaatgtctggagagccgagttgcagtgctggaagtccagaacaagaagctgatagaggaacttgaaaccttgaaagacatttgttctcccaaaacagattactagaaattatttaactatgaactgaaggcagcatgtatagttgcttttgaaggaatacaatatatagctggcaagaatggtggcttcttttctttgtatcattcatcttcttctttaatcattcatcttcttctttaatcacttaacattcctaaaaatgcttcactgtacgtagttaagtcgtagctataacttcaaattttttaaaagggacaaactgtaaaaaatgtgtgtattcttaaaatgcaatatttgtaaggcttgttccaatgccacatacttgcagctcccattctatgtgtcatcaatagtgtcctatgcaataaattatttgcaggtctttaaatcattttaggaaggatgacaaaataagt

SEQ ID NO: 587822 - DNA, 1199 bp, Homo sapiens
tggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcgcagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaactaaggcaggagatgcagcagtcctacttattgccatgtggacttgtgggaaggacacgtgtgacctaagaatccagtttggattagtgtttgaaattgaattgggaatgttgttccaggatgtggaatgcagccgtgatcacacttaccgagcttactttgatctgtttgtcaatagcatgcaaaaaagctttgtttgccctttgcttctgctttttttcagggaagctgccaaagaatgtcgacgtcgaaagaaagaatatgtaaaatgtctggagagccgagttgcagtgctggaagtccagaacaagaagctgatagaggaacttgaaaccttgaaagacatttgttctcccaaaacagattactagaaattatttaactatgaactgaaggcagcatgtatagttgcttttgaaggaatacaatatatagctggcaagaatggtggcttcttttctttgtatcattcatcttcttctttaatcattcatcttcttctttaatcacttaacattcctaaaaatgcttcactgtacgtagttaagtcgtagctataacttcaaattttttaaaagggacaaactgtaaaaaatgtgtgtattcttaaaatgcaatatttgtaaggcttgttccaatgccacatacttgcagctcccattctatgtgtcatcaatagtgtcctatgcaataaattatttgcaggtctttaaatcattttaggaaggatgacaaaataagt

SEQ ID NO: 587823 - DNA, 489 bp, Homo sapiens
tccgatcagtcaggcgacattaggaagcagagggtaagtggatgttaattgactccgctgattctgaagccatttgtgaaatagcatctagtcagatttaatggggatgcctgagtcatattgatgagaaatgacgcacctcatataaatacacaggataaattcagttttgtcacaagtcaagcagttacatagcaacacagatatagccttcgtccaagaagagaataagtcatagattaaaagaaatagattctaaggaagaaacatacgttgtaaaagaactggccgttgatattctatgaaatgacccccatccgggcaaaggacttggagtttggaggagtacctggtgtgttactcatcatgtttggcctgcctgtgttcctcttcctgttgctgttgatgtgtaaacagaaagatcccagtcttctgaatttccctcctcctttgccagctttgtatgagttatgggaaaccagagtattt

SEQ ID NO: 587824 - DNA, 309 bp, Homo sapiens
tgtggctgtctagaggatcccagatagaggcaggagaatcgcttgtagccaggaggcagaggttgcactgaccgagatcatgccattgcactccagccggggcgacaagagcgaaactccatctcaaaaaaaaaaaaaaaaaaaggagggtagattttcctatccctcatttgaaaggtggtgccagaaattgaaaggagcgggtccccaagagtcagcaatctggaattgcagcatacagggacaattctaaacccttgatcggtctacagagcaccttgagtccctacccctttcttcatccaaaag

SEQ ID NO: 587825 - DNA, 155 bp, Homo sapiens
agaggtccccctgagctatgagagcctcagagaccttggtccccccgctccactattaattacaacttgtgcaacgggagtttgttatatcgtattataaaagtacaaacataccaaagggtgcagattgaactcgttctctccccgggatacag

SEQ ID NO: 587826 - DNA, 375 bp, Homo sapiens
aactttttccccctaaaaaattctaacattctttcagcagttaaaagccaaatttagggtggacctgttttacttcattctttaactgtaggttggagtggtgtgaacgatctgcaaaactggccttaaaggggcagaaaaagtagacctgataattaaagtttatgccttaaccttttagatttggtttttgatatgctctcttagtaaatttgagtgtgtctttaaaaacgtaaacccaaagccatttaaagtttttcttttaactttgccactcgcgaatgaaaaaattgaaattatttgtagggaattgccctattcccattttttaatgtatgaggccaacaaataaattttatgtacagtgtgctgtga

SEQ ID NO: 587827 - DNA, 208 bp, Homo sapiens
tgagttgcttcctgagagcctcaactctaccccaagccctgcagctgcagcactgtgcctctgcctcttgctggtgagcctgtcccccgagcactgtagtggcggctgaagcagcacaagctggccccatgctgctctccactacaacctgagagcctggccccgagtcttcatgcctcttttgggcccctgggtctggctctgctgc

SEQ ID NO: 587828 - DNA, 590 bp, Homo sapiens
aaaaaaaaaaaaaagaactaatatttaagtctgggcaggggggctcacaccggggatcctagcacttcaggaggctgaggcaggtgggatcaccttggagttcaggagttcaagaccagccgggccaacatagcaaaactccatctctactaaaaatacaaaaaattagctggggtggtgggtgggcggggcatctggtactcctcagctaactggggaaggctggaggcaggagaaatcacttaacttggcaacctggggggccggaggtggcattggagccaagaatcggggctggcaactccagccggagggatagagcgagatgccgtctcaaaaaaaaaaaaaaaaacttaggggggttgggggcatttcaatctccacgggaatctccatgtggaaatttaaacatttctcaaattattacgggggttcccggtcttcccaaaaaaacgataggtgcccaagaaataagggcattaaacaaaaaccgagtcacccatcaacccgagaattaagtggcccagtggggaaaaaacccggaagacccccttcggggggcaaaatccaagaggcttggattgaacatg

SEQ ID NO: 587829 - DNA, 548 bp, Homo sapiens
tagaggacccctggccaggctctcatagcgttggcaggctcacctatgccaggcttcatttactctataagggctacaggactagaggagaggggagggaaccggaccagctaaaaaatcctataaacataaacagaagacacgtatcaattcagctcgggaaaacaaacagtatataatatatcacagcaacggattttccaaaaatctagtgacacagaaaaagcagtggaggggggcagaaatatcactggagataccagcaagaagggaggggtccaagtcgcagtgacgggcacagataagttactctctgaacctcagctatctatagaggggggggataatagtgccggcctaattcaaatcaagaggtgataggtagatcaaatgaatattaagtaaagggctaaattacatgtaaaatagtatacaaatgaggatgttactaataacaaagatcagaacactaaaagatcacggatacatgaaaaacatcaaagttatatgaaccttcctagaatactatttgaatccaggaggtagag

SEQ ID NO: 587830 - DNA, 646 bp, Homo sapiens
  misc_feature (133)..(133): n is a, c, g, or t
  misc_feature (435)..(436): n is a, c, g, or t
atcgtggcaaggtttctacaacatcggcattgtggagcagacgtgttggtcttggtgggttggttctcctttcaagaaaaaccacagggcaccaacgcaagaacaatataacagcttggatttcgtgtcatancccatttgtattctgaagcatactatggcataccagacttatactatattatattacattatttctcccttaaatagcaggacatggcttccatatttacttcacaacaattaattatcccgtgatcccaccttttcttgtgtggttcttctcactgtggtaccaagtcatcctccgtggctttatcccatttgtgctagaactctcgcatagcgcactgtccgcaacactggcttggttcccaccaaaacacaagcgacaacctggacgcacaatctccatctctccacaccacacattcnnaaacatcttccgacgctttctccatcagctcacacacacacgcctggaactgcttcacctcaatcaattctctctccattattctcaaacacacaaatattctttcacgcacatggacacattcggctggtcctaacacacaccaatatttccacatcaacataccttctgggtcgtactagcgaacacactatcgtcatcacgcacggc

SEQ ID NO: 587831 - DNA, 117 bp, Homo sapiens
  misc_feature (20)..(20): n is a, c, g, or t
  misc_feature (113)..(113): n is a, c, g, or t
tccatccctctagtcattgncttattaattacttctagaattttgtggggaaatgtatttaataagcaatgactaggggatggagcaccatagggggaaggagcacccatggngtac

SEQ ID NO: 587832 - DNA, 283 bp, Homo sapiens
tttcagagcagcatggcactttcaaggcatggagcatgcatgcaagggatctgaacgtaggtggaagtaagtatgcgtgaacttttagtgtattttaaaatccttttatctttcaaaaattgacgtgtaagatactttacattagtcaatcaacagtgtgaaataatgttttcccagtgtgtgaacattgtaggcttgcatggttgtactggttcccaaatttcaccatgataccatgtgtagtcatttattttctttatatttagtggacagaaattgtaat

SEQ ID NO: 587833 - DNA, 980 bp, Homo sapiens
tatgctgaagggctcttcatggccatggggttctgggcgataaggaggcgagggcagatgtcaagcctgatagtggttggtgcttgtggataacggttctgggacccaggttccaggtcccgcgttctcccagcaccctcggttggctctgttccgtcaactctttggtgcgttagtttaaattcgtgccaagccaggcacgtccaaggacagcccctgtgtccacaggggctcttccgttgaattcagcaagggttcaccaggtgcccccggacaagcccctgctggtgtctccatctgcctgccaagcatcgctccagtgcctcgctgcctgtgggcctggcctcaagggcatatggacagacctcctgtacccatcgccagagactccctgtgtgatcggttcacctgggcacgtggggccgtgggcacctggctgggctcggcttgatagaatcttgcggactggaagccttgcggaatgaggcgcctgatgtgggtcccagccatctccggacgccaagtgcttcttcgctggtcgggcgctgctcgtcgtcgcattcctggtattgggcaggaagcacattcatcctggactagcctaacgcgtggaagaggaccgtcgaatcgtgggacacccagcacgcctcgtccagactcagaaatgccctccacaggccagcgggcgacatcccgtgcacctatgtcgccagcgggacacggcatggagcccagagagctctggaccacggggccgtcgcccttagagtagagatcccgccactcatgactgataggatcgccgtctgactctggggtctagatcccgttgggactggacgctctgccacaccactcgcaggaaacctgacggcattaggggagactgttgagccttcagtgtctgcatgtgggaagtgggctccattcacctacctcacagggctgttgtgaggggcgctaaatgcgggccaaagcaa

SEQ ID NO: 587834 - DNA, 499 bp, Homo sapiens
ttatgtcctccaataggtgtgttcatagcagtttagtataaaatccccaaactgcctatcaacagtagtgtctctcaataggagaatgtataaggacattttagtatacttatacaatcaagcagtgggaaaaaataaactattgctttatgcaccaacatggataaatatcacagacctattgataaatgaaagaagtcagaaatgaaaaggctgaaaattgtatgagccatgtatgtgaaaatcaagaacagacaaaaccaatctacagtgacagatgtcagaatgatggttacctttagagtttattgagtgcaagaatatgggtgtagccttctgggatgttgaaaatattctctatgttgatttgggtatggcttaaaaggatttatgcatgtctagaaagttatcaagctgtgcaattaagacctatgtattttattatatgtaatctataccatatttcaataaaaatatgaatacctttaaaaaaaaaaaa

SEQ ID NO: 587835 - DNA, 391 bp, Homo sapiens
ggattggggtgaatttaaatcccattcgggtaaataatcattgggcaaaactaatttttcccaccaaaatggatgggagggggatttaaatgtttttaatccttttgacccatggtgggagatttcaagggcccaacttctcccccttaaagggttattcccaaaaatttcttcccttaagctctttagcaaagggaagggggttttaattttattttcaaattatttaagggtaagggaggggaatctccaccaattttgggggccattattctattccgccaaacccccgaaaatgtttattagttcccgtgggattttggggggctgggaaattcttccccgaccaggtcctcccccacccaaaaaaatttggcttctttctttttga

SEQ ID NO: 587836 - DNA, 654 bp, Homo sapiens
  misc_feature (128)..(128): n is a, c, g, or t
  misc_feature (170)..(170): n is a, c, g, or t
  misc_feature (245)..(245): n is a, c, g, or t
  misc_feature (377)..(377): n is a, c, g, or t
cttacaaggcttgagccatcacgcctggccctttttgtactttttgtagaagcgggagggtttcactatgttgccccggctggtcttgaactgctgggctcaggcagtctgcccacctcaccctcccngggtgctgcaattacaggcatgagccaccgcgcccatccccnatggtttttccttaaatagaaattgttgtgaatggaggctcatccttgtaaaccgcttaggcagcttaagagtcnacagggatttggaaaaaccagcctgggtgacggggccagactccgtctcaaaaaaaaaaaaaaacttcacaatttccttctgtttgctcatttctgatagatgccttgcattttttttttacatgccttgcntttttgcagaagctctgtcccagggagctcaaagcttatcatagtatttaaaaaaaaaaacagaaatacagaaagtgtagggactgcaataaagactagtctgcaagtctggggcccacttctcccagaattttttcaagagttccagtgtttaacattcggcctcagaaattccagaatcttggggttcaaatggaatcttccaaactgcccatcccacccagaaaggacacattcttcagaccatatcttccaatgtttttttggggaagtgagg

SEQ ID NO: 587837 - DNA, 761 bp, Homo sapiens
agcggataataccgcagtcgccggcctcgcggggctcacgggctcgcctcggtatctgcagcgtggtcctctctattgtgagctccacgcctctcggtcctagcagccctcacatctcgctgacgtcccggctgtccatagccagagccaactggccgtgtgcccgcttgatgcgtgccgcccagcttgctccttgctggcctatctcgtgtgctcgttgtgtccgtgggcctgtggaagtccacgagggctggctcttatgtccctggacagggacacagtccgcagcgattggcttgcgtgaaggaccctcactgaagaacgcctactcagtagagaaggagagcgaagagagtagtagctgtacagttgtacctgagaactcttagtctgatttgtgcctaagtgtaccaactcagatagccctatgcaagtagatctccatggaaagcaaaacaaagtactcgacgttcgatcgcctatgggttgggggttgggctgccaggcacacgtgaggcggacttgaaatacccggtagttaccttgtgtggagtgtgacactctagactcttctttgtgagaattgtatggtacatggtagagagctctcgaacatggatcggttgcataatagtagcccctcgggagcccaaaccagtagagaagcccattggacactgattccaggattgaagcgaagctgccaagttatgcaggtgagttctcggggccgtctcctggctcattttccctgagcatcc

SEQ ID NO: 587838 - DNA, 399 bp, Homo sapiens
tttttttttcattttaaagtgtaacttttagatacagggggccatgtgcaggtttgttacatgggtatactgcagtcaagtagtgagcatggtacccaataggtagtttgttcttgaacctgtgctgcccgctctagtagtctgcaatgtctactgttcccatgtttatgtccacatgtgctcaatgtttagatcccacttataagtgagaacatgtgatatgtagttttctgttcctacattaattcgtttaggttaatggcctctggtccattcatattgctgcaaagggcatgacttcattctttttcagggctgtgtggtattccatggtgtatatgtaccacattttctttatccaatccaccactgataggcacctaggttgattccatgtct

SEQ ID NO: 587839 - DNA, 345 bp, Homo sapiens
gtcccgtctgctgtgctgctatggcgataaacatcctgcttctctttttctgttcttaagacctgcctatttgttttcaaggactccatttcctggaggaacttgtctgttagctccttaatcttctcagaagagttcatgtcctttagtcggagttgatactcattctccatttataattcctccacacgagtctttagctccaacataacctgagccttttcttccatgtctgatttagtcacaagcacctcttcggcagagcccacctccctctctcgcttgattccccggccatccttatcaaagaccttgcaggtgaacaggcagccatcctcagcagca

SEQ ID NO: 587840 - DNA, 342 bp, Homo sapiens
ggctatcacattatccaatcaagaagaggaaacgagtgagtttcacagttagccaagactcccggactattggaaactatttttttgagaatcctctcaagtatgcaaaaaatcagtggaccaaagtagaatttaaaagctaagagtaacctacccttgtaagaaacatcatcctgaaaacccaaccagcaggacatcccatttttactttgactaaaataaaacacatatttcaaagctaacctattctgtaccactacaaaactggcatgtatttgaaaaaatggtcaaatttcaattccaaattcaaatatggagataatgtgatagggctatcacatt

SEQ ID NO: 587841 - DNA, 419 bp, Homo sapiens
taaatgttggacaagattagttaacatacattacatatatattacttaaagccagttttagtaccttagcagagcaactcatgctcacgctcacaactagaaggagaaataatatgccacaccacctaaaaacaccttggcacgcagaggagtggcaagggcagggactttaaatcatgatgctatgggcttgtaatccactatctactcacctgttagtgcggtaactggcagtgtctttcatttgtacataggggctgtaaatactatctatagtaggtaggttaaatcatcatggattaaatggacacactatatagaacatgcctatcaaaattctcaaataggtgccaataaatcttaatatctataaatgcaatcattattatcattatagtgaataaaaatccattgcttga

SEQ ID NO: 587842 - DNA, 388 bp, Homo sapiens
  misc_feature (29)..(29): n is a, c, g, or t
  misc_feature (32)..(32): n is a, c, g, or t
aagtgaggtcagtgaggtaccaggatatnagntcaatataaaaaaaacaaattgtatttctatcactatcagtgggcgatctgaaaacaaactataaaaaatcatgtataatggaatcaaaaagaataaaatgcttaggaagaaattaagaaaaaagtgcagaaactcatactctgaaaactataaaacattgttgaaaaagttaaagaagacctaaataaatgggaagacatctcatgttcatggactgcaagacttaatattgttaagatggcaatacttcagatatctttatcaaaatcccagctggcttttacacagaaattgacaggcttatcttaaaattctgatggaaatttaaggtatacaggctagccaaataatcttg

SEQ ID NO: 587843 - DNA, 297 bp, Homo sapiens
aaaacgggggtttttgggcgggttttggttcccgcctccccaaaggatggaaaatggtttaaggattaaaccggtaaaggcaaatatttttggcggaggccaatggttaaaaggcaataattccccccacccactgggggggaaaaaaaattttaaatttccctttctggaagggatttcccctttttgggggggaaaaaagcccaatttttttctttggggtgggggtttttaaaaaataaaaaaaggttaaggttttggttgccaaaccaaaaaaaaggtttttaatttttttta

SEQ ID NO: 587844 - DNA, 825 bp, Homo sapiens
caccaaattgtccctacttcagatggggccataagtggggtcccctggccacttgcacttctgaccaactggctacaaatttgagggtcccctcaattttctcagtttgataattccctcagaacaactcacagagttcaagcactacagttttattgtcaggatcagccaaaagcacgagacgcttagggtgaagtgtgggatggtctcaaacacagagcttctccagtattgttgcccctgctggaggtaagagtagatctatcccatcctctagtcaatccatgctcgtgctgtcaaccaaagacaagcgaagtctgccactggacgctgtcagaggtccagagatatttccaaaatcagggcttcattacgtaggcatgcttgattagatcatagcctacgtgattaaactcaatctcccctcccagaggtctggctggtgaaaagcccctcaaccttctaatcacacagtggtcttctagtgaccagctcccctcctgagtcatctcaatctcttagcataaactcaggtgtgatccaggggaccttcaaaataacacgtgaccgctccttattacgtgggacaatcatacacggatcagttctctcttccagtgaaccaagagaccagggcaagaggtcttacttcatactataaggcctgcatcatctcaaaagacatctaggccttcaaaactgagcttattagagcgcaagaatctctactctcataaccccaacatcgacgggaggatcggtctgacagacaggagaaccatatgtactacaccaagcacagagcggaggccaaacttgtcccgc

SEQ ID NO: 587845 - DNA, 222 bp, Homo sapiens
gcacttcccatttgtgtttcagaaaggagtagaatataaacccataattgcttatgtatgcctattcaaaataaatgggtaaccctgattacttttgggaggggaaccagtaggttgaggacaggaaagggaagggttttaacccttacccccttttgtacattttgaattttgaaccatgggactgtattacctattcaaaataaacaataaatgggccca

SEQ ID NO: 587846 - DNA, 748 bp, Homo sapiens
gcttatagagcagcctcctttgaagatctccaggtggacttcacagagatgccaaagtgtggaggtgtcgagtgtggatcaaggactggaacgtagcctcttgggtgcccatggtggaaaggaccccagacgtgtcgtcctgatcactcccactgctgtgaacgtagagagaatcctagcctggatccatcacaaccgtgtaaaacctgcagcgccttgaaatcctgggaggcaagaccaagtctggacaacccctgcagagtgaccctgaagaagatgacaagccctgctccagtcacacccagaagctgactggtccacgcacagccgaagcatgaggaagctcattgtgggcttcattttgtcttaaattttgactttacagtaaggggcttcaactgttcttactcaaactggggactattcccagtgtattcatcaggtcagtgaggtaggacagcaaatgaaaacaaatctttcgtgtacatatagttattatcaactgtatggggaaccgttaaaagagaccttgtggtataaatggccactcagtacaagggtatgtagcccagggaaatggactgacctgatgttgtgtataaacccatctgaggcccccttaaaaccaaccagttggacataagattaagacctgggctttcctaaggtgatcccagtcacataatactagaacaggaaaaagggatcccaaaaatactaaaattgagcttgggacctaaaggaacac

SEQ ID NO: 587847 - DNA, 81 bp, Homo sapiens
  misc_feature (48)..(48): n is a, c, g, or t
ttcaaacccaacttccaccgagaattggcgagacttgatgatcatganctgtcattgactacggtcctgtgatcagcggcg

SEQ ID NO: 587848 - DNA, 1092 bp, Homo sapiens
gggttcttaagccagcatgataatggcgagtttttttcttctcaggaggaaaaaaagcaagagcagaagtcgtagtcatgaacgaaagagaagcaaaagtaaggaacggaaagcgaagtagacgacagagagaaggacacaacacgagcaaaagcccgtgaaagaaaagcgaaagtagaaagcaaaagagagggcgaacgggagccggctcaaggaaagtcgaaggaattcgaaagattttacgaaggcccgcttacaggaaaggtcccttaagatatggtaaactaataagtgtattgactttgaggtaatgaaggggttatatcttctgggggtattccagaatggcaagtttttaaccttggaggtggaattttgaattggtgaaattcttcggaatcttgttctaaatggaattgggttaacaaaagtaattcgaattcaaaggattattgggagcattgcaattacctaagtaaaagttggaaaaattacaagttggcattagaagcaagataaggtaaaaaaatgttggctttttcacctaaggggccattaactgggactaattgtgtctaggttaaaaactaattcaagagcttttctaaaaacttgggtattggcccaggtcaaacggcaaaacttgggattgaaaaggcactaagaaagtggcttgcacacacacagattgcaccatgtggttggtggccccaaaataccttaagaaacagctttaaccaaaggtggtctggggcctggttaccaggaatggtggctacaattaccattattcgacgtttaagaaagtttggtcaaaagttgctggatggaataactaaaggtttacgcacaatgttagtaaaatgttaaggttgaaagcaaggtaaaacagttaagcgcagagggtcgttggaccacacccgagcgggactcggatatttcaagcgttggagacaatgtgtccatgggccccacagctctgggggcaaacatctagtggagacagacgcggatattggcgtccacatctggaagtcaacagaagatcccctttcgaccagggggggaccacaacacatggtgactctcaac

SEQ ID NO: 587849 - DNA, 709 bp, Homo sapiens
gcctgccagaggactgaccacagcctggcttggcagctgctctgtgtgagtgacctccaggatctgatgactgggctctgttttccaaggcgtcttcactaggccccctagctacacctggaagtttcagatacccacgtttggggggcctcctgcctgggcaggctctttcaacgtgtgcgcctctttggagtcaacgcctccttccctgacccgcctccccctagccgtagccccgagtcacgtgtcaggcgttcgggcctggcccctgcactgcctcggcgaggaggtgcgcctgggttaggtcatgtcgacctctctgtgccctcagtttccccccgctttgagtcccctattggccttgttgacacgggtggagagggtactgtctaaggggcgccagtgttctcgttccagtgagggaagatttctcagctcttggcgaacccccttgctcccagggcgcagggcgcaacacccttttttcattcagacattgtcatgggcgcaagctttgtgctgcgcccccttgcgtgagcgagacagccccagtgaggggaccagcaggggatgctgtgtcgctgcctgggatcttggggttggcctttgcatgggaggcaggtggggctgggatcaggtaagtctggttccgcctcctgtctgagagaggagtgcggagccccagggccggcttgtgttgtaccttgcg

SEQ ID NO: 587850 - DNA, 359 bp, Homo sapiens
catgttatccccaacacaagacaacttactctaagaaaaaagcagacatttaagagaagggtttacttttcataaagccatgtaagggtggcatttgaaagttactattgaaggaagttacaaataatttcatatatatctctaaacattgacgtttacagcctttgaggcaaccatcctttactataagatataaaatagacggccagacatggtggctcacacttgtaatccagcactttgggaggccgaggcaggtggatcacctgaggtcaagagtttgagaccagtctggccaacatggtgaaaccccatctctactaaaaatacaaaaaataactgggtgttgggcgataaca

SEQ ID NO: 587851 - DNA, 907 bp, Homo sapiens
gcgtcgtcgtcctcctcgtgtgtcgtggcccccccgagttctgtttttgccggtggatccgcgtcccccccaaaattttgtgtcgtttggcgcaccacccgttttgtccgatgtttgccctcagtgtcgcccggcttactcgcgcgaaaaattttgtccccgcggggtttttgcggccccacacattcggccctcctcgtggggggaaccccggctctcctttgtggtcaccccccgggggcgccctctccgggggtcgctaaattattgtccgccgctctttaggtccgcgcgcgcgttcttctttctggccgtcgttgggtgcggagcgcggccccgttttttgacaaaatgaatgcgggtgctgtggtgcccaccctgcggggtttccccttgtcggtgaccaggggattgggtgggagagaagcccctcgcacctctaccaccgccgcggccgtgtgggcgggtgggcccaccctgagtgccgcgccccggcttttagacgcgggtgtccccgccccgcactgggtccccgaattacccgcggcgtttttcccgacgcggagtttttccacccggggatcatctcaagtgtgtcttctgcgagaatcttccgcggcccgtttcgccctgagactacaagaaaaaggctgtggggggacacacctcttactaataacgggatccactcccgccccgggcgacgcccactcggacaaataatctggggcttctccccctcggtggcgagccagaaaccgcttagcaagcagggttattgaagatcctacgacgcccccccgcgcgtcaccaacagccgccccgtgatgaacttcccccacacgaggtcagcgccgtaccataagcgtgcgcccccagccccacaaaacgcctcgtccaacacaag

SEQ ID NO: 587852 - DNA, 279 bp, Homo sapiens
atgctgttctgaggatccctgtggtcttgtgctggagactgaaatgagggacggtgcagttgtgtcgccagtggagggggctgctgtgttccggtgtctccagcccgccatgggctgaggctccgggaggcccacgggtgcacctctggctggtgaacgaggtaattgtagtcacatgtgacacaagttagcattacaacggcactaatgttgcttcttgtaaacgtgttacttgctttttctcattgttgattttggcacattaagtgcttaagcctg

SEQ ID NO: 587853 - DNA, 405 bp, Homo sapiens
actacatacttccgggagaacacagatctttttaaaattgaaggtgtttacgcccgagatgaaacagaattctatttgggcaagagatgcgcttatgtatataaagcaaagaagtaagtttatgacactggtaggatgtgggtttttgagatctgcctcattttcttttttatataacggagtcttgctctgttgccgaggctggaatgcagtgacttggactccctcaccgaaacctccgcctcccgggttcaagcaagtgtcctgtctcagcctcccgagtagctgggattacaggcgccggccaccacgcccggctagtttttgtattattagtagagacagggtattgccatgtttgccaggctggtcccaaactcctgaccttaggtgatccgcccacct

SEQ ID NO: 587854 - DNA, 314 bp, Homo sapiens
ggttcttgtcctcctaatatcaacagtggattgccttgctgcagaggggaactgcacgtttaagagaaaatatcacgggccgctttccacaatgcagttgctgtagtcatctacactaataaatccacagaggagccagttaccatgactcatccaggcactgagatattttgagatatctggagacaaacatctctgtacacatgacaatagctgtggacctcgtatgcacccagacctcagccgtgctctctagtcttcgtgtcaatatcctctattgttttgatgattatttcttcagcatggctcatatc

SEQ ID NO: 587855 - DNA, 366 bp, Homo sapiens
  misc_feature (38)..(38): n is a, c, g, or t
  misc_feature (150)..(150): n is a, c, g, or t
agcagctgatggtacttagaccttttgggctctttctncaagatgtcacttaggaatttaaacaattgtatttacattcaaaactaggaacagacgatttaaacaactgtatttacattcaaaactaggaacagacggggggaggagtgngttatcacgtaaaggtacagaataataaacctgtcagttaaacgggagtccaagtctgtctacctcattctttttttgagatgggtcttgctctgtcacccaggctggagtgtagtggtgcggtctcagttcaccgaaacctccccctcctgggttcaagcaattctctgcctcagcctcccaagtagctgggattacaggggtgagccaccgcac

SEQ ID NO: 587856 - DNA, 864 bp, Homo sapiens
  misc_feature (446)..(446): n is a, c, g, or t
  misc_feature (714)..(714): n is a, c, g, or t
ctagtgtgggggggggaccatatgggtctcaaccgacctggtttcgggcgcgtctcacttggttccacaggatttggggcactcgattatcacatttaaacaccatctggacccgcaatataattcgccacataaccctactattcaacgtgtatccacggcttttactgggggacgcccggactaccgctccaccccgcgtttgctcacgtcgataccattgtaccacgacttaagggtactttatagatttcatgaacgagggcatcacagtgaaccgccctggatacacaacctcatatacattgtgtaacggttcattgagtcaggtagcgccaaccttgtagcgcatagtatttcccggataaatactcgacgtctccattccaaattagttagcggataattctgctcgggcggtgcctacacgggaccgcattgaaggncaattgccctccctaatacatagcagccccatctcttgacgtctacattacggtccctattattacacatagactagcccctttctacctgcgagatccgttaaataatagaggcggcgtctactaaccaagacagctattgttatcctagaaatgggatttcttcgaacaagccggctccacatactattaagatagggcggccctatgaccgcctatgctgtccttgacttactaaggacctatccttctatccaagtgcctggtntgtttatagctcaaaaggagcttgtcacaccatctcactattgataacaccccccggtgaagcgttactttatcatgcaatactcttggtaatcactggcacggcggcccttttacccaattcacggggaatttcacctcgtttttatcg

SEQ ID NO: 587857 - DNA, 240 bp, Homo sapiens
  misc_feature (88)..(88): n is a, c, g, or t
  misc_feature (193)..(193): n is a, c, g, or t
gtgtaggcaatgtggcagtcacagagcagacgtgatcctttgaaattgggagactgggtctgtcttatctgtcaagtcccaaaaacanatgagttagaatatgaataataaatacacatatacacccgatttatttcaggcattggatgatataatagggaaggctgccaaattcaaactctctagggcaccnagaaactctggaagctccgcaggagctgcagtgctacaggcttcaga

SEQ ID NO: 587858 - DNA, 150 bp, Homo sapiens
ccgttctgccgatagattgggtaccgcggtactccaccgaatcaagggtcttggattccttttcgttaatacgaccgacgtggccaatgtgatgggcaaagtgcgcgcccagggggtagtggcgaacgaattgtggttccacgtccaccc

SEQ ID NO: 587859 - DNA, 312 bp, Homo sapiens
ttgtatataacatattacatacattgaaaactaccagataatggttgtaacttttgcttttaactgtaatacatatgttatgtggctcacatctttaatcccagcactttggagaccagtgcgggcagatggcttgagctcaggagttcaagaccagcaaagccccgtctctacaaaaaattcaaagattggctgggcattgtgacgtgtgcctgtggtcccagctcttcaggaggctgaggcagaaggatggcttgattgcaggagtgagatcgtgccactgcacttcagcctgagtgacagagtgagacc

SEQ ID NO: 587860 - DNA, 132 bp, Homo sapiens
ccacccattaagtagctacctgacccaagacaggacgccgatgggttccaagggccagatgggagggtagaggtgaggagggaggcagatgggaggccgctctgcccctttgtgcacggatgacgtaggagc

SEQ ID NO: 587861 - DNA, 332 bp, Homo sapiens
  misc_feature (96)..(96): n is a, c, g, or t
  misc_feature (103)..(103): n is a, c, g, or t
  misc_feature (108)..(108): n is a, c, g, or t
ggggggggtttttccggaaacatccccttccttccaaaagggtgtttgtttttggtttcgccccccaccgggggtgttattgaggaggggggcctnttttctncatcntcgctctttcttttccacgcgctttattgggggggggggccctttttgttctagaccccctccgtgttggggggttcaggagaataaccttttttttccccaggactttgttgtgataaaaaccaggttttaatcagggacaaaatgaagagcagaggctagtaagataagggaatataataaaaaaaagaaaaatgtaaaaaaaggcacagaagcaaaaaaaa

SEQ ID NO: 587862 - DNA, 292 bp, Homo sapiens
ggtgtacgaggcatgcccaccaccatcggaatggaacatatgcgcgattacctctccccttctactcctctcccaaccacacacaactcagtacacattctattgggcagctgaggttcaatccaagaagctgctggtctgaagccaatttgcacctataacacaggagatgctaaacatctggagatgtaccaggacagatgtatgccccgcccctcacggcaggagcacacatcacacatgtggttgtcacacaaaaatactggcttcaggggtctccactgggcatcag

SEQ ID NO: 587863 - DNA, 496 bp, Homo sapiens
agaagtagcaagagatactgcaattgaaaccttgccattgtacctctttgcaccaccaattccaggagtgtccctggggcctcagcacagcctgggcatttgtttccctcaaagccagtctacggaatgaatatcttgtttcaattctggattggaggtccttcaaggaagtccattagaagttgaatacccagggttgtcccacaggacagtttcacactatcgagtgatgcttagttaatagaatatggttaatgccattcatcattttgtatcatgctttggtttcttgaagccaggcatagtacatgcatgcctgtgatcctgggacttgggatgtgtgggcagaagaattaaatgttcaatgttcacctcggctgtatagcttgaggccagactgggctgtgtgagatactgtgttttggttttttgttgttgttgttgtttttggtgggttttttttttgtttttaattaaaaaccgaacacttcttgga

SEQ ID NO: 587864 - DNA, 437 bp, Homo sapiens
  misc_feature (5)..(5): n is a, c, g, or t
ctacntttcccaaacacagtgaggacactcactcacaataactccaatctgaggcactggtgccggaggaggagaaatgcttcccgggcccagactggcacaaaccagtgcgcctgccggctccccctccggacgcgcccactgtgatggctgagtgttgctattaaatagcagcaatgaaagacatcattcagctccttcaagtttccaaataaaatacgctacttgatacagaaaaccagcaggaccccaggacacagctccacttcacagctgggaaaactgaggctcaggaagagagtctggcagttcctcaaaaagttaaatagacttaccagaaggtgcagcagtcccactacagatacatgcccaagagaaatgaaaacatacagacacacaaaaacatgcacgccagtgttcacaacagcattattcgt

SEQ ID NO: 587865 - DNA, 527 bp, Homo sapiens
  misc_feature (9)..(9): n is a, c, g, or t
  misc_feature (345)..(345): n is a, c, g, or t
gctcattgntgcctccccagcctgggctatgggagcatcggtctggcggggctcattccactcgggatgccaccctctacttactgcagtgtggttctgcatggatgtgtggaacaatggatagatcgaccgtgcaggtgatgcacagttggtcgtgctgccctgaccacacatgtccccctgctagtggtccatggactggtgactattgtctcgctaccacttacaattggaacccttgctggacggcaccgtccattcagacaccagtgtacaggtagacggcgcagtggacgttagtagacagccgatatcagtcagagctcttgtgttttgtgctcgaantccacatggggacgattgtgatccaaggggtggccatgcattgggcgacaattggttgctcccgttgggcaataggaatgcagcagggaatgtgaagtttccgtgcaatcccacgtgccttgtatcccatgggtctcgtgatgagtcgggggacacaggggttcatgggggactcagttgat

SEQ ID NO: 587866 - DNA, 174 bp, Homo sapiens
tactgatcttgactagcatctccaagtggaaaggttttcagtgttcccaagagtgaactctcaaatccagaatggttatctttgagatcatccattctcctcagtggcttctccagggaattcttacagtctagtcgtgacagtcactgcattagcctgcgaacctagtagggc

SEQ ID NO: 587867 - DNA, 298 bp, Homo sapiens
aaaatgagaatataaatacataatcgcattctttaaaatcatatccccaaatgcgctttcggaaccctcccttcaaccatataattctgaaaaaaatccagttaatgtaccatttatttgctttataaaggaagctctattttctttaccagaaatgtttataagtaattcccaatagaaagctgcttattttcattaatgaaaaataccctgtggtttgtatactagaagtcttcttcaaaattgtgtgacgcctttctgttcaagcgcatgtgtaaataaactttcttgcgcattt

SEQ ID NO: 587868 - DNA, 1313 bp, Homo sapiens
ggcctggaagcggctcctgtgacgttgatgactcaggatgtgttgggactctggtcagtgtcgcgatatagctcagatggggttcgccgcgtacgagcgcatgctagttgcaggccttgcgtggttcagaggaactcgtggagcgccggggagaacagctggcagacgtccagacgttgctgcatcgttgcgcacgactggaaaccatttctgacacactcacgatgattccattgcgagagaggtacgctgactacgctgggttgggcaaggggaccagggagacaacccatggcttggctggcgaacgcacctgacatatcacgtacttattccaagagcgttacgctgaagccctcggcccaaacaacatcgacaacgcacgcccagcacggcaacttactctctcctcgaacaactgcagtttgctcgcggccttatccacaatggaattgaccaaagtccccacaacgatcgaactgcggagggaaatcagccaaatgacaggacctccaactttccaacatcggtagtaccgaatcctggagtctttctccagcggtcgtcgcaccggacaacctgcttgcacatcttgggagaccgacgacacggggaactcaacatttgtcatgccttcattgaaagcgcgaccttttccccataatgtggaccctaacagcaggggcctacctgtcaccactcaacacggacttgttgacgacacatgcaagacccgtgaatgcggcaagtctgaccacgctgccactactgttctacggaacacgcctcaacttggcgtggcgatacgccaacggcaacacgtcgtggactttcctcacttgccactcggccattttctcttcacattagccgtgtttctctcacgacgcgcgactctcaccaatctttcgggaacgggcacgtatcagccttctcgaacgatgcaccaacgggaaacacgggtgtcatacaaccagaagtgtggccaacgaatggcatacggcaaacacccgtgacttacgaatgggacaacaacggcccaggggggacgttccgcaggacacgtcacgacggcaagctacggaacctccccacggccctcagcggaaccgaccgcttgctcgacggtcggcaacagacatcgcacggcccagcagccggcgccaccacggggcgcacgaactccggggcccccgacaggggctacgaggaacccagacacgcaagcagactcgcaagcctcccgtaacacagagacacccacgtggcagcggacaaactgcatcgacccacacaacacgttcggacacagg

SEQ ID NO: 587869 - DNA, 359 bp, Homo sapiens
ggcgactcatcttgagtagggactgtgttatgaagctgagacccactgggctgcattcccaggaagttaggcattcttagtcacaggatgagataggagattggctcaagataaggtcacaaagaccttgctgataaaacagtctgtggtaaagaagccagccaaaacccaccaaaaccaagacgggaatgaaagtgacctccggtcatcctcactgctcattatacgctagttataatgcattgacatgctaagagacactcccaccagcaccatgacagtttacaaatgccataacaacatcaggaagttaccctatatggtctaaaaaggggaggaaccctcagttctgagaattc

SEQ ID NO: 587870 - DNA, 211 bp, Homo sapiens
  misc_feature (84)..(84): n is a, c, g, or t
gcccaccttggcctctcaaagtgctgggattacaggtgtgagtcactgtgcccggccagcatttcattgtcttttatgacattnccatttttgaaaaacaatcccttttttaaaaaaaacctggatgttccttatttgggtttgtctgatacttcctcatgattagtttcagagtatgcattctggccagaatagcacataggtatgttgc

SEQ ID NO: 587871 - DNA, 442 bp, Homo sapiens
atcctgattccagttaagtaatgtaaactagtacttacattttaattgccataagattttaatgccagccctaacagatttattgtgtaaagtacccaaaattgcctaattcacatcagttgcctttgttagaaattgacatctctgaggcccaggtgcagtggctcatgcagtcccagaactttgggaggcccaagacaggaagagtgcttgagccccaggagtttgagaccagcctgggcaatgtggtgaaactcccatctccacaaaaaattaaaaaaaaaattagctggatgtggtgacatacatctgtggtctcagctatttgggaggctgagatgggaggatcacctgagcccaggaggctgagactgcaatgagccgtggtcatgccactgcactccagcctgggtgacagcaagattctgtctcaaaaaaaaaa

SEQ ID NO: 587872 - DNA, 337 bp, Homo sapiens
  misc_feature (308)..(308): n is a, c, g, or t
cacgaggcgcgcgccggtacgtccaggggatcgggctcgcgcttgcggcaggactcgcacaggcggttgtgcgggccggcgctcggaaacggccggccgcagcagaggcacgggcgcgtgacgcggcctttcttgggcggcaaggatggcctggcgggcgctgggagcgcggcgccgcgccggcggatggacaggcctagcgagtacagcttgccctccaccgagctgggcgcccgcccgagccgggcggcgatgtcgcgcttggttcgtccctcggcgaccagggcgcgcagccgcgccacctcggnggggctccagggacgcttgccctgggcga

SEQ ID NO: 587873 - DNA, 430 bp, Homo sapiens
  misc_feature (2)..(2): n is a, c, g, or t
  misc_feature (8)..(8): n is a, c, g, or t
  misc_feature (35)..(35): n is a, c, g, or t
  misc_feature (54)..(54): n is a, c, g, or t
cnaccctngcaaagtccccttttcccatgaaatgngccatattcacaggtgtcnaggaatccagagggcaggtaataattgggggaccattattctgccaactacacagggccttatatggtctggctctgtgtccccattcaaatctcatcttgaattgtaatccgaattgtaacccccacgtgttggggggagggaccttgtgggaggtaattaaatcatgggggcggttaccctcatgctgttcttgtgatagtgagtgagttctcacgagatctgaaggttttgcaaggagcttttcccccttttgctcaggactctccttcctgcagccaagtgaaggacaagtttgcttccccttccacaatgattgtaagtttcttgaggcctccccagaactatgagtcaattaaacctctttcctttataa

SEQ ID NO: 587874 - DNA, 343 bp, Homo sapiens
taaattcgcggccgcgtcgaccgatcgaagaactgatggtctcgccggtgtcgccgcacaccatcctgatcggctacaccctgggtggcgtgctgcgcggcttgatggtcggggtggtcgtgaccttgctgtcgctgttcttcacccatctgcaagtgcatcaccttggggtcaccctgctggtggtggtactgacggcaacgatcttctcgctgctggggttcatcaacgccgtgtttgcccgcagcttcgatgatatttcgatcatcccgacgttcgtgctgacgccgctgacctacctgggcggggtgttctactccattgtcgacgcggccgcgaattt

SEQ ID NO: 587875 - DNA, 147 bp, Homo sapiens
actatgatttacagtatccagaagatcacttaaacattagaacttgcgattcctgcagtagtaaaatggagatagatggtaactagtctcacactaagttgcctatacccctgtagcccaagttagcgtgtgaccaagttgcgatgt

SEQ ID NO: 587876 - DNA, 492 bp, Homo sapiens
ctgtctccccgtgctggagttggtggcgccatcctatctcacgtcgcacgcttgcagtgctgagctcatgtgattcagttttgctccaaccttagcctccttggtcatctgattgcatgagagtcatcccacacttgtggactcaggtcccctgagctgtgatcccagaactactgcacaccagactgggcgacatacgaacatttggtcttcgaacgaacgaaaacaaaatctcttgaccatgtgggatctggggatccccatgtatgttttcaacccacattagaaatgaccccctaaagcacctctgtcaaaacaaccaaacctgaactcatccctctctgccctctgcccactcttgctgttcttccttgttttctacctctttattgtctcaaatagaacatatgaaaatcattacattgtcctcccttcaaaaccagtttttaagcaagtctacttgatatcccccatatctgcccaattgtctca

SEQ ID NO: 587877 - DNA, 596 bp, Homo sapiens
ctcgtgtctcctcgatgtgttaccttctacattgttcgtaagcggacgtagcccccgctgttcactatctgaatcgcatgttcctatgtttagagtcggcgtaatccactataagacaatcagcaatggggaatttctcgttcaccttcgtcccaaatgtgtctcgtgactgagcaccacacgaatagtttcacttgtgatgcagtctcactctgtcgcccaggctggagtgcagcggtgcaatctccattcactgcaaactctgcctccctggttcaagtgattctcctgcctcatgctcccgagtagctgggattacaggtgcgcgccagcacgcctggctaatttcttggtattagcagttaagaaacggggtttcaccatgttggtgcgtgagccactgtgcccggccaggagtaggattctcgggctcccagatgactcctttttgtcagagttggtgtttccaggaggcccttggtcttgacatggagactgttgggtgcagccgtgctctgcaagagcagggcccgttctacagtgctagtgtcttgggacagttcccaggcaacaggcagttctgctctttccatctg

SEQ ID NO: 587878 - DNA, 421 bp, Homo sapiens
cactaccttaaaatggtggccatacctgaagagggaagggcaccggagcggataagataggacagcaggacagtgttcgggatgcctggcagctgacatatgcatggatgccaccgatggactgagagggccaaacccgactccaggcgtctgaccgataccgtgacctagcagggggtacagggcggagcgccaaggagcaggtgcttaggaagggaacagagaacctccagagggcgcaggcttaggtgctgcagtctgtccgggagctgagccgaagtcggaggctgtatgggcagcgggaacgtgtgtgggccttggcacaggagaaggcggctgatgtccaggccaggctaaaccgaagtgaccatgggatcttccactctcggaccagtctccagaaactgagcaccaagctgtc

SEQ ID NO: 587879 - DNA, 540 bp, Homo sapiens
  misc_feature (304)..(304): n is a, c, g, or t
agtcccaggatgggctccatggttggttgatacaaaaagagggaggaaccctggttggtgcttgctccattcaatggatgagggaagatggatccacaccccaccaccagcgaagcttgatgctttgctcgctgcgctgcatgagggataacgaaaccttccgcccttcttcatccatccaggaagcaaggttggaggaagaattaaggagaaggaaggagaccagacttgttggtctgtttcctgcgtgcggcggcgcgccactcgtgctgggtggtgtattgttatcgttttcctatgctgntgtgtcggtgtaagtcggctggcgacgccttcgtggttgtgatagcagatgatgatgatgatgatcggcaagtgctctgtgtagtatagacgacactccgaacatttttgtattatctctggagcacaccaccgtctgtccaccctcacagagttgtgtcatctccccgagatctctctgtggcgcacccctctgtaagaaaaaatctacaccacacaacaaataacaaacaaaca

SEQ ID NO: 587880 - DNA, 737 bp, Homo sapiens
  misc_feature (14)..(14): n is a, c, g, or t
  misc_feature (28)..(28): n is a, c, g, or t
  misc_feature (515)..(515): n is a, c, g, or t
  misc_feature (708)..(708): n is a, c, g, or t
aggctgccggaatncggctctaggttcncatttggaatgcttccagtttttgcccatacagtatgatattagctgtgggttggtcatagataggtcttattattttgagatacgtcccatcaatgcctaatttattgagagtttttagcatgaagcgttgttgaattttgtcaaaggccttttctgcatctattgagataatcatgtggtttttgtctttggttctgtttatatgctggattacatttattggtttgtgtatattgaaccagccttgcatcccagggatgaagcccacttgatcatggtggataagctttttgatgtgctgctggattcgcgttgccagtattttactgaggatttttgcatcaatgttcatcagggaaattggtctattctcttttttggttgtgtctctgccaggctttggtatcaggatgatgctggcctcattgagttagggaggattccctctttttctattgattggaatagcttcagaaggaatggtnaccagtcctccttgtacctctggtagaatacggctgtgaatccatctgggcctggactcttttttgttggcaagctctggttatctgcacaatttcagatcctggtattggtctattcagagattcaagttcttcgcgggttagtcttgggagagtgtatgtgtcgaggaatttatccatttcttctagattntctaagttaattgcctaggtgtttgggtc

SEQ ID NO: 587881 - DNA, 387 bp, Homo sapiens
aatttgtatcatcacctttgctcttacagtatgggtgtttttttctctgtcttttaggatttttactttatcactgtttttgatcaatttgaatatgagtgtaccatggtatagtgtgtagcttccttgctttcttttttttttttcttgtttttctttctctttctgtctcccttttttgctctcttggtctttcttgcctgtttgtcttcctttcttccttggtcgctccttgcttccatgcttgcttttggtactccgggttcttggagatactgaaatgtcggggtaaatagtgtgcatcaaatttgaactgtttgcggaccgttatttccttagcttttttatggtcgtcccttccttttgcctctactttgggggccccat

SEQ ID NO: 587882 - DNA, 270 bp, Homo sapiens
gggtgactacaggacctacgtatatgtaatagagcagctatataactccttagcatataacatggatcagaaaggtaagggttttgcacaaggaaagaggcaggatgaggcataaggcatggcaggagcaaaagaaagagaggactagggaaggggaaagttaaaagaaccttcaaagtgctctgaaactcccccagaaaccaaaaatatgataacagcagttattgtcaacggcatttaactgcatacggtggttacataattacgggg

SEQ ID NO: 587883 - DNA, 116 bp, Homo sapiens
  misc_feature (37)..(37): n is a, c, g, or t
  misc_feature (44)..(44): n is a, c, g, or t
agaagtcaactaaagcttcaatgcatcaatttataangcctcanagatcagcaatttatgacacttacatttacagtcgacctttactaaccaggcaaacttcccgaaatgatcag

SEQ ID NO: 587884 - DNA, 287 bp, Homo sapiens
ggtcgacggggctcacgcctatggtcccaatatttctggagaccaaggttggcagatcacttcaggtcaggagttcaagatcagcctgaccaacgtggtgaaacccatctctactaaaaatataaaaattagccgggcatggtggtgtgcacctgtagtcccagctacttgggagactgaaccagaagaagcgcttgaagctgggaggcagagctggcagtgagctgagatcatgccactgtactccagcctgggtgacagagtgagactccatctccaaaaaataa

SEQ ID NO: 587885 - DNA, 298 bp, Homo sapiens
  misc_feature (14)..(14): n is a, c, g, or t
  misc_feature (19)..(19): n is a, c, g, or t
  misc_feature (25)..(25): n is a, c, g, or t
  misc_feature (37)..(37): n is a, c, g, or t
  misc_feature (81)..(81): n is a, c, g, or t
  misc_feature (106)..(106): n is a, c, g, or t
  misc_feature (121)..(121): n is a, c, g, or t
  misc_feature (129)..(129): n is a, c, g, or t
  misc_feature (154)..(155): n is a, c, g, or t
  misc_feature (176)..(176): n is a, c, g, or t
  misc_feature (198)..(199): n is a, c, g, or t
  misc_feature (203)..(203): n is a, c, g, or t
  misc_feature (205)..(205): n is a, c, g, or t
  misc_feature (245)..(245): n is a, c, g, or t
  misc_feature (281)..(281): n is a, c, g, or t
  misc_feature (293)..(293): n is a, c, g, or t
gtttccgcggtcgnggttnagtctnccccggctagcngcctgggttgggctttgtagctgctccgagcccagcccgggcgngctcgcagagtcctaggcggtgcgngcctcctgcctcctncctcctcngcggtcgcggcccgccggcctcccnngtgcctgccttcgctctcagngttgaggagctcaagcttgggnnaatngngtgcattccttgtatcgtcattccagttcttgctcttggntctacaaaaaattcctgggggccatatatatacccnctggtttccccntccgt

SEQ ID NO: 587886 - DNA, 1028 bp, Homo sapiens
tctcttcaccagcacaccaaccgccacttagggaaaacattaatatcctgttacaaaagtctaccttacagggtataactttacattagcagatatactattgcactatggacttcatcgctttatattcgacctgacagttcaagaaaaggagatatatcttaacgcgactcgctggttttgccacattcagcattatccatgcatcatgtcacatcttgtctagtgttgtctctcatccacgaacaaactatatagtaagttccaatacaagctgtccatgccatacagaacgtcctatttaaaatgttctaaaatggataatcggctctcccacccgcggactcatgcgaatccatatacagtcccatctttattcgttggccttacaatgaaccatccacagcctccaccttgggtctcgatcggtctatcttttttattacctcccaactgatgcacagcttactccacaaacacccaatttagcttttcacacgcgcttcctcaccccacttataaatgaacatttggcaccggagcacactaccgcgcgctacgcgctcacacagtagacaatctgtctatcaaaataacaagcgtataaggactacgcccgagccccccacccacacacatttagctagcccacatccagtctaacagaacgccctgcccaacatgacatatcaatcttcgtcctctacgtcgtccgtattcctctcatcatgtacatgtcttatacatcatcctcatgagaagtccacgacgcaccgaataatgactagtcacactccatcgcaatcacacagtctactagcctgttctgtgatagactatgtcgtgtaaacagccccattagtgacccctccgcaacgcctccccacctattacaacacaaactcgctccccgacgccagccctaccctcaataatcatgctgtaccctctgtctcacctaatcacctctctattgctatttacagacttgttaactaatctgttactatctggcccttccttgagat

SEQ ID NO: 587887 - DNA, 1667 bp, Homo sapiens
aaatgcagagattatacactaagcttccattctcagtttccttgtttcttaatgattttttctatttcctacattagtgtgcaggctctatgtgtttctagctgggcaacacccaaagtttgccctcatagtttcaggcagcttaatcaggaagaagctctgtacagcaaatctgcacacagttcgtttaggctttattgtgttattcccgcattgtgggtaactcaagagagttctatagcatattcgtattgtactatactttactgggcgtgtattccaagcgccaaagcacttgatagtgcgtacagtccgcgtaatattaatcgtatctacagcgtggacacaacgattcgtccgtgatcctcctgggaccttccttccagggccttgcacacatgcaccattcagtctatatactaccaccgccttaactataccactactatgacagaaagagtaagagggcatcactattcatcaatatcacgatagcgttatgcgtacttcaagacacatattactaggttgcacaccaagatatatggcggaacgccttgctgggtgatgcatccatggaaggatagcttagcatagctgcaacaaaagcaagaagcaccttcatatggtacatcgcccattagttgatagattgactggatcgcatacatagactaggtcgcccatagatcagggtaacactggaagcatggctaccccctgacaaccatttacgcttgggcaagcctgacgccgccctctaaccgtcagggtaaaacgaacagacagcgcaatacgacaataaagaccacgacacaaccacaccccccaaaaagtagcacacaacagaagcatcacccaagacctactagaggagacaaccaccaagaccaacggacacctacatgcggcacccacacacgcaaacggtacgcacaccccacgcaacagggaatacacaaggagcaaaggataaaaacagcacaagaaacaggggaaaacatgaaaagaaatagagcgcaaccttggcgccaagcacagccgacaagaacagagccaaagacaactagctaagagcgaacaaccccagagggccacatacccaacgaacccaggagacaaggagcacacggcatggcatacgcaggccaacatacacgagaaacattgaccccacaccctgctagcgatgtcagccaggcatggaggaaaaaggacacgagcgtcacacaaacccccaaaccgaacccagaccaactacgaacaaacacgacagcaacgacacgacggaagacacaacaagaacgagcaccacagaacgagaggacagacaacagcacgagcactcaggagaagcggaccagcgcaacatacaacagaaagaaccagctagcacaaaggacgacgaccgacgcacaaacaaccactcgaagcaccagcggcggcgcgaacaaccaaccgcaacagcaactcgcccagaaacccaacacaagcacgccacgagacatagagcgaacacagaacgaacgtcgaaagacaaccagaaagtacaacacagacacaagccaacacatcaacgcaaaccaacgcatcaccatcaatcagaccatacaaccacccgtacagaagcactgagagaaacaaagaggacgcatcacagcaacaga

SEQ ID NO: 587888 - DNA, 440 bp, Homo sapiens
cagactaagccgatcatccttgggctaagtcacccaacctctctgatcctgatggtttgtttgtttgattgatttgagatggaagactcgctgagtcaccacaaactgaagtgcagcggcatcgacctaggctcactgaaacctgtgcctcctgagtataggcgacgcatttggcttaatttgcccagtagcccttattacaggtgccttacaacataaccggctaatttttgaaaatttagtgatggcaaaaccctatgatgttccccaatttagtccctttgcaccagatccccttttgccagattagcttaatctcaaaagggcctggactaaaggcctttccaaacaatgcccacactctattggcaattgaaatttgaaggcgtaaaaatttggtattcgcgttaaatttttggttacagtatttttttacccgg

SEQ ID NO: 587889 - DNA, 163 bp, Homo sapiens
  misc_feature (14)..(14): n is a, c, g, or t
ccaccttatgccgngcggggggaccgcggcatgagctcatgacgccaacgccatgggaagatgtctcagacacaaagagtatgtgctgcatgagcagtgtcagaatgagggtatcttgaagtctgaaattgctgtgggggctttccatttctctaatggatct

SEQ ID NO: 587890 - DNA, 784 bp, Homo sapiens
caacgtcgtaatccccctagctctacaccacatgagtgtcctggacgtagggctcttagcttcatcaatgagcaatgtgtatggtcaagatcttacaccactgaagatattctatatgcctgttgatgtcaagcactttctcaagtatttccgtaagacagtggctaagtattcgaagcatccggggcggaggatcacccgccgttcttaaccagcgtcacccgtccctgtgtgaagatcccccgggactgcgatgtcggcgtgtaggctgggactgcgttgtgctgacgccaccttcctgctgaggtgggactgggccctggacactacccctcagcccctctgtcctcattgtttggcctcactgggactcgagtgggcctgtgatggtatgacggtcggatgcttgtgccctcagcttgttccatgcagcttgtctggcagtctactggctttcagagtgcttttccctcagtctcctgtgtgggactcacttctcctcctgagggcagactcgatggcgccaggacaaatagtcttggtaactcgcttacaatactgatgggtaaattatacacacgttttacaagcattctacctaatatttttcttttcacatactttttctgttctagttgtattatggtgtccgaaagctatataacgactaggacatatttttttaagaaaagtaaaaatcagtttaatgtgggaagtacgttaagtggtattatattttacattttcaagtatagtgcataaagaatctgtctaaatgtaactg

SEQ ID NO: 587891 - DNA, 322 bp, Homo sapiens
catttattcgcatattctctcccacacacaaacacacacacacacacacacacacacacgtgcatgcacacacagacacacacacacccccctataagaatcatcattttcagccaggcgcagcggctcacgcctgtcatcccaacactttgggaggctgagacaggcggatcacaaggtcaggagactgagatcatcctggctaacacagtgaaaccccatctctactaaaaatacaaaaaattagccaggcgtgatggtgggcgcctgtagtcccagctacttgggaggctgaggcaggagaatggcgtgaacccgggag

SEQ ID NO: 587892 - DNA, 322 bp, Homo sapiens
  misc_feature (134)..(134): n is a, c, g, or t
  misc_feature (179)..(179): n is a, c, g, or t
tctacaggatctcaaacaccgcactctcaatggtggatgtgacctttgctgatgtggcccagccagaccagaccggattgtggcctgaatgccacaccttcctgcgtaatggaggacacttttgtgatttccanaaaggccaactgcattgactccacagcctcagccgaggccgtgtnttgcctccgaaagtgaaacaagatgcaaacaggagaacatgaagcccgcaggtagcagttgaccccttgaggccatatcaaaagagaccatgcccggtggtccgtgggaagttgtacaggccacccccccaaggtgaaagaac

SEQ ID NO: 587893 - DNA, 401 bp, Homo sapiens
  misc_feature (188)..(188): n is a, c, g, or t
  misc_feature (194)..(194): n is a, c, g, or t
  misc_feature (225)..(225): n is a, c, g, or t
  misc_feature (241)..(241): n is a, c, g, or t
  misc_feature (249)..(249): n is a, c, g, or t
  misc_feature (319)..(319): n is a, c, g, or t
  misc_feature (356)..(356): n is a, c, g, or t
tctggagcaagctggggaaagaggggtccttagatcacgggttcaagggagggatcgggtaggggcagcatttcttcggggcgggaaacagaaggggggtttcaagagggcagaaccattccattatgggagctataagcccctagaatggctccagggcctatctcggtttccctgggatctcatcngctccngaacggcaccggtcagggcaagtccatctcnggcccccatctccccngagccaangtgagtcaggtgaacaaaattcatgggttccccaatcagggtccggtcaatccgtcttctcttcttcttnggcgggggtttctctaccacacagcagcccagttggngccaaaattcactcaggttcccagctggctcagaggggtaccgag

SEQ ID NO: 587894 - DNA, 290 bp, Homo sapiens
tgtcgaccgcaaggctggcagccatggccagaacaatgcccacgatggggacggtggacctgggaagactggctcccatctcaggtgagtgggcttcgtggagccccctcatgctgtacatggcatgtgtatctctgctcttctccagaaggcaccaccacagctgcccacttctggaaggttctacctccgtgctggtctggtctccacaatgctcaggtgtcctgacgtttggtcctcgccgatcccgcgtgccatggtcagttgtgatcttccgcaggggtagagag

SEQ ID NO: 587895 - DNA, 341 bp, Homo sapiens
tagagcatccccgatacttgcctttagatgtctttctttacacccccaaggtgcaggaaaatagctagtaagcatgagggtaatatgcattattcctatataatatgttattcttatatcaagaccattctcttggccgggcacggtggttcatgcctgtaaccccagcacttagtggggctgaggcaggtggatcacaatgggccaagagttagagaccagcctggccaacatggtgaaacccagtctctacttcaaaaacaaacaaaaacctgggcatggtggtgcatgcctgtaatcccagctacttgggaggctgaggtacgagaatcacttgaact

SEQ ID NO: 587896 - DNA, 540 bp, Homo sapiens
  misc_feature (3)..(3): n is a, c, g, or t
  misc_feature (254)..(254): n is a, c, g, or t
  misc_feature (286)..(286): n is a, c, g, or t
  misc_feature (296)..(296): n is a, c, g, or t
  misc_feature (352)..(352): n is a, c, g, or t
  misc_feature (363)..(363): n is a, c, g, or t
  misc_feature (454)..(454): n is a, c, g, or t
  misc_feature (460)..(460): n is a, c, g, or t
  misc_feature (463)..(463): n is a, c, g, or t
  misc_feature (491)..(491): n is a, c, g, or t
  misc_feature (500)..(500): n is a, c, g, or t
  misc_feature (528)..(528): n is a, c, g, or t
ttnactatattactcctttctctcatgcttgtcgtaggagcacaacgtgggttgtaccgacggcacgtaccgtgtattaggccggcccggcaatgacgttaggcggtagcgggcgtcagcagcaataagttaaacatacgtgaagcccagttatcgaatcatgagtgcattagggtaataattggcatatcgtaacttggggtaattaacgtacagtaaatacagtattcgctaatcgtaatcatggtgaaagnagtggcgcgggtcgtggaacaacagtgggtgngctaaaatcngtcttgtgtcttagtagtgttccgagagcaagtgttaaacaaattaaataaacatngaggtccgatnacgcacgtaattcatttcgcaattgttgattcgagtcggggtaccattgatagtagcagggccatacggccgaccagtaaacatgcggcgncggtgnttngacacgcatccctccgccttatcagggntaactacgngcaatcggtatcgggtaatttgttcatnagtcgcacgggc

SEQ ID NO: 587897 - DNA, 451 bp, Homo sapiens
gtaagagaagtagggtaagtagtctcagatgtaggtatagaacaggtgtcggaattggagaatgtggtacaccaatgtagatggaggggtggtgttatgtggtaccactggtgatcgctatctgtacttgggacaggcgtagaagatgaaacgctactggtaaatgatggtaacgtattagtggctgtgggccctaaaggggtggtagttgtcatcgaagtcaccgtgtatatggaggtgattgaagaagtgatggggggagtagaactcacgggtgttttgaaagatcctgtggaaatgtcagaggtaggagtcagtgtggtggtcttaggggatgtggctgttgaactggtgaatgtagtctgacctgtgcccgtagttgctacagtggatgaaggtgtttccatctttgtacatgttgtgaatgacatggtggttgtaggtcatgggc

SEQ ID NO: 587898 - DNA, 325 bp, Homo sapiens
gtgggtcgagcaaaggtcaaggtttgcttcttgttgcgatgtggctcaggctcagattgccatcgaacccggaatagggctagctagcctgtaattgtcccctgacgggagccacagatgggccacagctgacaagattcaacgggcagggccaagcccagaagaagtaggagtccatcctgtacatctcaagcaaggggttcctcccctagcacctgggcttggcagaagggccatagttcatccagctcctcccctagagcaatgctgaggagcgggggcatggtagcagggtgtctggttttaataaagttggaacacttca

SEQ ID NO: 587899 - DNA, 430 bp, Homo sapiens
gatgaggtgcaggatgagtgtcctgatttggttgacctgtctgcatgcaataaagagttcagaccattcagagaccaactgagcctcgagaatgatcacaggagaagaacaaccagtgaaatgagcatggcaagtgtggccagttgctctacaattccaccagaggtgatcaggcagaaggtgaagagacagctgaccaaacaacagaaggcggctcagaggagacgtctgcataagggggaagccaacctggtgaccaaggagaggagagagaaccagaacaacatcaagagcagtctggagaccgcttccttctggggctgaggatctattctacatactcagcctaatggagaaatgattttctcaagtgaacggttttcacttgtgtgtgtatataaaattgattaataaaacatctaaatctgca

SEQ ID NO: 587900 - DNA, 997 bp, Homo sapiens
  misc_feature (629)..(629): n is a, c, g, or t
tcaactctatataaaacgcctcatttctctctctttcacctgataaacttatcttttttaaagcccttacccctctcgggccgttgtacacatataagatttggtaattccctaaattctccacagctcatattttttctattgtcaccaaacgttttgttccgtaatggccccaatttctttcttcactagtgtgcgcgccacttttggggtttaacacacaccttgggtttcggtttcgatcatcatccggggacttttgacgaggaaaattggatcatgtctgttccctccctttctctattatagtcctgcatgtggtttctgtatctctcttggttgagattctctcacctcgagggttgttttggtgtatctgtttggggtgggccctttcgtgattagtgtgcagcgacttcgaatttttggtgactttcatttgcgagttgtgtcctaatgattttacccgtgtcatctgccttctggggtccgtgttcaagctgctcattcctctcgtatggttgatttgacgtcgaagccatcaattggagacgatactgatttgctctatttaataaggatgtctcctggcaccttcccctcgtctcatctttcggtatctcgtgtcntcattaggctatgatgatcacagcacggctccacctgttgcacttccacacaatgaacgtgctaaattcccgtatggcctctaccagaaagcagagtgctcagcatctcccacattccttactatctagcgttcgctagtaacgcatagcagcaaattaaacttgttttcttctataatagacacgacatcatgcagtttatttgtatcagtgcgacaatgcacgcctcagtacactgggctatacgtgtgatatcctgctttccttcgaatttactattagcgtctttatgtcacaaactattcctcaaaacattattttaatgactgtataatagtgccatcagttaaatatattcattacttatt

SEQ ID NO: 587901 - DNA, 233 bp, Homo sapiens
ggcgttgtgagaagcgcgggagccgagtatgggcagcggagcaggttgcaggtaacgcggtctggaacaagtagttgggagaaagttggagggcagtggagaagcccgacgggcggctggaccttacggacggttttcggggcggcagagccgagaccttggaccaaatcaagggggactgtcggcctagtcgggggctgtcggcctagtcggggctgtcgggctagtcgcgg

SEQ ID NO: 587902 - DNA, 372 bp, Homo sapiens
ggcccgagtatactctgtctggatcagaacacgtggaagtagttaattaaatagaaaagagccaggtcagttgctcacgctggtattgcaccactttgggaggccgaggtgagtgcatcacgagatcaggagtttgagaccatcctggccaacatggtgaaaccccgtctctactaaaaatacaaaaattagccgggtgtggtggcacgcacctgtagtcccagctacctgggaggctgaggcaggagaatcacttgaacacaggaggcagaggttgcagtgaacttagactgagccactgcactccagcctgggcgacagagcaagactctgtctcgagaaaaaaaaaagaaagaaagaaagaaaggaaag

SEQ ID NO: 587903 - DNA, 263 bp, Homo sapiens
ccaattttaaaacccatcccggataacccccatttacaaagggcctcccttggattagggggtataagccatctaaaaatgatttagcaaggatccaggaggatgtgcctaggttatatgcaaaaactgggcccttttatatcaggaacttgagcatttgcaaatattgggatcggaggggggtcctggaacccagcatccccggaaacttagggggggcctttcattaaggggagatccttggattcagagattggaaatga

SEQ ID NO: 587904 - DNA, 870 bp, Homo sapiens
ctcggcgcccgtgtccaccgggtcggtgtccgcgcgctcctaccgtaggatgtccggcggcccggggagaccgcgtatgttggcggaggtccgagggcggagggctatcgtgatctacgtccgagccgcgcaaccgtagctggcgtgggcatgccgcgccgttggggcccaggactcagtgggcggcttgatacggccatcgtcgcccgggcggttgtgtattgcgcacgcgctccgtcgtgctcgttgcgtccctttcaggccgcggggggggccccgggggttggcggatccttgtgggggtgctcggaggttggggatgttctcggggtggccgtgagggccgaattcaagcgacggaaagatgcagaggacacgacgcgcgggccccaatcgaaggagagcggtggcgaggctggagaggacgctgcgaaggtggaaccgggctcccggcggaaccttaacaatcggacaaaggggtggcgcctccccctggggaagcagcggcaaggagaataatcgatccttgggcgtggagacccagaagacttcgggacgacagcgtcgccaaggggcccacaggccgaaggtcgggcgccgtggggggtgacccctcatataccgaaggaggcgatgattcgggggaacgattgctcgcccggcgtggggttggacacctaggggttagagcccgaatcggaacaaaaagccaccggcgtgggatggtgggcacccgcagagtaatgctggcccgggggagatccatggcggcctcgggggagaacattgcacggatggagaatcgtctcaggatgatgagcgaacggcggataagaccgtggagactctttcaggagacggttgtgtcag

SEQ ID NO: 587905 - DNA, 1133 bp, Homo sapiens
tcttgaggtgtagagggaacaatagagcacggagtgagcgccaaatgttgatctgtcaatcgaccagatcccggggatgtgtgttttgttgtgttatctaccctgttctagtagtgatccgtgtagtgtagctgagttgtgggtggctacacactcttggggggggttctccctactcctgtgtggttgttgcacagggctccctttttttatgaagcgggtttctttctgtgtgaagcacgcgtgttttttccgagggtgctcccctctgtttggcctttctggtgcaattttgtgggggatctcccctcttgtgcattggtagacaaatgtgccgcgaccaagtttctgcgggggaaaatcttgtccctctggggggattcctgccggcttcgtgtttccggaaaaaattggggtttttagaaacatgcggatttccccagaatgttttccccctcttcttttctcagcatcaaattcccggggtttgctgcagaccgaaagcccttttgggcggggagaaacacactttttccgcctctttagacgtttcgctctcgccagttcttgtgaaagaggtaactcttggggttgaaaacgacagagagcctcattttggccccccgaacaatttctgcgtctgcgcgagagaatattttccctgtctcgctcaatatccatgggccatactacagattttgtactgttccgccgatcttgtgtcaaacaaagagggggccctcccgtggaaacagaaatatctggtcaatatacaatacatcttgttctctcaaagatccttctttgagagatgaacccccccgatggaggcgcccatatctcagggtttactcctctcttcttccaccgaggcaggttgttgaccccggctctctgtttaaacacgcggcgtgtgcgaaacacatatcgccctctcctttcttaagaaggtgtttcgtagaagaattcgggaatatcttttggccaccgggcaacgctcccccaccacccacgtgcacattggcacgcggcggcgcagcattcttttgtcgggacacttcttcttaagggggtatactatttgtgggaaaattacaaatcgcgaagacattaacagcccacaaaagacagaa

SEQ ID NO: 587906 - DNA, 208 bp, Homo sapiens
  misc_feature (185)..(185): n is a, c, g, or t
ccagtacggcgatcaggactttcagatggaggagaagagagcgcattgtcattactctgctttgggagcgtcggtggcacatgcagccttgccggccgcatatttaaggcttgcgccaaccagcgcgtcgaagtgcttgagcgcctcggagccgatcagcagcggaaactggaaggcgcttcggncggtgaggttcccttcgatgggg

SEQ ID NO: 587907 - DNA, 660 bp, Homo sapiens
gggtgtggtggctcatgcctgtaattccagcactttgggaggctgaggcaggtggatcatctgaggtcaagagtttgagaccagcctgatcaacatggtgaaaccccgtctctactaaaaacataaaaattagccgggcatggtggcagatgcctgtaatcccagctacttgagaggctgaggcaggagaattgcttgaatccaggaggcagaggttgcagtgagccgagactgcaccattgcactccagcccggctgacagagtgagactctgtctcaaaaaaaaaaaaggaatataaaatgttgctcctaatgtctgctgctttaggtggaagaaatatcccaccacacagaaaagagatgcttagcaaacaccccctaccttctggagcattttagaagactctgacatcaccccagacatttgagtccgcagctgtgaaaggcttcctgcactgtacagtgagaaattgctttatgctcattatctcacttcataagaaagtctgagaacacatacgagcacaacttcgggcatcgccatgatgatcactcgagttgaaagactcttgaaacgcagcgcactagtatctgaaggctcatagtacacataacatgccggctaaatttggcggctttcactggtcttcgatcccctcg

SEQ ID NO: 587908 - DNA, 122 bp, Homo sapiens
tgctggcaaactatggatgcggggactgagcatggagccttggcacgtggcgcatactgtgtaatgggatggtgtctctgtggctggaggaaatgaggaggtcctgggggtggtggctgctg

SEQ ID NO: 587909 - DNA, 487 bp, Homo sapiens
  misc_feature (195)..(195): n is a, c, g, or t
  misc_feature (253)..(254): n is a, c, g, or t
  misc_feature (294)..(294): n is a, c, g, or t
  misc_feature (300)..(300): n is a, c, g, or t
  misc_feature (423)..(423): n is a, c, g, or t
attcatttcactctcttatttagggcaattcagttctctccagggctgtcttatcacaatcaattccaggcccagctttagataacctaaacccagtagaggtcctgagattgcagactatcctcaaacaccttcaacaactccctatagcatatcagactgaatacatgttactcaaaacaaaccataatgacnccaacccattccttctgtgctaagaggcgagaaaagctcaagtcaaatggggctggtnntaagctatctgagctccttggaactcatgcctagcaacantaaggncagtacttggcaaatatttctttaattgaaatgacaaaaaagtgagggaagatgagaaagaagaggcaaagataatttaaaacccaaaccagtaatgtaagaatatttgtaagctggtatggngtgcaaacttacaaccctgcctcgtcttactgtccagagtctcaagtatacaatatgagaaact

SEQ ID NO: 587910 - DNA, 221 bp, Homo sapiens
  misc_feature (204)..(204): n is a, c, g, or t
  misc_feature (209)..(209): n is a, c, g, or t
tgtggggttgcgtgcccgggaagctgccctcgccagggaagggtgcgcagcgggacttcgggaagccaggtgacaaggagaaatggcgatgcctcgcccgacggcaggaggagggtgcaccgttgccactttaacggctgcaggaaaagtttacacgaaaagctcccacgtgaaagcacaccagcggacgcacacaggtcagtncccangcgggccccgga

SEQ ID NO: 587911 - DNA, 150 bp, Homo sapiens
ctgctggctgttgagtgagcggagactgagactacacagagtgtgtgtgacagagtttgggacctgaggtggagcccgagtttgggaccaaggtggagcccgagtttgagacccagttggagcctgagttttgagacccagctggaaccc

SEQ ID NO: 587912 - DNA, 1473 bp, Homo sapiens
taaacgtaatgccttctcctcactctctcaatacttcatccatcatagcaggcagttcgaggtggattaacagcaaagcgccagcctacgcaaacatcttaggcactactcctcaacttgagcccacactaggcatgacataccatagacacgttgctaccggtaccaagccctagacataaccattctgaatttcacctactttatagttagtccgtagagctgactaccgcgatgtcctactgactcaacttacagctccaggaccacgacccgtactacgtatctcgcaccctgaaacaccgcctaacagtgactgacacaccactctcagattccaatccatcgcctacactctccacactaagagtagggccgtgggctcacccgtcgttaacccggacttaattgccacaaacatggcgccacttatcgtaacgaattacacaccacaacatcaatacgcctgcaatcaatcccgcaaacatccactacgcccacccactgccacccttgcccttcacaactctgactctcgtaatcctgaacgcctaaagtctaacttccaaccatcaagtcagcgacctaacattgcagccccactatactgctaaaaacagagcggtgacgaaaaatgacagatcagtggagcagggttacgtcaaccattaatgcaaagagagcacgcagccgctcgcaatgtacgcttagccacgctaacaacttgcgattcccgaacgcatttctcgaagtgtacttcactttccccgttaacccgcgttcacttccattcgccccccacagtgtgcgacactttagccgtcaaaccgttacacagtacgttttacgtatgcaccccaacaccgccaccacacggaccgcgagcaactatctgggacctgcacacaacacagaaggacaaaccaggaaacaagagcaaacgcacacatcacgacgctgagggcgtagcgctcacccgccacacacatacggactacccccgcaacgcagggcgacggaccagcccacatcacccctcccgacacgcgcaccccacaaacaaaagatacagagcttaggcaacacgaacgagccgcgcccccaaccgcacaacatacaccccgcgcgtacaacattcaaccaatccccacagagcaacacccatcgatcgcacaccgcacaaacaacaccaaaactgccacaacacagacggtacaagacacacacacgcacacacaagaccaccgaacccaccggacggcgcacaaccagaccctaaccaaacaacggccggcggacggaccacatacaagaccacacatacccatcccggcaagcaagacacaacacacccaccaatccaccgcacccaccacaccacacaaccaagcccgcataccaacggccagtacaagacacaccaaaatcaaacgcgctcacgaaaccaaccacacaccccgcacacgtcccacc

SEQ ID NO: 587913 - DNA, 338 bp, Homo sapiens
gaggctaaagtgaatctcgagttaactagcatatagttgcatctttaaaaaaatcatgcctgggctcgttggctcacgcctgtaatcccagtactttgggaggccaagtcaggcggatcacctgaggtcaggggttcgagactagcctggccaacatggtgaatactgtctctactaaaaatacaaaaagtagccaggcgtcgtggtgcactcctgtagtcgcagctacttgggaggctgaggcaggagaatcgcttgaacctgggaggcagaggttgaagtgagccgagatcgcaccactgcactccagcctgggcgacagagtgagactccatctc

SEQ ID NO: 587914 - DNA, 388 bp, Homo sapiens
ctggccacagtgagactagattcacctccccatcacccttgcaggtcaggccatgcttctaggtagtgttcttttcctcaatgacatgagtgttccccagggcaacttctggatagcagcttcagactcagacataacctttcaatgtttcatctgtggggatcctgtttcttttctgttggccttagtctcccaaactcaccatgcttgtgcccttccaagggtctcattaacctgtgcctctggatccagtgtggtaccttgtgcatggctagtatacaacaaggtacagtgggggcaaatggctgggcaggcaggtaactggagaagtactgtagtccctcaaagtgcctcgctgcagagccctttgggactgagccttctctag

SEQ ID NO: 587915 - DNA, 174 bp, Homo sapiens
actacatacttccgctgggtcttctgctgggctggtgctgaagtgatcgttgaagggcagggctcaggcgccttgggctggcagggctctggaatcttggggcatggctgcagactgttctttataccaagggtccaagtctcgatgcttcttctttattcggaagtatgtagt

SEQ ID NO: 587916 - DNA, 948 bp, Homo sapiens
agcggggctaccagctcggcctgtgcggcgtggatctcggtggccgcacggagcgggaggcctgggctgccatggcgagtggcccccgcagccccggctgcggcccagaggcgccctgggaactgccctgcagcgcccggtgctgacgctagcaagactagccaccgccggcagcccagagacgtggtgagtctcccagcacgtagcctggcagctcctgagttctcatcaacgtctgtactgatctatcctagatggccattccagctgacgcagggccgacgacaagggctagccgccgccaggtcgctcagtcaagcagaatgtgcaagtagtaggatctgcgactgaaagccactcatagagagaccagtgatcaaccagtaggaacgtgaccacaacgtgaagacatggggctttcaaaaacgcttggaagcgaacgggtgcattgcaggacaagctaggataggggatttgcccaatcgcagaggcacaaaggaatgcttcggggtagcgttcggggcgcccggcgggtctggccccggacttgtgcaggatctcggccattgggtattgtacgcaatggacacaatggcctttccacgatacagcgggcttagaagaggcgtagacatacaccgcgcagcagaaggacaccccggccaggggcaggttgcaaagcgagaaccggtcgccccacggtaccatggggccccaggagggcgaacaccaagaggcgggggaagccacggggacagggacccggcgccggggagccccggggaaggggccgcccacagcaacgggccaaggcgagcgcggaacccccaagcaaatcgccggcggagccagagaccaggacgaagacacacaaccggaagggactaccccatacacgccggcctgcgaaggaccggagggaaccgtgaccacttccaaagcgcaacc

SEQ ID NO: 587917 - DNA, 275 bp, Homo sapiens
tttttccccccttaactaattaaaaggcaaattttttaaaacggattcccttccttggaaaccctattttcattaaagataatttggataaaaaggggaataaaaaacagggtatggtctcgggaaactttttaaaagggcatttttttcattggggggatcagggacccaggccccttaattttttcgggactgggatttggccttttaaagggggttgaagattttaacaaatggggtttgaacggagggcggcctttttccctcccccccca

SEQ ID NO: 587918 - DNA, 672 bp, Homo sapiens
gccccccttttttttttgtttttacttgttttaaaaaagtgactttgctttattactattggcaggtggggcctgcattgaggtgtggtttagtgtgtgtgcctcaggggatgtgggtgtgggctgtgtgtggaaattgattgacaaaaaggcttgagaaggaaagggggtgtgggtttagaaggccagggccaaggggctccctcaggttccgctttctgtgggaagggacagcctttgaggaaggagtctcagtggcaagaccattatctataggccaccaaattcagatttaaaaaatttcttgagaaaattcttagcttgaccattcagcgtgttggggtgtctccagttttctttcattcatgtggcggctcagggaaccaccagggtctcctctcgtggttctcttgtggtgaagggccagcttaagtttcgtggtttctcatgtgaagcttaaagagaacctctctgtgttcttgtggaagaagagtgtgttcgtttattaacccatctccttttttacaggacattacttctctgtggaaaacagggcaatctccggggacctcttgatgtgcaccccgtctctcaggtcttcgtgtataggggccttggcgaaatttttgtgtgcccccgtgaacgccgttgtggggccactatagttctcat

SEQ ID NO: 587919 - DNA, 737 bp, Homo sapiens
  misc_feature (6)..(6): n is a, c, g, or t
  misc_feature (12)..(12): n is a, c, g, or t
  misc_feature (22)..(22): n is a, c, g, or t
  misc_feature (26)..(26): n is a, c, g, or t
  misc_feature (42)..(42): n is a, c, g, or t
  misc_feature (50)..(50): n is a, c, g, or t
  misc_feature (61)..(61): n is a, c, g, or t
  misc_feature (80)..(80): n is a, c, g, or t
  misc_feature (86)..(86): n is a, c, g, or t
  misc_feature (99)..(99): n is a, c, g, or t
  misc_feature (111)..(112): n is a, c, g, or t
  misc_feature (125)..(125): n is a, c, g, or t
  misc_feature (127)..(127): n is a, c, g, or t
  misc_feature (135)..(135): n is a, c, g, or t
  misc_feature (153)..(153): n is a, c, g, or t
  misc_feature (178)..(178): n is a, c, g, or t
  misc_feature (189)..(189): n is a, c, g, or t
  misc_feature (194)..(194): n is a, c, g, or t
  misc_feature (198)..(198): n is a, c, g, or t
  misc_feature (211)..(211): n is a, c, g, or t
  misc_feature (216)..(216): n is a, c, g, or t
  misc_feature (219)..(219): n is a, c, g, or t
  misc_feature (228)..(228): n is a, c, g, or t
  misc_feature (235)..(235): n is a, c, g, or t
  misc_feature (238)..(238): n is a, c, g, or t
  misc_feature (249)..(249): n is a, c, g, or t
  misc_feature (253)..(253): n is a, c, g, or t
  misc_feature (259)..(259): n is a, c, g, or t
  misc_feature (262)..(262): n is a, c, g, or t
  misc_feature (270)..(270): n is a, c, g, or t
  misc_feature (275)..(275): n is a, c, g, or t
  misc_feature (286)..(286): n is a, c, g, or t
  misc_feature (292)..(292): n is a, c, g, or t
  misc_feature (295)..(295): n is a, c, g, or t
  misc_feature (303)..(303): n is a, c, g, or t
  misc_feature (316)..(316): n is a, c, g, or t
  misc_feature (330)..(330): n is a, c, g, or t
  misc_feature (333)..(333): n is a, c, g, or t
  misc_feature (354)..(354): n is a, c, g, or t
  misc_feature (405)..(405): n is a, c, g, or t
  misc_feature (433)..(433): n is a, c, g, or t
  misc_feature (442)..(442): n is a, c, g, or t
  misc_feature (503)..(503): n is a, c, g, or t
  misc_feature (566)..(566): n is a, c, g, or t
  misc_feature (639)..(639): n is a, c, g, or t
  misc_feature (660)..(660): n is a, c, g, or t
  misc_feature (697)..(697): n is a, c, g, or t
tcactncctttntaatcaggtntttnttcaaaaaaagctttncaaaattnttttacctttntggaataatcaaatttaanattttntgcagcaggcttnttctcctctttnntaggtttcttctntncaggcttnttttcaggggctggtttnttggtagctgctgccttttttcccnccagaggcttnttctncttnttaacaccaacancagcnttntttcctttnttacctnccncaggctttttncctncaaccnccnccttctcntcttntttggcttttngtcccnctnctgcagcngctgccttttccncccggagctttttnttnctggcctggcgaagaatggtnttccggcgcatggtctttgcatatgggtttagcttcaacatgattttcaantttttcagtgggttcttctttaggactntgcgatggntcttcttgcgtggtgctcgaagggctctttggatctctgggcttttcaagattctgctaanatctgtattaatcatcttgtgcatgggaagattgtagttactcttgagggaagcggctttacnccaagtgccgtacaattcatctaacttccggaaagcactttcagtccaaatgcagaaacgtcccacatgcccnccaggagcaagcttcaaaatnttcagcttgcttacattaagcagagtaattccagggntgtttctgaaggccttgatgataccattatcctcattata

SEQ ID NO: 587920 - DNA, 926 bp, Homo sapiens
  misc_feature (139)..(139): n is a, c, g, or t
tcacggggcaccaaggtgggtttaaagggcattcaacacccagggaggttcacacgttcagtctcgtggtgtgggcaacgtctcataggggtgtgaggggctgtggtggccctccagtttcggccccacagcctttggnagaaacgtgggctgtgccgcgggtgcaaccagcgtttcccgcccgcgccccagagtgtgaaaacaacaccactataacacgaagtggccacgtgcacgagaacgagaaccccaaagaagccgccgcggcctctcccaacaaccaccgcgagcggggccgtgctcgagagagttcaaaaccgagggccttgtgagggcggcgtccactctgcgggggggtggcgccccagggagagcctgtgcccgcccagagagaaactcagcgggtataactcccaaaagtggtgacaccacgaggtgtccacaattacaccaacagcggggggtcctcgtgggacagaggctcaaaccatcccggtggggagcgcctctatcacagagagacactgtgaggctccctccatccgagtggcggcctctcctccctgcgagagagaaatacgcggggacacagctttgggcgcccccgggggacacataacaccgcccgtgggtgaataagagaatgagggagaggagcgcacaaacactgcgcgggaacaggcgcaaaaggtgtgtcgacataagagggcacataataaggagggggcaacacacgtcgtgctggaaaaccaacggaccaaccacaccactccgatgagaacggaccacaaacgaagagagggggacacacccgtgcaaagagaaaccccggaaagcggggtggcgccccatcccctctatgcagcaagccacgtggcagaggccacgggagtcccatgtacggggccccctggtactaccacaca

SEQ ID NO: 587921 - DNA, 844 bp, Homo sapiens
gcacgctaaaggagcattctcagatacctgtatggcatccagacacattcactttcaactttaataatgaccctttggtccttcgacggcgccagacctacttgtgcctatgaggtggagcgcctggaacaactggcacctgggtcctgatggaccagcccactgggctttgctatgcaacgaggcgtaagaatctgtctctgttggctgtatgtacggccgccgatgcggagctgcgctgtctggacctggttccttctttgcagttggacccggcccgagatctacagggtcactgtggctgcatcttcactggtagcccctgcttcgtcctaggtggcgtagtgccgggagaagttgcgtgcgtaccttcagtgagaacacataacgtgagacatgcgcatcgttcgctgccggccatctatgattacgaccccctatatagaggaggcgctgcaaattgctggcgggatgctaggggccgcaatgatctccgagtcatagaaccataacgatcgaagtaagaagtacgtgctgaggagcaccctttgtggtaccgcacagggatgtcgccttccagccctgggatggactagaggagcacagccaaggccctgagtgggaggctgcagggccatttctccaggaactcagggaaacctgaaggatgggccttcagatctctagaggcaggcagagaccttgggtcgagcagcagacataaacaggatcttcttccaagaaagtgctatacagaccggttcacatcatctccagcatgttcacaagaagtcagcaagagcaatgtgctcctggatccagtaggatttttacaaaatccaga

SEQ ID NO: 587922 - DNA, 1174 bp, Homo sapiens
cgggcgcaaaaaatgtggttcggacctgtgctttctgggcggcttaccctaacaacgttatgcaacccgcacatggctctggctccccggttggcttcccctttcatccggagagagtgtttccgctaccgctgcggcgccaggaccgggcctttatactggcgttgctcgctcggtgtctacgatggtcgtcctccggcccggaggcaccactgagcctgggtcccactataccggctttcccagggccgatgaccgcaattcaagagcctctcgtgaccctggggactgttctgaagacaaggcctcgtgggataacgtaatccggacctgtcagccgctgagatgctgacacgtcacaattggcttttcattctatgagaagaattatgtgtcgtgcttgggaggggtgacagggcggttcctacggagaggatggggctgcccaccccggcactgacccaggtagaagctgctgatcaccagaggcttggaggccaacaaactacagctgcaagagaagcagacattcccggccgtgcaaacgcggagtggagctcagccaggggcagccggctctggtgctccctagaagagtggtaggtgtcgagcagaagactggactcggcgtccccaggaagctgtataaagccaggtgctaaggagccccgcggcgctgtgtcgtgagaaccaccggccaccctagtggtccagatgcctggacaaccctccatcacagaaatacgtggggaccatggaccacccaaatcttggtcagagatacacaggctgcaccaccgctagccatacacaggctcctttccactctaatgccgtgagctctcttctcgtataataacacacagagagctacttgccaagacaccatgagtaggctccttgacacttagtgctgccctgggatgcctgcactggcgcgaatgcaggaggttgctgcgaaggaactctggctatattcatgcaaatgtggcctcatgcaccttaccgtggctcggcgttgtggtgcctgagggacagccggccacatgcccagtaatggtcagcttatcaacactagttccctttcgacctactggccatcttcctcacagccctcagatatacaacggccacaaataagaccaatctcatataacccgagtgacaacctcaa

SEQ ID NO: 587923 - DNA, 925 bp, Homo sapiens
  misc_feature (291)..(291): n is a, c, g, or t
ggccggctgcccttccggaaggatgttgtccctttcatcagtaagggcctgcggtccaatgtcctcttgtctttagatgacgacccccgtagaaggacagcttcagggcccggagtactagtctcaacgagagagccaagagcaggatacagacgtccctcaccagtgccagcgttggaggtctgcagatgagaactccgtgggccaggctgacgatagcctgtaaaaagctccacctggagctcacggaaatcctgtctggacatgatggctcgatacagtcttctccanagttcagcggctgtcccgaagaggtctcctgtggtgcagagttcctcctagcgggtggcaggaccaaaaccgtggctggtagggaacaagcttgtcactgtgacgacaaggcgtgggaaccgggagccggtcgtcactaggcctggagctcgggggagcatgaaggccgggcccggagatcgagctccagccccggggtgcatgtgagacagaacaaggaggcgccggacaagcgtggagtcccgggctgggcaagcaggtgtcccgtggggcccgggatcgggtccagttccatgtcggggggccatggtcttcgagttggcgccctggacgtgccgtgctcccagttcctgggcagtgccgcttctccaggaccacggactggaccagacgcgaaacctgagaaggtctcacgctggcaccgggttcctgtgcaggagaagacgaaccaggcgagctatgtggccctgctgaaccagggcttgggcggagatccctggaccggaggcccacagggaacaccagtgagctgattgaagctggagaaccggtcaagcctttctcctaggacttcaacaaattcccctgcaggagctgctaacggcctcatgggggtgacgctaaggaggacgga

SEQ ID NO: 587924 - DNA, 401 bp, Homo sapiens
ataatcaagggcaaagctttgagtgcccagaagggaaagctgtaccagttggtaacctgtcttgtttcaggagccaccatgtttttttctcagtgttaaccacaatcatgataattaactccaaactctagtttgttcacttgtaggactgcagttttgaattttgggtcaaaggttttgggggccgtaagaatgtgtatttgaatgtattttgaattgtcagagcgaaagagcgttcccgcccaattttttttcatttttttggcatgatcttcaggtttctactaatagggtaattgtaaattttttgcattagcatttattggtgaatactgccatatatccccattccaagggatataagtgagtgaagttgaaataaaatctttaaaatttactat

SEQ ID NO: 587925 - DNA, 1438 bp, Homo sapiens
ctccagaatcaagtgatgagggaaacgtgtactgattgctaccgcaatgagctaactagtacttcgcgtcgagaattgactatcaattactgtgaagtgagttctctactagagagaagttgctatctattgcggacgtcgtgacactctagtacgatcatgggctatattcccacttgctcatatgcaaattgcgacttacataacctttgataagtcgttatccatagtcgcactaccacgtatttctctgggggcagtgcatggcaagacgcgtgcggtctggagcctatggcacatcatgtggtctgcacctagtggcaacaggactaatgaactgaaagtgtcctggtcacgagtgaagcgcatacatgttacctcagagaatgcatacacataccctcatgtccgcgctcctaagtaacccttactaagtttccccttaccccaactcgtggcaatcgaatgtttcaacaaacttgaaacacaaccaattcatagtttaggaacaattcatatggaacatttgctaacggcccagcaaggacctgagagtgtaactcaaggtgagtctactccccactctctttacattatttttatgcacaatttctaaagattcgaaacctagacaaaaccccatattctccacttttctggttagtcccactcctacgctcttgtaacactacgcgcagctctccctaatgaaaggacaacaacgcgctattcttccatgatatcttacataacttattatgcggcaaggaacgtcttgcaacccttttaattcacaaaacatgcgaagggtttcaaaagaacccggttacggtggcaagcctatgagttgctcatgtgttgttgccgacgctgttactttctcgggttatataacctaaacagggacccttcccgtgcgggcaagtgacactccaattgtctcactgtcaccaaatagtacctccacgttgacaggtgaaagaaaacgcataacacagcaaggccccaaggttcgttaggtctcacccaataggaaggtccggcaaggatcttctgttcccttccttgacgataccttaccataggttatgatcaccgccggtcacctttggcgcctaaacttgggatacttgggcgcgggactttgacagtagttaccactttgcgccacgattgagcagagcaattgaaaactggctaagtgcctggcattttggtgtgccactggttgtgatcaacaccggtgcgtatgaccatgcgcgcctttgacaatcgccccaaccagaaagcattacatgcggcctaccaagagtgttgtgggagcattccaaatacccttggacacaattagtgccgattctatggatgagtataaacttttacccttattctcaatcttccacaccacaggtatcagagacaatacttataaactacc

SEQ ID NO: 587926 - DNA, 202 bp, Homo sapiens
tttttttaaccccccccctttgggggaaaaaaaaggggggggcccggtttttaaaagggggctttttttccccccccccgggaggggggttttaaaccaaccaaatgcccgtttttaaaagacctttccaatttttttaaaaaaggggggggcctccgggtaaaagtttttttataggtttaataaaaaccccggcccttta

SEQ ID NO: 587927 - DNA, 188 bp, Homo sapiens
gtggacagttagctagaaagtcagcgaaactactcagccagaataccaccgctccacagttctcataatctacaagatctcctctcctcccaagcagtaagctcccttcctccttccaggattcaattactccatgccctctttataaaaaatcccaaattcagtcttaccagaagtgcgcctgggtg

SEQ ID NO: 587928 - DNA, 926 bp, Homo sapiens
gggcgctgtcatggcgggagtgctgaagaagaccactggcctctgtgggcattcggctgtgtgcaatactcctcaagcgagaggctaagtaatattgtacacaaatgcatctcttggtatgtccttgaggaaatccctaaaaatgcagtcgatgatagaaagtatacatgagacagattacaagatgaggaagctggcggtatggttaaagctggaatcagatgttaaaataattgagaagacccaatcttcaaggcggtgcaattagaagaggtggattcttcaggctgaacatgaactaaatctggcaagaataatgagggaatggaaactatgggagccgattagtgaagagctctccgtgacagatcagtggaaatgtgcagatataattattaacgtgacttgggggtgtgcaggggaaactgatgtactttatgatattctgtaatattaagagcgtgttcttattactgagatttgtaatcaaagacaagtgatatagaagaatatgtaggagacttgtaaaaatggtgatgatggtaatatggtcatgtgaatcaatttcgatcataccgtactcacagcaagtgtaatcagagatgattatcgtgaagcagagaggccatgggaacgatttcgatccactacttaactgaacacaatccttactgattttcactgcggagagccaataatcgacaaagtagcatatctgtaatacgttcaggtccgtcccatcagtaactgtgcaaagtcatcctgaaaaaggaaggtccttatattttggctacaactcatgatgcggtgagactcacagtgaattccatggattaatgaacaggtggaacatggatatgtacccagagctctgataaggaacagattatgaacccagtacctacaaaaccaacaaaaaaaaaaga

SEQ ID NO: 587929 - DNA, 457 bp, Homo sapiens
atgcccgactaaaaatacaaaaattagctgggcatggtggcgggtgcctgtaatcccagctactcggctcactgcaacccccacctcccaggttcaagcgattctcctgtttcagcctcctgagcagctgggattgcaggcacgacaggggctcacacctttgatcccagcactttggaggccgatgcaggcggatcacatgaggtcaggagttcaagaccaacctggccaatatggtgaaaccccgtctctactaaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccg

SEQ ID NO: 587930 - DNA, 563 bp, Homo sapiens
ataattttttattttctattatatataatcaataaaataacgcgggaaaaaaataataaaacaccgtaattctataaaaaacaaaaaaaaaaaataatcaccactcaagaaaaaaaaacaaaaaaaaacctcaaaactatcagagaatagtacaaatttcaattaccacctacaaaataattctaaaaaaccgacaaaaaaaaaaaagcaacaatccaggaaaaaaaaaaagccaaccaaaacacaaacactgacaaacacaacaaaacaaagccctttgccataaaaaaataccaaaacaaaaccataacaaaatacaaactaaatcatcatctcatatcaaaataacccttatgaattatacactaaaaaataaataaaatatattcgccgaacaaccacaaaataacaacgacaataactccgtcaaaacaaacacccattaacaataaaataaaacacaccatctaactaaaacaaaaccaaaaaccagggcatatatacataaacaaatccatcacaaaatggaaattcctaattccaaaaaacaaacaccctcaacc

SEQ ID NO: 587931 - DNA, 83 bp, Homo sapiens
  misc_feature (19)..(19): n is a, c, g, or t
  misc_feature (32)..(32): n is a, c, g, or t
atcaactggatggcggatntgagcctcagagnatcaccggctcctgcggcctgatgcaactaccgctacttcctggaggagac

SEQ ID NO: 587932 - DNA, 265 bp, Homo sapiens
tcagtcggtagcacttcagtgacaggagaggcacagggagaggggtcacaaggatgctactcgggcacctagaagccacagcatgccctccacagagcggactgaccatgcgcaggaatgtcttcgaacttgtaccatgtccttcctgaagcagtagagcagcccgtagttcttgagcagtgcgtcatggttgtgcgagtttgtgtcaaacttgctgtaggtctgcttgaggatctgcccagaccggcggcatgcccagtcttcc

SEQ ID NO: 587933 - DNA, 316 bp, Homo sapiens
ttttaaaatttaagattatagttgatggctggggctgtgtcacgcccataatcccataatcccagcactttgggaggccgaggtgggtggatcacttgagatcaggagttcaagaccagcctggccgtcatgatgaaacccgtctctactaaaaatacaaaaaaaaaaaaattagccaggcgtggtggcaggcacctgtaatcccagttatttggggtgctgaaggagaactgcttgaacccggggggcagaggttgcagtgaactgagatcatgccactgcactccatcctggacaagagagtgagactccatct

SEQ ID NO: 587934 - DNA, 216 bp, Homo sapiens
acaccgtagcagccgggatggtctcgatctcctgacctcgtgatccgcccgcctcggccgtcccaaagtgcgtgggactacaggcgtgagccaccgagcccggccaacctagtttcttctaagattataaattaatttttaaaagtgctaataagtgaattcttttaaaaattagtatcacaaatgttctcatgcatgctcgagagtcacaagaat

SEQ ID NO: 587935 - DNA, 975 bp, Homo sapiens
gcacaatgatgatcaagaaaatcagatagaagaacaggcacaaagcaagagcaatatttactgatgcgtactcctgtttgtctttctacaggaggtacaactaatggttgttttcacccgaatttttggtatggtgggatattttcgtaggggtgggttctccccccccaacgaatttggtgggcaccagacaaattttgttttcaaccgccgagtatggcaggttttcacgtcataaacggtgttcccaggacggctattgtaatcttggtgccaagcgccgcctaagttcttcttgccgccccaccagcaggagagagtgtttgtaggaaaaacagaattcaaccgaggtggtgtattcatccgagggcaaagccacaattatgtcagggaccttaccccttatattacatgggggctcaccaaacacgcacgaacctgttgctgtcttggttgaacacccacttgtggcatggaggtctctatcatcaacacccaattatgcgagggccgctgccggcaacagccaatcccgctgcggtagcgagtttgttaactcatgagacgaccataccctggggcgatcgccacaacaggacccatctaaatgggccactctggggtccacgcacaaaaggcgtagaacaactggcccctcgtgggaagcccccaccttcgttggtgtagcctccagacaggtcagcttcccccgatccaaccgggccccttctgcggcgcaccacacattgtgtgttctggctgcccacacaccactgactttcatcaacatggggggtggtaactcagcaccctcacctcccagacgtcacgccactctctccccccgctcacacgaggtgttgtatctcattcagttcatctttgaagatgacatcttgcgtccaaaacaagacctccttcaattagaatattgggcacccccatccccctctaaagaaaaaaaacaaacccaca

SEQ ID NO: 587936 - DNA, 196 bp, Homo sapiens
  misc_feature (25)..(25): n is a, c, g, or t
  misc_feature (184)..(184): n is a, c, g, or t
ccaatctcctccttccagcccttgnagaccacgttctactcctcgtttctacgagtttggctattttaatacctcatctaagtggaattgtgctgcatttgtccttctgtgaccggctcacctcaccgtagcgtgctgttctccaggttcatccatgttatcctgttcagcaggatttccttcntctcctgaaggc

SEQ ID NO: 587937 - DNA, 260 bp, Homo sapiens
tacccgttctcgactatcagggacgcttggagatggggatggatagttcatcaaagcttctaagcggcatcacgggggtgggaagattgtacctgatagattcgatgggagaagtggcaaggtgatcagggacccgagtgcgtgctgagctgatccaggctttggaatccgtttccgaggatcgcgccatcaaggcgctcgtgttgactggcgcagggaaggggttctgcgcaggcggggatatctcgggcatgcagcgt

SEQ ID NO: 587938 - DNA, 459 bp, Homo sapiens
  misc_feature (9)..(9): n is a, c, g, or t
  misc_feature (38)..(38): n is a, c, g, or t
  misc_feature (80)..(80): n is a, c, g, or t
  misc_feature (85)..(85): n is a, c, g, or t
  misc_feature (130)..(130): n is a, c, g, or t
ccccccggnctaaaagaaacccctggccccttaggccnccccctaaagcacctgtgattaccagatggtaaagcctaacnggggncccaagcccccccaatttaaaaaatggttccctatattttccccnacactttttaccaatggatccatatattcccttttataatcaaagtaaaagaatagtttttttaaaatgataatagaggttgccctatggtggtgtgcgctttagtccccagctacatgggaggctgaggtgagaggattgcttgagccaaaggacttgagtctagccctggacaacataatgagaccctatctctaaaaaaacaaaacccagaccaggcacagtggctcattcctgtaatcccagcactttgggaggacaaggtgggaggattgcttgagccctggagtttgagaccagcttggacaacataaaaaaaccctgtctct

SEQ ID NO: 587939 - DNA, 312 bp, Homo sapiens
agcgacatggcccagtcccaaggcgcaagggccacttgtgtcagcagtgtgcaccagcagcgtgcgccggcaagatagcagaagcatgaaaagggccggccagaagacacctactctggctggaagacacgtacccctgaagatcaagaaagaagctatctgggaacaatgtagcagttacgtcagaccaggacacttcctgtttacaggagactataaaacctttgtcctatcatcacttgatgtggacgccattttaggcctcagcccgcctgcacccaggcactgattaaaacagcatgttgctcccca

SEQ ID NO: 587940 - DNA, 349 bp, Homo sapiens
  misc_feature (263)..(263): n is a, c, g, or t
  misc_feature (265)..(265): n is a, c, g, or t
ctgtacctcaacctctgtgtactcaggcactagccttgggctcgggagacagcaacagagcagggtgttggaaaaatgcagggacaggtatgagcaccgcagacctcgcaggcccctagcacaggagagagaaagacaggcaggtagccagggggactagcccctgtggatactggggggcttgaaattgtccccgtggtatcttaatttcctttccccagcacagggtggacttagaaagcaggggctacaagagggaatcnantaaggtactggaggtgggagcaggagattgagaaggagagaaagtgggtgagatgatggagaagaaaggagaggagagaggcag

SEQ ID NO: 587941 - DNA, 153 bp, Homo sapiens
tttgccagcacttgccaggcaggcaatgcatgtccagcagtattaaatggggcagcccagcagcaagccccgggtctgggcttctccgctctcaagtccatgttttctctctagggccacgtggggagccctgcgagatgggcctcaatatag

SEQ ID NO: 587942 - DNA, 513 bp, Homo sapiens
ctgagcacgccatccctgagcagagtggcgatgaggacgaagcaggagcctgacaaggcgcatctcgatctgctcttctgacataacgaattgcctgtgaggaagagttctccgattctgaagaggacggagagggggaccgcaatgaactcttccaacttcaaaaaagccaagagagtcaaaacagaggatgaaaaagagaaagacccagaggagaagaaagaagtcaccgaagaggagaaaaccaaggaggagacgccagaagccaaaggggtcaaggaggaggtcaagttgggctgaatggacctctccagctctggctgccggctgagtccctcacgtttcttccctaacccctcagatgatatattttctatttctctgtgtattgatatgaaagtttattaaatataattatccccagggacagaaaccaaggccccgagctcagggcagttgtgttgggtgagctctactaggagctagcttgcatccattctacgcgtctaactt

SEQ ID NO: 587943 - DNA, 601 bp, Homo sapiens
  misc_feature (18)..(18): n is a, c, g, or t
  misc_feature (34)..(34): n is a, c, g, or t
  misc_feature (36)..(36): n is a, c, g, or t
  misc_feature (45)..(45): n is a, c, g, or t
  misc_feature (66)..(66): n is a, c, g, or t
  misc_feature (73)..(73): n is a, c, g, or t
gaagaaccttccgcttgncatatcccagggatcntnagctacatnctcgaaagctcggaagctttnatatggnagccaggcgtagcccacacagtcggcataaggcgtcaagacggcacgctcagcggcccatggacggccacaaggatcagcgactaccaccttaggatccctacgctcgacttcgtccctgatacaagctgggatcgagagccgccccacctgctgttcggcccggtagccagggaatgccaccgcgtcctgatcagcaaagtaaccccgaaaggaagcgaaagcgtttcggttcaaggcctcaactatgacgacagggtttacctgtacgacaacgctactgcacccgactaaataaccaaaaccacacaggcccgccaatgagcgggcttttttgtgcctggagaaaacatgcgatataacacgggcaacccagtaggaaccgacggctccagcgacccgagagatctttacaacaatgctggtgtggctgatctttttgctaacggcttggcggcatcctttcccgatcgccttgaccgcccaagaaagtcaatctatggaatggagcaggactttttccgacttt

SEQ ID NO: 587944 - DNA, 143 bp, Homo sapiens
gtccaacagtaacatgacccagtccacccccaagtgctcttagatactgaaggagtctcccttaacatacagtgtttattattattttttgagacagaatctcattctgtcacccaggctagagtgcagtggcaccatcttgg

SEQ ID NO: 587945 - DNA, 132 bp, Homo sapiens
gcccacgttcttgcatgggagggaaagaaaagagtggagtatatccagtgtttttacttttgagggggaagtactacctaaagggagtggtttccgttttgcctgaatctagtatgacagaaactgggctat

SEQ ID NO: 587946 - DNA, 530 bp, Homo sapiens
atttgtaaattgaatacttttgaatgtaagcagttgaagtaaaacctgtagtgagttcttcagtcagtcaacactaaacctgttttgtaaatttgatgctagtattacactggactttctcaaaatgaagtacacctatatatgcatatagtatatgagcatgcgtatttgtacaaaagcccttcaaaaggagttcagcttttataaacaccaaaacactctctgcctgtaaaatgtttttgctgaaatttgtatcattaactctcaaatttacatcttcatgtttgagatacgcttttaggactgtctatgcatgtagactttggtcaactctctcctcctccctcaataaatcattaacttgaaaaaaaaaatgtgaaccttttttaaaaaacacagttacaaaaaacaatccaacactttggtctcaaacaaaaaaaaaataagtccaatccactcacaaagaatttctattttgtaaaaatgtagcttgtatttcagtataataaaatctgatgtaagaaactgta

SEQ ID NO: 587947 - DNA, 914 bp, Homo sapiens
ggaccgcgtccttggcgcttggtcctgttgatcctctcgcctgccggttctccccggttccaggctgtggctcacgtttaggttaagccctctccttacgtggtttcccccccagtggcgtgtcacacttcgagcccgtgtgtcggggctgtgaaccccgttgggcctctttgggggcttctcttgagcagcccagaaggtcgcgcccggggctggtatcataatcacggggtcaccccgcgtgtgttgtgtcccccgggccctactgggtcccttaggtagtcaccatggggcccccttgggagtcgcctgttccttgttcgcccctggtttagtaaatgccctggtttctgatggcccccgtgtcccgtttggtgcgccccgttggcccatgtgtgtgtcgtggcaatgactctgcatatgcgggcgcgccccctgtggtgggagacattgcttcggacgcgggtatagtgcgcccatccgcagtttctatgagacccctttctcctgtgccccgaataacgtggacttcacatctcttccgcttaattaaagtcgcttaccaggggggggcgcgccctctgggcttatcgcccatgtgttcccccccctggtggggggtgtcatgggcttgccagccccctgggccttcgcggctctatcatgctgccttccttgcccctattccgcccgaaatcccgtggtttacccctcatgacgacgcgcatattgccgctgtcgggtcctcgagccggtcacgaacttcgggtgcagccggactcccacgtgaggggcgcgtgccatccagcgccccgtccctggacaccgatgtcggaggcccacgcgatgtccccttgatcgccggcctccgccccccgtctttccccccccgggcaccaaccgcaccccaccat

SEQ ID NO: 587948 - DNA, 146 bp, Homo sapiens
ggcacgagcttttttgcaggcgatactgacaagcttctgcacatccggatagaagattccccggaagcccagattcttcccttcttacgccacatgtgtcacttcattgaattcaccatcaccttggctctgtcattctgatattg

SEQ ID NO: 587949 - DNA, 485 bp, Homo sapiens
gtcttctcctccttaacctctttctttttggcgagacagggtctcactctgttacccaggctggagtgcaatggagtgatcactgcccctttgaacttctgggctcaagtgatcctctcacctcggcttcctgagtaggtgggactgcagatgtgtgccaccaagcctggctaattaaaaacaaatgtttaagccaggcatggtggctcacacctgtaatttcagcaccttgggaggccgaggcaggcggatcacttgaggtcaggagttcaagaccagcctggccaagatggtggaaccctgcctctactaaaaacacacacacaaattagccgggcatggtggctggtgtctgtaatcccagctgtgggaggctgaggcaggagaatcacttgaacctgggaggtggaggtttcagtgagccaagatcatttcacctcactccagcctgggtgacagcgtaagactctctcaaaaaaaaaaaa

SEQ ID NO: 587950 - DNA, 593 bp, Homo sapiens
atgagcagttctccaaactcttcgctatcgtgaaatagtgcatgtaactatacacagcaagtgcagggtatcctttgatatactgatttcttttcttttgaatactcagtagtgggactgctggattatatagtatttctatttttagtttatttgagaaatgtccagttttccacagaggttgtactaatttacagtcccaccgatgccgtattaagagttttctttgactgctggattacatagtatttctatttttagtttatttgagaaatgtccagttttccacagtggttatactaattgacagtcccaccaacaccgtattaagagttctcttttctctgcctctttgctggcatctgttattttttgtctttttaacagtagccattacaactgggataagatatctcattgtggttttgatttgcatttccctgatgattaatgatgttgagcaatttttcacatgcctgctggacatctgcatgtcttctttcgagaaatgtctatttgtgtcctttgctcacttttgtcttttttgagatgtaatttcgctcttgttgcccaggctgcagtgccaggcaatg

SEQ ID NO: 587951 - DNA, 131 bp, Homo sapiens
atatgaaatgaaaatgatagaatggaatggaatggatacgagaatacacatggaattgaatgaaatggaatggcatggaatggaatggaatgaacccggattagatacaacacatgctgcgaggggatcct

SEQ ID NO: 587952 - DNA, 131 bp, Homo sapiens
ggaaaaataaagagaaaaaagcacagaagccagtgaaagaaggacagccgagtccagcagatgagaaggggtgccattgttatagaacgaccaaatgtgaaatggagtctgctgctgagagcgaggcctag

SEQ ID NO: 587953 - DNA, 159 bp, Homo sapiens
  misc_feature (93)..(93): n is a, c, g, or t
  misc_feature (102)..(102): n is a, c, g, or t
gcggagacgggcatcagtgtgatggcggctcgcagcaatggcaccgtctccccctcggccttcttggagccatatagccctgcagtgtgggtnatgatgttngtcatgtgcctcactggggtggccatcaccggtcttcatgttcgagtacttcagccc

SEQ ID NO: 587954 - DNA, 105 bp, Homo sapiens
acttagaggatcccaagctccaacagagtgaactcatctcacacgaaaaaagaatgttgatattggccgcactctcttctggctgtagtgtttcgcgagaaatca

SEQ ID NO: 587955 - DNA, 286 bp, Homo sapiens
cttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttatacactccttagccactttttattctgagagaaataaaaaacctaaaagtc

SEQ ID NO: 587956 - DNA, 428 bp, Homo sapiens
gtgtgtttattacaaccttcggtaagctatactggattttcactgatgtcagtcatacacatatgggagggtagaactaatactaattatggagcaagtgagcaaatattataatagagctaaaaaggtgtaaaagtcaaactcaacagacatatctgatgggactagtgacaattaagaggcaatgggtcctgatgaaggaataggaaaagattactttgtggattctggctgggtggactccagtttctccctttattttggtcttggatattactaccctgagctcccaatgcttattccctcatccctgtaacctagtccctccgactggtcagaccttaccaatctagtcattttgccacaccctccttccaggagggcctcttcactaccctggtgctcagtgacacctccattcctagttc

SEQ ID NO: 587957 - DNA, 134 bp, Homo sapiens
cggcacgaggtgggagacagaggaaatgggtaacttgagcccaggagttggaggctacagcgagctatgattgctacactccagcctgggtgaaagagtgagacctagtctcaaaacaaaacaaaccaaaaaaa

SEQ ID NO: 587958 - DNA, 636 bp, Homo sapiens
agcggagggcgggagcaggagggggggggggagggaggggaaggagggaggagggagggggaggacgaactgaagaggaggagggcgggaggggggggagaaggggggagagggagagaagagcaggcaggcgcagggggggcagggggggaggagggcagacgggagggggagggggaggacgagggggacggggagataagggggagggagggagggggagggggagaggggggggagggagaggggggggagggtgggacggcgtgatgaggagacggggaagggagtgagggagcggggcagtgggcggacgggctgagacggggcgagatgaggggaggctagggggagggggggcggggtgtgcgtgggggggatggagtgagggggatgagtggtgggtggacctggctggaggagggtggagcgagctcagctcgggcaggcgggtgcgtccggggctcaagtgtggcatgtgggcgaggagggtgagtggaagagatgaggaaaaaaaaaaaaggccaggtgtggtggctcacgcctgtaatcctagcacgggaggcagaggcaggtggatcgcgagttcaggagatcgaggccaacctggctaacatgatgaaacttcgtctctac

SEQ ID NO: 587959 - DNA, 1589 bp, Homo sapiens
  misc_feature (297)..(297): n is a, c, g, or t
  misc_feature (908)..(908): n is a, c, g, or t
ttgtctccccacgcgagttgtgttttcgccccgcgagctacgtactccctgggccagcgccgggggtcttgtcccccacctagtgtacggggactccagcggggcagacgaggccctcccgcagtagtggtcttcttccggggtgtagcacagtcgcccccggcggtagttaattagtaggagtgtgtggtggttgctccccccccccctcctccacccacctatgtgtgggtgcacctcctttttggtgttacttagaaggaccgcacactgctagtggtgggtgttcgccgttcngccctcccctccgcagcgaagaggctgatgtcgtcgttgattctgtcttgctgtctccccccccccgccgcccttctcgttaggggaatgttctccccgaaggagtctcgccctcgtgcaggtttttcttgtttctccctctcgggggcggcgcccctcctctcttttctccccgcagaggttggtatgagatgggcttttttttgtaggagagatggtatttgttccccccccgctgcgctccggctggtatgcggcgtcggcatccccccctgttgtactcggtggccccactgcggccctcctcaccacatggctggtttcaactacgagggcggctctgcttgtgtgtgtcgtcctactcctccggggggcgctcccaacacttggggcgcccccccccttctcgtgctgtcttttgttggggtgttgtttttttagatgggctcccccccccgcagagagagtggtggccccccccccccccccgccacgcaccctcgtgggggcagcgcgcagcgacatcatctacacctggtggtcgccgcaccagtcttttctctcctccctcgtctttgtcccccccctctcgtgttgccgcacacgagagnagcttctcttctctctgtgagggggcgcacacagagtatctccgcgcgacagttgctcgcccgccactctctttgtcgtcctctctctcacacagggttcgcacacgcgccctctctgccgcgcgctctctctgtgtgttgtgtgtgtgcgcccctctctctctcctctctccgccccacccgcgggagcgctctctgggtctcttttgttttctccccaccccctctgctgtgcgctctcatagagagatctcctctctcctccctctctttgtgcgcggtctgggtattctcagatgtgtgcgtctggtgacaccccaactctctcccccccgcggggggcgccctctcccgccccctctgggcgcgcctctctctctccacagcagcgcgcccactctctctgagagcgcccctctcttttgtagagcctctcccgcctctctctctctgtgcgcccccgcctctctctcttgagagagagagagagctcgtgttttccccccatgtttccctctctctcacgcgggtgtgtctcctcggccccctctctctgtccagacccccccccacggtgtttcccgctcgccccgggctcctcggcctcccccctcgtgggggcacacacacacacaagggtgttttttccccaaaaaaaaaaagggaatttaggggtgtgta

SEQ ID NO: 587960 - DNA, 213 bp, Homo sapiens
acaatcacgatcgccgccagcatgaaggagtgaacagaggcaccgccaagtcggggagatacaatcccaggaagggaagggccatgtggcgggcttctgtgagcccgtgcactcatcagctttgccagctgtcccagatgcgctccagcgcctgtctatgagatacatccaagaagcagagcatctcaactcaccgcccttgaagctgatggt

SEQ ID NO: 587961 - DNA, 338 bp, Homo sapiens
  misc_feature (20)..(20): n is a, c, g, or t
  misc_feature (322)..(322): n is a, c, g, or t
  misc_feature (324)..(324): n is a, c, g, or t
cattaattgcgggaattacntaaaagctgtcggcgggccaactggtaatgccaagaacaagaataacgtgctcgaatgcggccgaattattgcggcctgcttgcgttaatgacgtgcgcgttcgattacatggcacatcgggcaaacgcaagcactcgcgtattggttcgatacggtatcgatacgcatcgaacgcacacgattgcggcgcacgacaaccggcgcatccgttgcctgcgcatcctttagaatcgagccgtcctttaccacgccctccgcgctccgtgcccgccgatcatcgtctcgacctgaacctgtttcntntgctcgacgccgtc

SEQ ID NO: 587962 - DNA, 231 bp, Homo sapiens
  misc_feature (225)..(225): n is a, c, g, or t
  misc_feature (227)..(227): n is a, c, g, or t
caaccctggttcggtaagtggtttgttttctatagcattattataggtctacctgcaaggtggtcgctatgggcagtaaacgtttctggaaaaacaactagtatagtagtgtgggaagtccactttatgaaattcactccaacctctatttcctccaatttccttatttgtttaaaaggagggaatccacatatctccttagggtgtacttaaaataaaatactntngaac

SEQ ID NO: 587963 - DNA, 992 bp, Homo sapiens
tgatcagccatctaaagcggacctctgttgaaaactctttaaggccaatccagtctcgactcctgcttgctggcttcgctggcctccagttgtccaggcacccgtattgtgcggatattgcatgttttccgagcacttgccaatgtatatttgtagtgacacttgcttatgtcccaatgtgagcgtttccagaagaagggcttacctaacacggtgctgttggcactttagcaagtgcggaactgggaggccacctgtcaaacacacagcatttgtacagggctcaatgtgatgtcagttttataggcaggaaatgatgattgatgaaacagagcttggaacatttgaagaggaccccatgatgttcaaggaaatgcagatggagttcttgcgtctgctgcccaggtctggagtgcagaggactgatcatggcgtcaactgcagcgtccatcttgccagggttcacagcgattctcctgctttcagcctctcaagtagcttgggattacaggcgcccaccaaaccggataattttttttttttttaatactttaagttttaggttacatgtgcacaacgtgcaggtttgttacatatgtatacatgtgccatgttggtgtgctgcacccattaactcgtcatttagcattgggtatctctcctaatgctatccctcccccctccccccaccccacagccgtccccggtgtgtgatgttccccttcctgtgtccatgtgttctcattgttcaattcccacctatgagtgagaacatgcggtgattggttttttctccttgcaatagtttgctgagaatgatggtttccagcttcattcatgtccctacaaaggacatgaactcatcattttttatggctgcatggtattccatggtgtatatgtgccacgttttcttaatccagtctatcattgttaaatatttgggttgtttccaagtctttccttacaccacgggccacataaagctcttt

SEQ ID NO: 587964 - DNA, 690 bp, Homo sapiens
  misc_feature (23)..(24): n is a, c, g, or t
  misc_feature (27)..(28): n is a, c, g, or t
  misc_feature (30)..(33): n is a, c, g, or t
  misc_feature (52)..(52): n is a, c, g, or t
  misc_feature (247)..(247): n is a, c, g, or t
  misc_feature (257)..(257): n is a, c, g, or t
  misc_feature (269)..(269): n is a, c, g, or t
  misc_feature (283)..(283): n is a, c, g, or t
  misc_feature (294)..(294): n is a, c, g, or t
  misc_feature (300)..(300): n is a, c, g, or t
  misc_feature (313)..(313): n is a, c, g, or t
  misc_feature (327)..(327): n is a, c, g, or t
  misc_feature (333)..(333): n is a, c, g, or t
  misc_feature (339)..(339): n is a, c, g, or t
  misc_feature (344)..(344): n is a, c, g, or t
  misc_feature (350)..(351): n is a, c, g, or t
  misc_feature (449)..(449): n is a, c, g, or t
  misc_feature (486)..(486): n is a, c, g, or t
  misc_feature (529)..(529): n is a, c, g, or t
  misc_feature (547)..(547): n is a, c, g, or t
  misc_feature (558)..(559): n is a, c, g, or t
  misc_feature (568)..(568): n is a, c, g, or t
  misc_feature (571)..(571): n is a, c, g, or t
  misc_feature (583)..(583): n is a, c, g, or t
  misc_feature (638)..(638): n is a, c, g, or t
ctacgtacggttaggtcgaggcnnggnngnnnngagatccaggcggtgacanagtggagccatggctagaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaantgctctggantgcgtttccccnttcaggaagagaantcagttacctnacgaantcaatgccagggngaaaccattagccnggaatntacagngaaangagaannagaaaagaaatgctgggaacgcagtacggagcgccatgaagtccgaggaacagaagatcaaagacgccaggaaaggtcccctggtaccttttccaaancaaaaatctgaagcagcagaacctccaaaaactccancctcatcttgtgattccaccaatgcagccatcgccaagcaagncctgaaaaagcccatcangggcaaacagnncccccgaanaanagctcaaggaanaacgcaacagaatcgcaaacttacggatttctaccctgtccgaaggagctccagngaagagcaaagccgagctgcagtctgaagaacggaacagaatagatgaatga

SEQ ID NO: 587965 - DNA, 159 bp, Homo sapiens
tatgtgggacggccccgcttcgcctgatcgaagccaccagcatgggcgaatgtcgcggcgcgtggcactggatcaggacatggtcggcgcaggtggcggagtaggtcatatcttcgcaatgacgccaccataagcaatggacgcaaccgccgcgccgtg

SEQ ID NO: 587966 - DNA, 135 bp, Homo sapiens
cttagaaactaaatcgagcccagaaagttgaggctgcagtgagctgtgattgcatcagtgcactccagcctgggggacaaggcaagaccctgtgtgaggggagaaaaaaatcagggttgacatggcttagcagca

SEQ ID NO: 587967 - DNA, 595 bp, Homo sapiens
ctgaaccaagtgctcatgtacctgctcttctgtcttcaatcttcgtcttcttggcttggcttggaggctgtgatccatgtggtgtggcccgtgtggctcctgccttgatcctgtagaccaccaatcctcctgtatcttggagctgggagacaagcccgtgcccaacaccttctatgtaggcttctacatcctcatcgcctgtgggcgctgtcatgattgttcgttggattcctgggctgctacggggccatccaggaatcccattgcctgctgtggacgttcttcacctgcctggtcatcctgttttgcctgtgaggatggccgccggaatctggggctattgtcaacaaaggaccagatcgccaaggatgtgaaagcaagtctatgaccagggccctacagcagggctgtggtggatgatgacgccaacaatgccaaggatgtggtgaagaccttccatgagactgcttgattgctgtgtgtccagcacactgactgctttgacacctcagtgctcaagaaaattgtgtcctcgggcaggacatcatcagcacctcttcaggaggactgccacagaaatcgataactcttcttg

SEQ ID NO: 587968 - DNA, 344 bp, Homo sapiens
  misc_feature (291)..(291): n is a, c, g, or t
tggagtttggctctggtcgcccgggcgggagtgcaggggcgtgatctcagctcacgtggcaacattctgtgccctcccgggtttcaaggtgatttctcctgtgcctcagtctccgtgagtgtggcgtgggatctacggggtgcccgccaccagcgctcagcataatttgtggatattttaagataaagagtggggtgtttaaccatgtgtgtgggccaggctgggttcttataaacctcctgtggaccctcgaggtgtgactccacctgtgcctctcagccctctggacantctcagtttatattctcacatatatttgtgtgtggtatacactctccccatgt

SEQ ID NO: 587969 - DNA, 217 bp, Homo sapiens
  misc_feature (208)..(208): n is a, c, g, or t
acaattttcaagtctacaatatattattattgactgtagaaaccatatagtacaatagctcttcatgacttactcctcctgtctaatggaaactttgtaccctttgaccatcatctcctccccattctcccaccaatccccaatctggtgtgaattttctgaattgatacctatattgatccagggttaaataaacaaagtataatantataataat

SEQ ID NO: 587970 - DNA, 1251 bp, Homo sapiens
agcgggctttcccccaagatggcgtccatgcgggagaacaacacgaggccataacaacacaacaaacaaaaaccacaaacaagcaagaaagacaccaccgcaacagacgcgaacccgaacgacacgtagccacaggaggcaacggacaacgaacggcggacgacgagcgaaccagtaggcgcgacgcggtcggtcgagtgtgagagcggctgagggagagctaagcacaaagacagctgagcggccgacccagcggcctgcagcggtaggactgagtagatagatagatctgccctaaaggatgaatatacagatccatggctacatccgatgcgcactaccacaggagcccccatgtgataacgacaatggtacatcctaggcagacgatgagatatgaccgaagtccaataccatctaatagcacatctaatgagccaagtaagggaaggtagaagatctaaggaaatggcccaaagccagtaaccatgagaagagaaaagaggagaaaagacgatgagagaatagatatgaataagaagatggaagaataatactatacgaaatcgcgatagacaaatctcagcgaagataaaggaagccagagaaagcgagaggatatcgaagatatactggtcccgccaaggacgaatcctgctaacagtcgataagcactcccgcggcgaagccgacccctcccagaaggaggacactgtcaaagagagttcccacgtgtatagtaactgtccgggtggagataggccctaggattgaggtcgagcgcctagctggcttaatgccaagaaacctaggaaaagcgcgtgagggctaatccaagtgagagtgggaccccaagcgaggtgtaggaccctatggccccaaaggccatagtttagatgaagagatgtccaggacacgtgcggagctcctgaggagaagtaggcgcgcccccaagacccgcaacgaagcccgactagttggagagccgttagagaagagatcttagactcaaatcggtgagcagaattcgagaagtatagccgatgcgtagtctcgaatcgtctcctgagctgaccgagagatgaggtccgagacccctgtatgagtgcggagtgtatcgacgcccctagacgtggaaatggccccctgagcgagagtcatctgcccgatgtcgagtgacgggaccgatgccgccctcgacgaaggaggaaacccgagggaacccccctgagaccccgggcctggacccga

SEQ ID NO: 587971 - DNA, 222 bp, Homo sapiens
aatcgagctcggtacctgtcaaagcgtagtacccaagtaactgggactacaggtgcacctccacgccctgctaatttttatatttttagtagggatggctttcaccatgctggccttaagtgatccgtccgccttggcctccaaagtgctgggatttcaggcaagcgtcaccacacccgacccctcactagtatttcagcatttgggtactacgctttggca

SEQ ID NO: 587972 - DNA, 1293 bp, Homo sapiens
aagtccctaaaggagaggctcaggggcagaatgggaattcttccatgaggactcagcagtcaaccaaagttggacaattacatgtagaagagagtgagcaaatagagttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaatagagagagctgtcattgagtcccaaaatggattgccagttttaaaataattattataaaatgtatgctaaccccaaaataatactaggcatgaggtgacctctctgatttggtcaccttgtagaaccttggagggtgtcagggcatctctttgagtatcagttatgattattcagaagtatagatgtatcaaatgatagaaatgacaaggaatggctgggattacaggcgtgagtcaccgcgcccggccaagcccttggcattttatctggaatagcatctgtaaactgaagtgtttgacctctgttttcttctctcctctttcatctgtttctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaacaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatcggtctcattattatggctgtgacaattaatggtgggtcaggaaattttctagttatagaggaagttattaattagggtaattggcgttgtaaagcgaaatttccaatggaccgaaaaatagggaaaaaatatt

SEQ ID NO: 587973 - DNA, 973 bp, Homo sapiens
aagtccctaaaggagaggctcaggggcagaatgggaattcttccatgaggactcagcagtcaaccaaagttggacaattacatgtagaagagagtgagcaaatagagttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaatagagagagctgtcattgagtcccaaaatggattgccagttttaaaataattattataaaatgtatgctaaccccaaaataatactaggcatgaggtgacctctctgatttggtcaccttgtagaaccttggagggtgtcagggcatctctttgagtatcagttatgattattcagaagtatagatgtatcaaatgatagaaatgacaaggaatggctgggcgtggtggctcatgcctgtaatccagcactttgggaggcaaggtgggtggatcatgagtcaggaggttcaagaacagctgacaacatggtgaaaccctgtctctactaaaatacaaaattagccggtgtgatggacgcgcttgttaatccagctacccaggagtgaggtaggaaaaacgttgagcccggcagcggacgttcagggagccgaaatgaccattggctcagctggggaaaaacgaatcggctcaaaaaaaaagaaaaagggggggcccaaaacacgggagccagacaccaccctctgcaaggccaaagggaaaaaggcggggcgacagcggaacaccgcatcaacccctggcaggcaccaaccga

SEQ ID NO: 587974 - DNA, 295 bp, Homo sapiens
gaggatccccgactcacagcgtatgtgtgtacctgtcgcatattatgtgtgcatgtgcgtaatgaaagtcagtaggcgtgtctgagtgtgctgatctagagtgtagcatcttactctgtaatgagagtaagagggtctgtaggagagtggcagggcatctatctgtgcatgtgactgtgttggacataacaggtcgtgcgctgactggaaccctccgtgcgtatgtgtgtgcatgtgagtgtgtaatgggagtaagtggacgtgtgtgtgtgctgtgcatacgcccgggtaagca

SEQ ID NO: 587975 - DNA, 1387 bp, Homo sapiens
aagtccctaaaggagaggctcaggggcagaatgggaattcttccatgaggactcagcagtcaaccaaagttggacaattacatgtagaagagagtgagcaaatagagttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaatagagagagctgtcattgagtcccaaaatggattgccagttttaaaataattattataaaatgtatgctaaccccaaaataatactaggcatgaggtgacctctctgatttggtcaccttgtagaaccttggagggtgtcagggcatctctttgagtatcagttatgattattcagaagtatagatgtatcaaatgatagaaatgacaaggaatggctgggattacaggcgtgagtcaccgcgcccggccaagcccttggcattttatctggaatagcatctgtaaactgaagtgtttgacctctgttttcttctctcctctttcatctgtttctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaacaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacctaa

SEQ ID NO: 587976 - DNA, 381 bp, Homo sapiens
atcgagctggtaccctcataagcggccatgctggaatggacgaatacatgcaggaagtgcatgaaggttgacaaggggagtggagctgggatcttatctccgagagcgttctgggaggataggcgcgtggatgtctgttagctggaagcttcgtactttcctgtggcctcctagaacccatacgcctgccgcgttccctggttttaaaaactatccggaaaccttcttgaaagtttccactgatggccaccttgcatctcagagccagcgagctcaggtctctcctggtaaccttcacacctagaggtggggggatgggggagcagtattgaaggtgaggaaaaacagcatgaaatggagcattgtcaggatagatggtga

SEQ ID NO: 587977 - DNA, 1431 bp, Homo sapiens
  misc_feature (1399)..(1399): n is a, c, g, or t
aagtccctaaaggagaggctcaggggcagaatgggaattcttccatgaggactcagcagtcaaccaaagttggacaattacatgtagaagagagtgagcaaatagagttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaatagagagagctgtcattgagtcccaaaatggattgccagttttaaaataattattataaaatgtatgctaaccccaaaataatactaggcatgaggtgacctctctgatttggtcaccttgtagaaccttggagggtgtcagggcatctctttgagtatcagttatgattattcagaagtatagatgtatcaaatgatagaaatgacaaggaatggctgggattacaggcgtgagtcaccgcgcccggccaagcccttggcattttatctggaatagcatctgtaaactgaagtgtttgacctctgttttcttctctcctctttcatctgtttctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaacaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacctaaaaaaaaaaaaanaaactctaggggggggcccggtccccaatctg

SEQ ID NO: 587978 - DNA, 118 bp, Homo sapiens
gagcacagggcttactgctcgaaccctctcagcactggtgaggacagctgcctcacaggaggactggactctggactgggctcagggctcccagcacactggctggctgactcaacag

SEQ ID NO: 587979 - DNA, 1600 bp, Homo sapiens
aagtccctaaaggagaggctcaggggcagaatgggaattcttccatgaggactcagcagtcaaccaaagttggacaattacatgtagaagagagtgagcaaatagagttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaatagagagagctgtcattgagtcccaaaatggattgccagttttaaaataattattataaaatgtatgctaaccccaaaataatactaggcatgaggtgacctctctgatttggtcaccttgtagaaccttggagggtgtcagggcatctctttgagtatcagttatgattattcagaagtatagatgtatcaaatgatagaaatgacaaggaatggctgggattacaggcgtgagtcaccgcgcccggccaagcccttggcattttatctggaatagcatctgtaaactgaagtgtttgacctctgttttcttctctcctctttcatctgtttctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaacaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacctaaggatgtcgtattgttttactctctgtctcagaatttgtattttgcctttctgccttttttatgtcaaaatagatgagattgtgtgcatctataaattgttaccacagtatttttgataatgaataaggataggactatctctgtgattattaaaatacatggaattatccaggaaattttccttacaaggaattaaaagactcctgtatttac

SEQ ID NO: 587980 - DNA, 450 bp, Homo sapiens
gcgctaacccggtagagcggctgctacagaagtacatcagaaagacaatcagtgtaggaaagaggacaacaatagctgcttctacctccatgctagtattagggtcaagatcatcacactctgactcctcggaactgttcgtctccttgatgggcagcatgaggaagggggaagaaagagaacatagttagaacacaggcagcgttggctagagagcagggagaacttgagagaagcacggacaatgggaaatcgggcagagaaaaacgaggtgctgtaaaggtggggtgcatatcgcctagcgcagcagcatgctcttttcgggaagaggaggctgggattgtgtacagccgctcatctcacaggaaatagcaatggaagcaaccaaatgatgcatgagtgctattgactttacatcgttgtcttctgtgcagctggactccccacatg

SEQ ID NO: 587981 - DNA, 334 bp, Homo sapiens
ccaagatcgcgccactgcactccagcctgggcggcagagcgagactccgtctcaaaaaaaaaaaaaattactttttaaaacctcccaagatggctcctgaagagccctcaataagtcccctaattcatccgggaaaaacaagactacagtaaaactattccaggaaagctactcaaaaatatactacaggaagtgaattcccacataatttaattacctcactgtcaaaaacatcacttatttatcaagaagctcccaagattgaaaactaaaaactgcacattaaaaactgcttcctctatatgacaaaattctacactggccaaaaagggtt

SEQ ID NO: 587982 - DNA, 472 bp, Homo sapiens
tactcggggagggacaaggtgtgtgggggttgaggtgggaggagcgcttgagcccaggaggtggaggctgcagtgagccatgatcacactgctgcactccagcctgggatacagagcaagattctgtctcagaaaacaaaaaagataaaaacatgaaattaaaatttctcttctgtggccgggcgcggtggctcaagcctgtaaacccagcactttgggaggccgaggcgggcggatcacgaggtcaggagatggagacaatcctggctaacacggtgaaaccctgtctctactaaaaatacaaaaaaaattagccaggcctggcggcgtgcgcctgtagtcccagctgctgggaaggctgaggcaggagaatcgcgtgaacccgggaggcggacttgcagtgagcagagatcgcgccactgcactccagcctgtatgactgagcaagactccgtctcaaaaaaaaaaagaa

SEQ ID NO: 587983 - DNA, 105 bp, Homo sapiens
ggccttctgtaggcaagctggaggtcccccgctcccgggaggacaccatattgatgcccatcgttagacgctagcacatcactcggtacagcgcactacagccca

SEQ ID NO: 587984 - DNA, 358 bp, Homo sapiens
ttgcccttttccctaaaaaaaaaaccccccccctggggaaaggggggggaaacccgtcttttttcccaccccccaggggggggggggttggaaccccaagggtttataagcccccccaaggggttggttttgggaaaatggggggggcttttcttttggggtcgggggggaaattccaaggggaaaatgttggggggccgctttcgggggtttgaaccccccttccccggtttgggggacggggggaaaaaaagttttttgggggatttcccaaattggtttttttggtcttttttgccccccggcgggctttgaaattttgttaagggaaaaacccatgaaaaaaaggttttcttta

SEQ ID NO: 587985 - DNA, 198 bp, Homo sapiens
acctaatcaacagtgctagttagggttcttcaacacccctttttagaccttatgcacttcattacatgaacaaaagcaatttctaatgatttacttcaatatttttggtggtcaatattaaccttggtggggtaacattgactaacatgtgtttaataacaatcagtataggcataaagggtttttgtctatttgtta

SEQ ID NO: 587986 - DNA, 631 bp, Homo sapiens
cccagttccccaacccactcccttccaaaacaaccagctccaatgactctggtctgggaggtgaggcttcccaaccaggaagactactttaaatgaaaaaaagaaatggaataataaaatcaggagtcaaaattcatcggtcttcaagcccctctttctagccttttctactaactctctgctgggtcaaggttggtgccccattacagacacaggggctaaattagccaacccaccaattggaaaactcagccgaatttttttataccactctgatgtcagcattttttccatctgtggggggctttttcctctttttttccattctccccaaatatttatcctggcttcaaaattaagaggatattttcagatggttttaattcagtgtggcgattcctcatctgattcaggctgtccagtcaggcccctcccatttaaggagctgagccttcatttatgaggagattctcatctatgaaatggatcctcattgtgtaaatcttttttcttcccattttcacaaagctgtaaagaaataatccatctcaaccttaccctttttctctggagtcagggggggtcttcctcgctccatcttacacagacctgagctggacctccaatggtt

SEQ ID NO: 587987 - DNA, 131 bp, Homo sapiens
cggttgggctcgttattctggctctcttcttttctttctggaccaccccctctttgtccaggttaccccttcatgtatcaatgctctttatactatggtaatgccaggattccaacagcaaatgaatactc

SEQ ID NO: 587988 - DNA, 102 bp, Homo sapiens
aatgggggccaaaataatttttaaatatagaagtatgccaaatgccttttcccctgagtaaaaaaaatttcagggccactgtataaatgggacatctgtgga

SEQ ID NO: 587989 - DNA, 235 bp, Homo sapiens
  misc_feature (204)..(205): n is a, c, g, or t
  misc_feature (213)..(213): n is a, c, g, or t
tattaagtttcttcttggtaaatatcctattggtggggtaagattttactatatctttagtttaaaattctgctgtgtagactctggcagctgcctctatggtgacgaaacaagctttttttttttttttttttttttttccacataaaacgaggagaaattgggtgttcccccaggcatcattctagcgcattattctataanncaaggcgngcaaataatttctcagggggtc

SEQ ID NO: 587990 - DNA, 1034 bp, Homo sapiens
gctcttcccggctccagctccgccggggggctccagcctttgctccccctcccaaagtcccctccccggagcggagctgcacctagggtccctcttcctgtccccccagacccagctacccgttcagaccagcagcctcggaggggcaccccccctgccagcctgcctccctcccgggtgcagccctgcccagggttcctcaggcatgaatctcttccgataccatgggagacctcatcccacctcctacgcacatcatcttgctactgctcaacaatctggaagtcccgctcgtgcgcccggaatttcagaggcacgagccagggtcctgtattgctgtgcgtgctccactgtcgccgactagttcctggcacccttcattgtcacgcacagcgtacagtctcaggctccttaccaacccacgttctactgaacgcgtgagctctaccagtaggccctgcatccctttcagccaccggctcttgggcccgcactgaataggccaacgcttaacgcaacggcctaacctataccgcagttggcgaaaccgcgattggacgcacccggtacccggcaacggtgtgaggcttccccgtgcagcaccgttgtccgccagcaaggaccaacgttccatggggaccagatgaccactagggctccgaagtaccattggacgtttcgaacacacccttccattggtgccggcaacgtcgcatccatgagaaacgcctattccgtccgcaattctgttacccttgtcaaggctccacggccaggggcccaagtcccattagcgcaccggccaaacccgctggctcctcaacgtggttgggacagcgcaaagcgacacgccggggtcggtaacggcgccgttgcccgcatcccgcggctcactcccaagtacgccgatcataccgagttgctgtttcggcgtgcccttacggtcgcgcctttacatcacccagacaacctgccctgcctaaaatacctttcattgccacacctgggcagtccctggggccggtcgttgccaa

SEQ ID NO: 587991 - DNA, 485 bp, Homo sapiens
  misc_feature (10)..(10): n is a, c, g, or t
  misc_feature (58)..(58): n is a, c, g, or t
  misc_feature (87)..(87): n is a, c, g, or t
  misc_feature (346)..(346): n is a, c, g, or t
  misc_feature (450)..(450): n is a, c, g, or t
  misc_feature (485)..(485): n is a, c, g, or t
actgaatgcngggggcagcagaggcagctctggccattggggcagccgcacgactgtngggggcagtcaggaccgggaagccttggnagtgtagggtgccgtgaccagggagggtctgcttcttgcaacagcccctttccctttgcacagaaaataatctgaggacaagaacagtggcgtggctggaatggctggggctgctcagggcctctgttgttcagctgggcttgcacctgaggctgacccctggtctctgagacaagctgatggccatcagatgccacaacccctgtctggacaggccccgaggacgtgtgtcaccgcaagagctcaaagaggattggtngagtgtctgggtcagaggtcaggacccaccttgcatcagcgggcttgggtttagtcatttacctaggaggttgagggtcatcctggcttaagtccagggcatancacagcaaaatctaccctttgggaagttcataaan

SEQ ID NO: 587992 - DNA, 1484 bp, Homo sapiens
  misc_feature (751)..(751): n is a, c, g, or t
tgaaataaaactcagtatttttgtctccccaccatttccatgtctgaccaccgctactactatgtcctatcataacattccatacatacttaaaaccaagcaaagggtggagtgccactctttaaaacactaacacaggcattttggacaagacatccttcgagaaaagaggacagacactcctaaaactaccaaaaggacctagatcgtgttcatcaaagacaatatgcgtcacaacactgccagccagatgttcaacaggcgtggtgctctatcccacgatggacaccccgaacttcatcacacttatgtgaacaacttgcttccagagatgacctgtaccacagaaggctgatacaagcaatctcctgagcacccgagaggacaagtctactcttgagtagaacaatagctttcaacactaactctacgttgagactgcgtgtttaccgatacctctagttcagcaagtatcgacgtgctagaccatgattggaataattagtagaggcataggtcccatatacatgtcagtaacacattgcaagagtgtcttgcaagaaaacaacatatgaccatgttaagcccggcaagcataggacggaagtcaagaccactgaaccagcatcccggataggccttgccaacaagtatgagcgcaacatgaaaagttggcagcataggaaccccacaaaacactggacacatggattgccccaagaagaggtaacccaaggcaaggcaatagccngcaacaccgaccgccaaccacacacataaaggaacggcggagtgcaccaaaacaccgacgaccgtgcgcacaatgcagaacacacagactaagacttcgacaatgaaaccgacacacaacgcaagccatagaggacaaccgacccgagcccagagaataccaacagaacacacacaccgccaacacaacgccgatgaggcacagcgcggacgacacaacacaacagagacgagacacaaatgacggagcaaagctcacaagcaaacccgcggccaacgacacccgcacgaagacagacaacccgacatagacacctccagcgccctcacaccaacgaacgccgaaaacgagaaacaacgcgactaaccaccccccccacggcccacaccagcacatagcacaacgcacaaggccaacgcgaacatgaaccagagagtacgcacccgaggacgcagcgacgaccgccggaccgcagagacaaccagggacgcacagagaccagcgacgcaaaaatgaacgatccgaggaccacgaccacgacacaccagcctcggctcacaccaacaccgcggccccgcgccgacacgtcgcaccctgccggaccgacatcacacccgagcaccgacaccggccagcacagcccccaacgcaggcatacaccacaagtacccgccccgcgcacgacgcaccggaccccgacccacacaggaccacaccgacatcggacacaccc

SEQ ID NO: 587993 - DNA, 148 bp, Homo sapiens
gtgcattgctttaattgcttgtcctggagactctctgaggcaggaggtgatgcattgcagaggctgcacaggcccctggaggtgggaatgaactgacttggcctatgtgagaaatgggctaacaagtgtggctggagggagccgcgcg

SEQ ID NO: 587994 - DNA, 150 bp, Homo sapiens
cagggactgacgagtctcacttaccccaggactccgctatgacaccggcctcggcccctacaagacacagatctctcgtcagccccaaagccgggggctggcagccacggatggtgtcccagcaggcggaagagggcctcaccttacccc

SEQ ID NO: 587995 - DNA, 256 bp, Homo sapiens
cgtgatctcatacaggagtgatgggcgatgagatgctttattaagggttcttgtttcaccatggcagtgcacttgtatcaaccgtatgactcaggaaaaccccttcgttaaggtcctccttcacaaagacatagagtgaaactccctttacatgtctgtatttgtacaacactttaggcaacttgcactgtcagtgttaaaatggaaaacaggaaaatggaaaaatctgaccaattctgccactttgagactttca

SEQ ID NO: 587996 - DNA, 529 bp, Homo sapiens
gcacgaggggaagccctgtcagagacagactcgtagagagccagacgcagacctgtggagagacgcgcttagagacaccagcgaggagctgagatatccaagacaggccccccaggagttcacagcggcctctggtaacttcttcttcgagcccatatctagacattaacaacttcctgggcaagggcaaagagagggcccaccagaaacgcaccagcaaacgggccccgcagaaggactggagccagagaaacgaactctttagaaacctctgagacgccctggtggcacccacagactgtgaaggcccagccaggatttcaccccacactttttccttcttcccaattactctcctggatcaaagtgccaattagagcccacataccctttcttgagacaaggattttctagagaaccatagtgcttcctgagtttatgggtgaatgtgtttccgtgcttccgcaacagcctttggcacactgtctgtgacatagctggcctgtgccatgtcacgatcatgggaccg

SEQ ID NO: 587997 - DNA, 1103 bp, Homo sapiens
cagatatcagcagagtggagcggggctgggagacaaagcgctgagggagctcggtacgccgccgacctcgcacccgacagccatcgcgcccggcggcgaccgtccccgagagaaccatggagtctggcagtaccgccgaccagtgaggaggcacgcagccttcgagaatgtgagctctacgtccagaagcattacattcaagcgctgctcaaagattctattggtgcagtagtgcactgctcgacctgagagacccatggcattcctcagggaaatactttgagaaggttggagaaggacggaggcaaaacagattcagaatctgcagaacagcaggcactcgtacagactccaagggcaggatgcagcatttctcctcctccagccaacccagtgggttcacacggtcagcgcaggcgacgcaggtgctatcagcgctgcaggtctaccacggaggcaagatgcggaatccatatgatagaaaggttataccaaaagattacaaagacaatggacgattaagccaaagcattgaaaagaatgtgctgatattccaatcttgatgataatgagagaagtgatatatagagatgccatggtatacgagtctccctttatcgcagggagagactgtgattcagcaaggtgatgaaggggataactctatggtgattgatcaaggaaagacggatgtctaagattaaaatgaatgggaaacaaagctggagcaccgcaagcacaccatcgaccaacatgcagcagaatgagaacacgcaaaagagccaatgccacaccaccagaccaaggtacaaggaggcatcacacaaaagaacgagaaccacagaagccgagacaacggaaacagaagcgacccgagcaccaccaacaacgggcacgcgaaaaccagacgcaagaagacgagaagaaggcgcaaataagcgcacagagcaaagacacgggacacgacggaagagagggagcggcgacagagcaagagacaagcggaggaggacgatgccccgctgcccggctagaaaagaagacaaggacaggagaaaaggcgacgagagaaggaaggagagaaaaaaaagaaacgagagaag

SEQ ID NO: 587998 - DNA, 161 bp, Homo sapiens
cataccacagctgggacccagccttcactgatggcatgcatccaaggcggcactgggagacaggagaggtgggttaccacaaggaggctggagtaagcacaagggcatccttggtcagtgaggactcagctgcctcgaatcccaaggccttcaccaatgac

SEQ ID NO: 587999 - DNA, 316 bp, Homo sapiens
gcggggcgacctagaggatccccccaacacagtcgtacggaaatacatcatattaacattattcccacaaaatgttaagctcaatggtttgactataagagtcaacaattactatttggaaatcttcttacggaacatttttataatctaatccggttttaattgcatgattatgcttatgtgatgaaccatcccatgattctgatattgtatttctttcccagtattaacatgtgtattgtgtggccaactctgatttgtaccccggtattattggggtaaatgattcaaactggttccctaacaatttaaattg

SEQ ID NO: 588000 - DNA, 219 bp, Homo sapiens
ctgacgcgccactatgtagcgggtttcgggcgggccacgcgtgcggaacaggaacccaaccccagccgaccttgagctccaggagttcgtctcttacgtcttccggaggtaaagctgcctaagttcttaggccaggtgaaaactacaggaaaggcatttaggctggaatgtcctctgctggtattcaatgactaagcaactatcctaagtaacatggga

SEQ ID NO: 588001 - DNA, 145 bp, Homo sapiens
caccaggcgataaaataccctctgactgtatttgatagccgatgtttccgctgccccctccacagctgtgtgagctgccatgccttccaacccttcatagccaaggccgtcacaaggtcaaatgatgtggtgtgtccgctgcccc

SEQ ID NO: 588002 - DNA, 1246 bp, Homo sapiens
ctgcggggcggggagctgcatggagcacatccgcaagaagcggcacttcagcgagtcggaagcaagccagatcctgcgcagcctcgtgtctggcctgtgagcttcatgcactgatggagtgcgggctgtggttgcacctgcgacctcaagcctggagaacatccatgtactgcctgacagacactgccctggtggcccctggtgaaaatcatcgacttcggggattcagcgctggtttgcgtgcctgcagatgtccctggggttgcccatgcatgactgcacctgcattcactgcttgcatgtactgctgcacccacgaagcttgcttgtgctgcaggcatgggggctacagaacgagtcctgcagaaccatcattggagccttggtgccgtcacttcttgtacatgaatggcttgtctggggtgcatggtcccccttccagtggtggcctctggaccatgggccgggcagatgccacgggctggccctgagatcacatgttgcaacaatccggcgacgggggcggcttcttccacttggactgtgggaaggccttgtgcaggggtggtaatcccgcacgtgaaggccaatggacgcttgtgtccctgaggtgtgctcacttggaccaggttgggacccccgggcatatgctgggcttgaaaagcatcggatgggggacattgcaggggtgcaagaactccggttgggcttgcagaggacgggccaagatggctgcagcatcccatcgggccacagcacggacatcgcgttggactgggcacccggaaaggcttgccataccgacgttccgctccttggagacacccggacatgatagccagacatacgaggggattcattacaaacatgaccaaaccaattttcaattgggcgcacattatcaacacccggtggtggcccacaggcaggggagacaggagggctgttcatttaccactttgacaaacgaaatggacgggttcgtgggacaagaaaaacaggggaaaagccacaccatgattgtgtgagaccacaaaatcgactgcgatcgtgtgaacacggcacggacaaagcgacttgggcagacgaacagccacagccagacacacctgagaacaattactccagtcgggcccgggggggcgctctcccacagtttgacagacaccaaggagacaaaacaccggggtgtgagccggggagtgagcaacacaggagacgggccggagacacaaaagatggggag

SEQ ID NO: 588003 - DNA, 85 bp, Homo sapiens
  misc_feature (11)..(11): n is a, c, g, or t
gccttgcgcgntcagccctgacaaaggtcagctagccccttgaggacatcagctttggcctcagggtcctaatggcagcagaacc

SEQ ID NO: 588004 - DNA, 371 bp, Homo sapiens
gcagaaatttttttggaaataatccaaagcagttttcctgagggggtcagcctgtcagtgaaggggccccctgaagaagccttcaaggggcgattcaaagttcgcccaaactgggaaaaatttgtgggcaaagtccaagcaccccccgtaccccctttcatgccagcaggggtcatattgagggccaaaaaaaagagcttttgggggggttagggttcatcaggagaccccccccttagtttttatagggccccattcccaaagccagaaaggtcctccctcctttgggggtgggggggacttgccattttttcccccttccctatgggggaagggttgtttttttccttttaataaaaatttgcggcaga

SEQ ID NO: 588005 - DNA, 329 bp, Homo sapiens
tgtcttaaggccatttattttttttccctttttaagtaattttacactttagtatctatttcagagtcatatttaaaactatttattagtgactacagtacatgagacaacaaggttcttcgattccaattccttcaaaggttaatgataatgtggtttatcctgtgccttaatagtaaggcaatctaagatatttattttgaagtttccatatgctgcactttaaagaaagggactttagatgtgaccctgtgagactatgtattcatgtcctggcataaattatttagtaagtctagatgtagcgtattaaattctaacctatccta

SEQ ID NO: 588006 - DNA, 1636 bp, Homo sapiens
  misc_feature (88)..(88): n is a, c, g, or t
  misc_feature (1156)..(1156): n is a, c, g, or t
tgccccccctcccctaaatactaaaggaagcgataaatggagagagagagaggagagagacgacagcagcaaccagcaaactgtgtgntcacctatttaactacagaccgtctattacttcactactcatctttgtgggttgggtcattgtccattctgttcatagattctgtgtggtcactcacactagtcttgtcatttttgcttcgtgttattatagccacccccgtgtaacaaaagtttgttatgaagtgtaacggccccctccgtctacaacagcacatattcatttgctgcgggcaccacatgttgcatccggctcgagttagttcaccacccgccgctcctctccattcgtggcggtcaccaccacagatggtgatagctgcccgccgtcggagagaaaggaagagctggcgagattgtgtatatctctttcggagtggttaccacctcagtgagagacaacaacgggggttcaacacgtgggggcccctccaatatgatgaagtggtgtctccgcctgtcgtcccccctatgggctcccagaattttcctccgtggcccccccgctctcggagaggataatctttgcaaaaaagcgacattggggtcttaaaaagaatcccccttggagagaagattatttgctcctggaagggggaaaaggacccacaaaaaagcgcctccccaaggggagcccgcccactttggagtaacctctagagaaaaatcgaggtgttggggaaaaactcctaaatgccccctagtttcctcttcttcagaaggaaaaactcccacgaaatgttgggaacgcattataaagagaatagacctttgtggggacggggttaacacactgctgtctcctctctcgagaagaatataatagggaggagccccccttgggaagaataaaagtcttggctatggagatgtagacaacagagttttcgaaaaatagggcctgtgagaaaagccccaccccccaagagatggggcctggaacacattgagaggagactttcccaaaagcctatacagagaagagatagggagatactgtgagaagaaaaaatttcgtttcacacacccacacttgtatatcacgccccaaaactctctatatgtgagaagttgtcacgcgccccgtccncccgcacacctttggtgtagaagaggggagaatccacgccacgagaacaaagagttgagagtctgtatagagacacctcgagtttctcggctaagtgcctcgggaaataattgtgaaaataactcggagactcacggaaacctttgttatggaaaaaacattgaaagacaacctaaagttctcgagaatgtaacattggaattcttcacccccacgaagtggagagttgaaaactgctatatagcctaagcggctgtttactgcttttcacttagcaccttgctcaccacagttctttgggtgggggggagaaagaagaacttggccactcttaaaaagcgggtataaaaacctgggttatagggtgtgtgttcacccttccaaatgttctatttaaccactgggtcatgtgcatctggtgtaggaagttttttctaccataaatgaccacccaaaaatgtttgcttatttaccctggga

SEQ ID NO: 588007 - DNA, 234 bp, Homo sapiens
tagacacggacttactctgtcaaataggctagggtgtagtggtgcgatcgtacctcactacagcctcaaactcccaggcccaagggatccgactgcccctccctcccaagtagaaggatcactggagcctgggaagtcgaggctgcagtgagctatgatcacgccactctactgcagccttggtgacagagtaagacgctgtgaaagaaaaagaaagagagagaagagagagaa

SEQ ID NO: 588008 - DNA, 1004 bp, Homo sapiens
  misc_feature (630)..(630): n is a, c, g, or t
  misc_feature (652)..(653): n is a, c, g, or t
ggggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataataaggagacaaagggtctatgggccaccctgggcccaaaaggtccacctggaactgcaggagacatgggaccaccaggtcgtctgggagcaccaggtactccaggtcttccaggacccagaggtgatcctggattccaggggtttccaggcgtgaaaggagaaaanggtaatcctggatttctagganncattggacctccaggcccaattggaccgaaaggaccacctggtgtacgtggagaccctggcacacttaagattatctcccttccaggaagcccagggccacctggcacacctggagaaccagggatgcagggagaacctgggccaccagggccacctggaaacctaggtgtgggactggcagcattgacttggatcactaggaagtggttgaaccaaaatacctgtaaactgctttggaaacagctgatacaacttcacagaaaatgttgaacatgatagtggttttcacaatcagtcttaggattgagctcattttacccttgaccagcaaataaaagaccttggaatct

SEQ ID NO: 588009 - DNA, 368 bp, Homo sapiens
  misc_feature (353)..(353): n is a, c, g, or t
ctgtggtcctgtctaacgcacgggcaggggagggcgcagcttccaaacccacagttctccctccaccaactcccaccagatgctcctacagttttttttgtattatgtttagtttttttttgtgagacacagtcttgctctgttgcccaggctggagggcagtgtctcgatcttgactcactgcagctgatgcctcctgggttcaagcgattctcctgcctcagcctccaagcagctgggattacaaacgtgaaccaccacgcctggctaattttggtgttttccgtagagacggggctttgccacgttggccagattggtcccgaacaccttgactcaggtgatccaaccgnctcgggctcccaaag

SEQ ID NO: 588010 - DNA, 3281 bp, Homo sapiens
  misc_feature (630)..(630): n is a, c, g, or t
  misc_feature (652)..(653): n is a, c, g, or t
  misc_feature (1788)..(1788): n is a, c, g, or t
  misc_feature (3112)..(3112): n is a, c, g, or t
ggggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataataaggagacaaagggtctatgggccaccctgggcccaaaaggtccacctggaactgcaggagacatgggaccaccaggtcgtctgggagcaccaggtactccaggtcttccaggacccagaggtgatcctggattccaggggtttccaggcgtgaaaggagaaaanggtaatcctggatttctagganncattggacctccaggcccaattggaccgaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacagcagaactcgtatttttcatcctaaagaacaaagtaatgacagaacatgctgttatttaggtatttttctttaaccaaacaatattgctccatnatcttagtacaaagtttcaatttgtttccccacaaaacaaagcaattctttcaagtcagttctgtgatctgggtctctaatctgtgctgtttcaaagttctctgtggcaacagcgaactatcacaaatatcaccaaaacctattccacttacatccaaaggcactgctcatacggtgattgtatgaagtttgaatgcagcacgttatgaaatatttggccgctggattcccacatttgtcttctttctgtctttaagactcagggaggctaaatcagtgtttgattccccgccgaacccttcctgaaacttcaagacctggtagggaagagaaggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgttggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaaagcaacactttttatgttatatgttgttcttacaaaccatactgaaagagtccattgtttaaaaatcttaatgtatcaaactgtataacttggccactgtatgtcttaaaacctgcttttcaatgtgttgatacattcccaaggttacttaattcaacttaactatcatgttattcagcaccaagcatgtcccaggcactgtactaacctacagagatgctaagagataatctcacatatacaagtagcttccctcccctctagttttttcttccttttcactgctgttatatttcatcatgataattcagcaggcccaagtaaaggttaaaaataaggtctgaataatagcagaaaaaccaacatctacnaaacattaaactagtgttatacttgatgataacactatttgatgagtcttagagtccagacacaaagagacaaagctttgaagatgctttttgatctacctaggtggagttggtggtgctgatatttttcaggctactgcttcaatctcttgctttgtgtgacatgccc

SEQ ID NO: 588011 - DNA, 206 bp, Homo sapiens
  misc_feature (18)..(18): n is a, c, g, or t
  misc_feature (34)..(35): n is a, c, g, or t
  misc_feature (67)..(67): n is a, c, g, or t
  misc_feature (78)..(78): n is a, c, g, or t
  misc_feature (89)..(89): n is a, c, g, or t
  misc_feature (122)..(122): n is a, c, g, or t
  misc_feature (153)..(153): n is a, c, g, or t
  misc_feature (155)..(155): n is a, c, g, or t
  misc_feature (172)..(172): n is a, c, g, or t
  misc_feature (185)..(185): n is a, c, g, or t
  misc_feature (191)..(191): n is a, c, g, or t
  misc_feature (195)..(195): n is a, c, g, or t
gaaagaagctctacctanctatactaatgtcccnncaaatctccttatcttataacattcacagtcncagcaacatantcactattgtnatatctatcttcagcaaacacacaactttatanccacaacgcttgagcctaatgcaatcatccncnggagtgaagagccaaanccatgcacagganactgcncttnacacgctaggc

SEQ ID NO: 588012 - DNA, 711 bp, Homo sapiens
  misc_feature (35)..(35): n is a, c, g, or t
  misc_feature (68)..(68): n is a, c, g, or t
  misc_feature (84)..(84): n is a, c, g, or t
  misc_feature (100)..(101): n is a, c, g, or t
  misc_feature (110)..(110): n is a, c, g, or t
  misc_feature (116)..(116): n is a, c, g, or t
  misc_feature (130)..(130): n is a, c, g, or t
  misc_feature (139)..(141): n is a, c, g, or t
  misc_feature (166)..(166): n is a, c, g, or t
  misc_feature (214)..(214): n is a, c, g, or t
  misc_feature (224)..(226): n is a, c, g, or t
  misc_feature (251)..(252): n is a, c, g, or t
  misc_feature (268)..(268): n is a, c, g, or t
  misc_feature (271)..(272): n is a, c, g, or t
  misc_feature (281)..(281): n is a, c, g, or t
  misc_feature (292)..(292): n is a, c, g, or t
  misc_feature (307)..(307): n is a, c, g, or t
  misc_feature (313)..(313): n is a, c, g, or t
  misc_feature (317)..(317): n is a, c, g, or t
  misc_feature (332)..(332): n is a, c, g, or t
  misc_feature (336)..(336): n is a, c, g, or t
  misc_feature (340)..(340): n is a, c, g, or t
  misc_feature (342)..(343): n is a, c, g, or t
  misc_feature (345)..(347): n is a, c, g, or t
  misc_feature (352)..(353): n is a, c, g, or t
  misc_feature (360)..(360): n is a, c, g, or t
  misc_feature (368)..(368): n is a, c, g, or t
  misc_feature (375)..(376): n is a, c, g, or t
  misc_feature (380)..(380): n is a, c, g, or t
  misc_feature (382)..(382): n is a, c, g, or t
  misc_feature (387)..(387): n is a, c, g, or t
  misc_feature (389)..(389): n is a, c, g, or t
  misc_feature (436)..(437): n is a, c, g, or t
  misc_feature (452)..(452): n is a, c, g, or t
  misc_feature (629)..(629): n is a, c, g, or t
  misc_feature (682)..(682): n is a, c, g, or t
gcacggcagggaaacgaagagcccccgggagagcngaagagagaagcacagaggacgggagcacaaancgggggggaaacaggnggagaacgagggcaanngaagggggngccggnagaagccgagggangggaggcannnaacaacaaacgagggggagaaagancccagaggccgcaccagacggccaaaggggacgaggacacaaaaaagnggagaacggnnnccaaaagcagagggccaaaaaaaannagggcaagggcagggncanngagagaaangggcccccgcnccccattacgacgangagganattnagggggatataaaangcgngganannannncacgnncgaggcngggaccgngggcaannacgnanacgcngngactcagcctcgagcgatataagggggataaatagacaacaggaacnnccgcagaggggttgngggaagagtatgtcattcaagggtgtgtagaacaaagacaagcacatggtagtgctcactaattagcagctattattcatatcacatcttgtatgtgaaaacaatttgtactttagaaattcccccataccattatttattatttttttggaaggcaccagccaaatggctcctatncagtgaaaattatggagggctgaccaactgagaatattgaatgtgggtaacantagcttttctaagatggacagttttttga

SEQ ID NO: 588013 - DNA, 3189 bp, Homo sapiens
  misc_feature (630)..(630): n is a, c, g, or t
  misc_feature (652)..(653): n is a, c, g, or t
  misc_feature (1788)..(1788): n is a, c, g, or t
  misc_feature (3093)..(3093): n is a, c, g, or t
  misc_feature (3103)..(3103): n is a, c, g, or t
  misc_feature (3118)..(3118): n is a, c, g, or t
ggggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataataaggagacaaagggtctatgggccaccctgggcccaaaaggtccacctggaactgcaggagacatgggaccaccaggtcgtctgggagcaccaggtactccaggtcttccaggacccagaggtgatcctggattccaggggtttccaggcgtgaaaggagaaaanggtaatcctggatttctagganncattggacctccaggcccaattggaccgaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacagcagaactcgtatttttcatcctaaagaacaaagtaatgacagaacatgctgttatttaggtatttttctttaaccaaacaatattgctccatnatcttagtacaaagtttcaatttgtttccccacaaaacaaagcaattctttcaagtcagttctgtgatctgggtctctaatctgtgctgtttcaaagttctctgtggcaacagcgaactatcacaaatatcaccaaaacctattccacttacatccaaaggcactgctcatacggtgattgtatgaagtttgaatgcagcacgttatgaaatatttggccgctggattcccacatttgtcttctttctgtctttaagactcagggaggctaaatcagtgtttgattccccgccgaacccttcctgaaacttcaagacctggtagggaagagaaggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgttggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaaagcaacactttttatgttatatgttgttcttacaaaccatactgaaagagtccattgtttaaaaatcttaatgtatcaaactgtataacttggccactgtatgtcttaaaacctgcttttcaatgtgttgatacattcccaaggttacttaattcaacttaactatcatgttattcagcaccaagcatgtcccaggcactgtactaacctacagagatgctaagagataatctcacatatacaagtagcttccctcccctctagttttttcttccttttcactgctgttatatttcatcatgataattcagcaggcccaagtaaaggttaaaaataaggtctgaataatagngccaccatcncaaacattaactagngtatcttgatgtacctattgagagcttagggtcagcccaagggccgcttgtctttttgactactaggtggg

SEQ ID NO: 588014 - DNA, 118 bp, Homo sapiens
ggggggcacgtgtagcacaggacagggtgtgctgggcatcaaggttacagatcatgctgccctgtgtgacccaactggtaggattggccctaagaagccctctgacctgaccacgtga

SEQ ID NO: 588015 - DNA, 1386 bp, Homo sapiens
cggacgcgtgggagcggatcccgtccgagccccggtcccaagtaactgccgccgtccccgtgagccgccttgtgagtgtccccccgtcgcgccacataacgttgcctctttgcagtagcgaccacgatccccagcccggcaacgctcgtctggagccactaacagctgagaccggtgcaactggcgggatcgagggagggcgcagacaacgaacccagaatggagccaggcatagcttgggggaatcgaaagatcttatgtcaagtctctaaagactaggcttaccttgctatgcgcgtggacgctctagcaggataatgggtcaacattctctacgtcgctaccgatctgctccgaccctcttgatcgaacgcgcgacaagtattatcaccgcacgatacaccagggatgatgtcgaagcaagcattgggaaggcgagacacatataccctcaccaacacgagcatgatcctagcacctagggacatgagcaacagaacaaggttcaacggtctctgaggcaatcctggaggaacaccaaggcatgggacgcagggaacgccgcgagagtcgaacaagaacgcttgggacacatccacaatagtacgttagtacaggagtggagtacccccggtgacttggcacagtcgaattggctcgtactgcaccaaatacacccaataaaacaaggacttaccatttatggcaccgtgggccaacaggcacactgggtagacaggacgctaacaaagaaggcgacggccacggccaccaaccatacgtccaatatcgccacgtacggcacgaggtaaacaaggagcaggaccctggggccaagcgacagcaagaagaccggtcgggacactaaccccgagggaaaagacaacccacagcccacagtggcaagcaccgaaacacaacccacggttaacaggccataggtctcagctgggcaagaacacaatccacgaccaacagaacggggccaaccggacaccggttgaaacgcgccacaactcgatgaccatgggccacaccatagtcccacggacaggctttccccaaacggaaaaccgaacgtccccccagagacacttgggccaaccatagacgatgactacccaaaaaggagcacgaaaaaaaccccaaaagatatgtgggagacccgctcccaggggaaggcaaaaaccgaaccccacaagccaacggaccacggaagccacacatgtactgcaaaccaaaaaatgagactcaccccccatagcacactgagcacacacctatccacacatgagcacacaacacacgtaggaagcgaacaccgacgcgggggagacatccaatacaaacaaacgacagaacggtaaagacaaccataggacccaa

SEQ ID NO: 588016 - DNA, 3108 bp, Homo sapiens
  misc_feature (630)..(630): n is a, c, g, or t
  misc_feature (652)..(653): n is a, c, g, or t
  misc_feature (1615)..(1615): n is a, c, g, or t
  misc_feature (2939)..(2939): n is a, c, g, or t
ggggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataataaggagacaaagggtctatgggccaccctgggcccaaaaggtccacctggaactgcaggagacatgggaccaccaggtcgtctgggagcaccaggtactccaggtcttccaggacccagaggtgatcctggattccaggggtttccaggcgtgaaaggagaaaanggtaatcctggatttctagganncattggacctccaggcccaattggaccgaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgaaagcctattccatcaactgtgaaagctggggaattagaaaaaataataagtcgctgtcaggtgtgcatgaagaaaagacactgaagctaaaaaagacagcagaactcgtatttttcatcctaaagaacaaagtaatgacagaacatgctgttatttaggtatttttctttaaccaaacaatattgctccatnatcttagtacaaagtttcaatttgtttccccacaaaacaaagcaattctttcaagtcagttctgtgatctgggtctctaatctgtgctgtttcaaagttctctgtggcaacagcgaactatcacaaatatcaccaaaacctattccacttacatccaaaggcactgctcatacggtgattgtatgaagtttgaatgcagcacgttatgaaatatttggccgctggattcccacatttgtcttctttctgtctttaagactcagggaggctaaatcagtgtttgattccccgccgaacccttcctgaaacttcaagacctggtagggaagagaaggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgttggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaaagcaacactttttatgttatatgttgttcttacaaaccatactgaaagagtccattgtttaaaaatcttaatgtatcaaactgtataacttggccactgtatgtcttaaaacctgcttttcaatgtgttgatacattcccaaggttacttaattcaacttaactatcatgttattcagcaccaagcatgtcccaggcactgtactaacctacagagatgctaagagataatctcacatatacaagtagcttccctcccctctagttttttcttccttttcactgctgttatatttcatcatgataattcagcaggcccaagtaaaggttaaaaataaggtctgaataatagcagaaaaaccaacatctacnaaacattaaactagtgttatacttgatgataacactatttgatgagtcttagagtccagacacaaagagacaaagctttgaagatgctttttgatctacctaggtggagttggtggtgctgatatttttcaggctactgcttcaatctcttgctttgtgtgacatgccc

SEQ ID NO: 588017 - DNA, 269 bp, Homo sapiens
  misc_feature (77)..(77): n is a, c, g, or t
  misc_feature (153)..(153): n is a, c, g, or t
gtctagtggacggcagtagactcacattcatatcgggactcaaagcttacaggctctccaagattcccttgtggcancgcaagactgtgatggtggcaacgtggggcctgcctcttacaacgtagaagagactctgaccactctgcgatatgncaaccgtgccataaacattaagaacaaaccaagggtcaatgaggaccccaaggatgccctccttcgagaattccaggaagagattgcccggctcaaggcccagctggaaaaacggt

SEQ ID NO: 588018 - DNA, 3103 bp, Homo sapiens
  misc_feature (630)..(630): n is a, c, g, or t
  misc_feature (652)..(653): n is a, c, g, or t
  misc_feature (1610)..(1610): n is a, c, g, or t
  misc_feature (2934)..(2934): n is a, c, g, or t
ggggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataataaggagacaaagggtctatgggccaccctgggcccaaaaggtccacctggaactgcaggagacatgggaccaccaggtcgtctgggagcaccaggtactccaggtcttccaggacccagaggtgatcctggattccaggggtttccaggcgtgaaaggagaaaanggtaatcctggatttctagganncattggacctccaggcccaattggaccgaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttgatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacagcagaactcgtatttttcatcctaaagaacaaagtaatgacagaacatgctgttatttaggtatttttctttaaccaaacaatattgctccatnatcttagtacaaagtttcaatttgtttccccacaaaacaaagcaattctttcaagtcagttctgtgatctgggtctctaatctgtgctgtttcaaagttctctgtggcaacagcgaactatcacaaatatcaccaaaacctattccacttacatccaaaggcactgctcatacggtgattgtatgaagtttgaatgcagcacgttatgaaatatttggccgctggattcccacatttgtcttctttctgtctttaagactcagggaggctaaatcagtgtttgattccccgccgaacccttcctgaaacttcaagacctggtagggaagagaaggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgttggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaaagcaacactttttatgttatatgttgttcttacaaaccatactgaaagagtccattgtttaaaaatcttaatgtatcaaactgtataacttggccactgtatgtcttaaaacctgcttttcaatgtgttgatacattcccaaggttacttaattcaacttaactatcatgttattcagcaccaagcatgtcccaggcactgtactaacctacagagatgctaagagataatctcacatatacaagtagcttccctcccctctagttttttcttccttttcactgctgttatatttcatcatgataattcagcaggcccaagtaaaggttaaaaataaggtctgaataatagcagaaaaaccaacatctacnaaacattaaactagtgttatacttgatgataacactatttgatgagtcttagagtccagacacaaagagacaaagctttgaagatgctttttgatctacctaggtggagttggtggtgctgatatttttcaggctactgcttcaatctcttgctttgtgtgacatgccc

SEQ ID NO: 588019 - DNA, 1160 bp, Homo sapiens
  misc_feature (991)..(991): n is a, c, g, or t
gatacaaaatcaatgtgcaaaaatcacaagcattcttatacaccaataacagacaaacagagagccaaatcatgagtgaactcccattcacaattgcttcaaagagaataaaatacctaggaatccaacttacaagggaagtgaaggacctcttcaaggagaactacaaaccactgctcaatgaaataaaagaggatacaaacaaatggaagaacattccatgctcatgcataggaagaatcaatatcatgaaaatggccatactgcccaaggtaatttatagattcaatgccatccccatcaagctaccaatgactttcttcacggaattggaaaaaactactttaaagttcatatggaaccaaaaaagaaccagcatacccacacaaataacaagaatactacttatgaaatgtgcactttatcctcattccataaatgttggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaaagcaacactttttatgttatatgttgttcttacaaaccatactgaaagagtccattgtttaaaaatcttaatgtatcaaactgtataacttggccactgtatgtcttaaaacctgcttttcaatgtgttgatacattcccaaggttacttaattcaacttaactatcatgttattcagcaccaagcatgtcccaggcactgtactaacctacagagatgctaagagataatctcacatatacaagtagcttccctcccctctagttttttcttccttttcactgctgttatatttcatcatgataattcagcaggcccaagtaaaggttaaaaataaggtctgaataatagcagaaaaaccaacatctacnaaacattaaactagtgttatacttgatgataacactatttgatgagtcttagagtccagacacaaagagacaaagctttgaagatgctttttgatctacctaggtggagttggtggtgctgatatttttcaggctactgcttcaatctcttgctttgtgtgacatgccc

SEQ ID NO: 588020 - DNA, 469 bp, Homo sapiens
agtatgctagcctcattagtcattcatttaacacacagttgttgtgccttcactggtatgcttagcgaatatacaggtgccaaggatatcgcaataagacaagacagacacagccctctagtttgttaaggaagcagacaataagtcagcaaatgaatcagataattgcagacagtgctccagtgatctgaagaatctgtaagtccacggtgaatgccgagtgatctgtagatgctggtccgtacctttaagcgtggtcaaggaaggaacaggaaggaggcaaagatatgcccccaactcctcgctcaactcccagagatgagaggtgcctcttggctccagctctgcagccacctctgctcaaaaggtacgctgcgttgctttctttattcctttgttaaacctggcaccagcaaaacaggcacctcaacacctataaatggttaggaatagatgggcaatcaagctt

SEQ ID NO: 588021 - DNA, 301 bp, Homo sapiens
gttactgtggtgttacgtcctgcacacagccacagacggctggatcccacctgcgtcggaacctacatcaagctcatggaatgcagatccttaatccactgagtgggggccaggatcaaacccgtccatgtcctcatggacactaggcaggttcattaccactgagccacaaggagaactccctatagcattttcagatctaggtttccaggctaggggttcaatgggagcagcagttgctgggctgcaccaacagccacaggtaacgccagaatccaagccatgtgtcttgaaacctaaa

SEQ ID NO: 588022 - DNA, 141 bp, Homo sapiens
gccacctatgttagaggaagtacagaagatgcagggtgtgtatccctgggtccagtccctacctggtacctttttcatgttgccttcaatcctgagcaggtattatcctagggaccagcatggacctaccagccaggtctt

SEQ ID NO: 588023 - DNA, 194 bp, Homo sapiens
atggaatatgagagagatagtaggaaaacagcaatgagagggaaataaggtaagagagatagtaggaaaacagcaatgagagggaaataaggtaagagagagatagtaggaaaacagcaatgagagggaaataaggtaagagagagatagtaggaaaacagcaatgagaggtaaataaggtaagaggtcgacgc

SEQ ID NO: 588024 - DNA, 119 bp, Homo sapiens
gtacccagaaagatcactcggtgcagaagatcacttattgtgcagaagattactcttctgcacgataagtgatcttctgcacaataaggtgatcttctggcccgagaggtgatcttctg

SEQ ID NO: 588025 - DNA, 487 bp, Homo sapiens
  misc_feature (266)..(266): n is a, c, g, or t
cccagctcagactccagagtttcctaaggtagtggtagctcaacctccagagcattcacaccttgactcaagccacagttcaagcttgggatcgggggtttaccatcactccagaatccaggagagaggttgaactttctccaaccaggagggagaccccaactcagcctcctaagaaagtggtaccccaatttcgagtatatcagggggtaacaaatccaacaccaggtcaggatcaagctcagaatccagggtcacccagcgtnacagttcaacttggggagcggggacttaccatcactccagaacccactaggggggtgggacattctacagccccgaagaggactatagtttctccaaagcatcggggggtgacccttccacatccagaccaggttcagactcagcattcacacctgactcgagccacagttcaaccttgggagcgggggtttaccatcactccaaaatccatgagagaggt

SEQ ID NO: 588026 - DNA, 534 bp, Homo sapiens
cttcccaccaggcaaagacataaaggtcagtcacatcacgtgtgagtcatttctacttattatcacctcccactaagaacttccctgtacagagcgtttagtggagaaaaatcctgcattaatggggtattaacctgtgatctggaaagctagctggctaatgaaagagggagaaaaactgttgactttacatgtgaaggcaccaacttggaaactgtgcataggttgtgtgtatatgagacccggtgagggatagtggagtgcagggatgagtggcctggctaggcagagcattcacactagagaggaatggagcataaggtcaggtgacggggtgggtgaccacagtgaactaggcaagcagaagagtgtgagctcatcaggggagtcacaagctgaaacagatgcattagcaacttatttgtgtagtagaggagttggcagtggtactgcgtgggattgaagactgctagactttaggcaaggggatcacttaaggaatttcttattgattcacattttgagtaagttggc

SEQ ID NO: 588027 - DNA, 280 bp, Homo sapiens
atggaatttaacagtcacgaaatatcacaacgttaatttgcaaattcaggtaacaatgacttggattcgatgaagcactacataagagctgggatgaaaccttaatgtccatgagtctgacatgggtaagtggcagattccagctacaatgtctactggattagagaaaaatgaaaaatccatggttcgagagtttccttggatgttcgggtctcacggcaactgcactcctattataacctgggccaagaatataacgaaatcgtggacataacagtgg

SEQ ID NO: 588028 - DNA, 326 bp, Homo sapiens
gttcttagcagtacactctcgtagggatctggtcttgtcctggacggctgtcaaatcgattcctagtaaactatacagagttttttcctgccctggtagcaggagaatgtttttcaaagagttgacttcacacaccttttggcagttgaaacaaaatcatacaattctcccccggcctcttccaaagcttctagtgttatatctcttccttgtgacagcggaccaattacaagacattttccattcttggatttcctctcgagctagttgtgcaacccttttgaactccgggatgctatgcataagtatttgaagaacctctggtg

SEQ ID NO: 588029 - DNA, 123 bp, Homo sapiens
cttctggtgtagcctgtgcggaaacttaggatgcctcagtgagctgcatcacttgaaaggcatgcctgtctcctcacttagtgcaatgtccatcgaccaaagccctgtactgatcaatactca

SEQ ID NO: 588030 - DNA, 531 bp, Homo sapiens
  misc_feature (484)..(484): n is a, c, g, or t
  misc_feature (511)..(512): n is a, c, g, or t
acactcatttgttatcttttgactttgcttgtgtattttgttcaaactttatgttgtcaagccgatcaatcatttccttgatggcttctgggtttatttaatgctttagaaaggcttccccattccgaaaagacagaataaaagcgattcacccatgttctccctttcacggtttcaacttcactgtctctcccgccgccagagcccagcaaaactttctaatccgcgaggagcccgggaccccgctgcgctgggaagccgaggcagggcgccggcctgcgggggtcttcggaaacgttcccggttcccgcggaagatcgcccggcccggagccgcgtgggctgtctgtcctcgcaggtagcagtcactcggagcagaacggtagttaggaaaaattttcaagtctccttcggctgcggggtcgcgccattccaggcggtgccaactgggagctccttcacccgccccaggccgagaaacgcgntcccagttggtcagggactaggagagnnctcgcccgccggagatgcg

SEQ ID NO: 588031 - DNA, 107 bp, Homo sapiens
ctcaggggacacaggatgaaagccatggccaatctaagagcatgacatgtgaaaagtgagtactctcactgtgtactcagcataggatagtgacactgctacaactg

SEQ ID NO: 588032 - DNA, 140 bp, Homo sapiens
atgcttgttggtcgtctctagcaggatcccctgtgagttcgccggacagcagtccctactcctcctatctctccctgtcctcagctgctggcttcactatactactatcagaccgtaaccttcgacaccacgcgttcttc

SEQ ID NO: 588033 - DNA, 572 bp, Homo sapiens
ctacgaatccaatccaaggttcccaaatcagcccgcacatccataagggtagaacttccgataactcacggacctcttgtactgcagagctaaaccacagcgctggagggcgtctgataataccaaaaagtgcggtcgctgcaagcgcgcaagttcgtacaaaaccgtaaggcatgtgtaaagaggggaggcactcgttacgtctattactaactctataagagagatgggcggattagtctatatagggactttaggggccgaatagaggcggggagaagaggagtctacgaggagtagacttacggtagagaatttcttgcgaaggaaaagccttgtcgatatgtcctacactttacgctccgacctcttagtacttttctataaagctaaagggtaaaccttccgttatgtatctctagcaaggaggccgtatcgtccttacgaaagtccagatcttgagccggatatcaaactctactacgtcctttctcgatctccttggttcgaactagctccccgactcttattaaagcctactactggatcgtttctttaaatcttatggcttg

SEQ ID NO: 588034 - DNA, 425 bp, Homo sapiens
  misc_feature (54)..(54): n is a, c, g, or t
  misc_feature (209)..(209): n is a, c, g, or t
ggcttagagggtggtaaactggaagcagtttaatgggacagtgtttgatgggantttggaggtgatgaggtttgatatagtttggatttttgtccctgcccaagtttcatgttgaattgtaatccccagcgttggcagttgggcttggtgggaagtgtttggatcatggtggtggatccctcatggtggatcccagttttcatgagatntggtcatttaaaagtgtgtggcacctccccaccacctctctctttcgctcgcttgctcgctcctgcttttaccatgtgatgtgcctgctccccctttgccttccgccatgattgtaagcttcctgaggcttccctagaagcagatgtcagcattatgcttcctatacagtctgcagaactgtgagccaattaaacttcttttcttataaaataaaa

SEQ ID NO: 588035 - DNA, 756 bp, Homo sapiens
  misc_feature (9)..(9): n is a, c, g, or t
  misc_feature (281)..(281): n is a, c, g, or t
  misc_feature (353)..(353): n is a, c, g, or t
  misc_feature (363)..(363): n is a, c, g, or t
  misc_feature (373)..(373): n is a, c, g, or t
tataacatnaaaaataggcttacaaatagagctactaggtacatacctaggctaaaggagtcagaggaaataggagacggtacataccctagtaagatagtacatagaggcgagctagggatttaaggtacaccgtatgcaggcctaggctaggaaaagacccagtaacagtagtaagccgtagatagtaggtacatatatagtacctagatagccagcctatagaagtatagcaaaaaaagagggaccataatagatagtaggtaggtatactaaccagngaggtaaatactagggccgcaccagaatttaatactagagtactagctagctagtagaagggagataactangaaggagcanggaaaaccgngaagggcctagataagccgccatactagtagcaggtacctaactagctactagtattggctacatagaaataaggtattaggaagtaaaagttacaacacaccctactatgctaaaagacaaaatagatagaataggaggtacattaacacctaactactagagaatacgtagtaggaacacaagacggcctagatatactataacaagccgggggccctagggaccaggctatacgaggtaatagcgctatgcaaatattgtatagaaggcccctagaatagggcaaaggaaggtaggcggctacaaggtagaagggctaccaactatggtacttaaaaggacctaaagagcagggaacttaggggaaggaatacactttag

SEQ ID NO: 588036 - DNA, 196 bp, Homo sapiens
ctgagcttgtttcccacagtcactgcatttatagggtttctctccggaatgaattctctggtggattataaggtgtgagtagtaaatgaaggctttaccacattcaaggcattcgtgatctttcttccctgggggaggtgtcttatgggtgacgaccatctgcccgaagctcttcccccgggcggggaagctcaga

SEQ ID NO: 588037 - DNA, 138 bp, Homo sapiens
agaggatccctctttgcttctgttctctcaccaagacctagagaagaaggcagaacatacaggaagtctcagaaggaggcagtgatagactgtttccagaacaggaaagtcaaacgccactgaggcagaagcaggaag

SEQ ID NO: 588038 - DNA, 936 bp, Homo sapiens
  misc_feature (673)..(673): n is a, c, g, or t
  misc_feature (806)..(807): n is a, c, g, or t
  misc_feature (812)..(812): n is a, c, g, or t
  misc_feature (814)..(814): n is a, c, g, or t
  misc_feature (821)..(821): n is a, c, g, or t
  misc_feature (825)..(825): n is a, c, g, or t
gcacagctggaagcgcgcgtcctgatgatgtcgaccaacaacatcctgtcgcccgccaacggcaagccgatcatcgtgccgtcgcaggacatggtgctgggcctctattatctgtcgatgatgaaggaaggcgagccgggcgaaggcatgctgctcggcgacatggccgaggtgcatcaggcgctcaacgcgggtgcggtgacgctgcacaccaagatcatcagccgcgttccgcagaccgatgagaacggcaagcagtacctcaagcgctacgagacgacgccgggccgcatgctgctgggtgaaaccctgccgcacagccacaaggtgccgttcgagaccgtcaaccgccttctcaccaagaaggacgtcggcgacgtgatcgacgaggtctatcgtcacaccggccagaaggagaccgtgctgttcgccgacgcgatcatggcgctgggcttccgtcacgcgttccgcgccggcatctcgttcggcaaggacgacatgatcatcgcgccggacaaggacaagctggtcgacgagacgcgcgatcaggtgaaggacttcgagcagcagtatcaggacggcctgatcacgcagcaggagaaatacaacaaggtgatcgacgcctggagccgttgcggcgaccaggtcgcgaactcgatgatgaacgagatcnaggccgtccgtcactatgaggacgggccgatgaaggccggagaaggacatcaatcgatctacatgatggcccactcgggtgcccgcggtcgcaggcgcagatcaagcagctcgcggcatgcgcggctgatggnnaagcngncggcganatcntcgagacgccgatcatctcgaacttcaaggaagcgtgacggcctgatatttcaatcgaccagggccccgaggcccgcggacaccgcgtgagacggggaaaccgggaataac

SEQ ID NO: 588039 - DNA, 168 bp, Homo sapiens
gttccagtggtcttggtcttatttcctcttgatggccggagttagatgtgtagggcgggtgatccccagttctttgcacctctgggtgacatcctgggcagccaacatagcacgcatatggggacggatcatctcggtctgccttaagcttcatcccaccagtcacac

SEQ ID NO: 588040 - DNA, 228 bp, Homo sapiens
cgggtgctgttctgtgtgtgagcctctgtggtgatggggcggtacgggtgctgttctgtgtctgagcttcgtggtgatggggcctgtgtagcgggtgctgttctgtgtctgagcttcgtggtgatggggctgtgtgctgggtgctgttctgtgtgtgagcttcgtggtgatggggtcgtggagcgggtgctgttctgtgtgtgagcttcgcgatgattggatgtccat

SEQ ID NO: 588041 - DNA, 741 bp, Homo sapiens
tttttttttggcaaataaaacgggctaagtgggtggcttttgggtgattagtcaaagagaccaaatcccatatcctcgtccgattcctccgatcttcctgtggcttcaaccttagcgggggctgcagcagcagcaggagcagctgtgggggcagcagccacaggggcagcagccacaaaggcagagggatcagccaagaaggcctagaccttttcagcaagggggaagggtgtaatccgtctccacagacaaggccagagactcgttggtacccgttgatgatagaagggggtacggatgcaacagtggggtagccaatctgcagacagacacgggcaacatggcggacaccctccaggaagcgagaatgcagagtttcctcgggtgatatcacgcacttcagggtggtagatgctgccatggtcgaacacctgcgggatgaccagcccaagggagaaagggggagatgtcgagcttgttcagcagcgtggcttcgcgggctcccacttggtctccagtctgtgatcagcggcacatcactcaggatttcacgggggccccgtggagattcaggggtgatacctaaagccgtggaaaaaggcaggtcctcctcgggcccgagaccaagctgtcctggggcgtggcacagtgacttccacatggggcaaggggaaccagcacgggcagcagcgtggcacccttatgggcagcaaatgtcccgaatctcaggaggcccctgga

SEQ ID NO: 588042 - DNA, 159 bp, Homo sapiens
tcagtaagcggagcaccagcaagctgcctacatcggcgtgagcaaggaaggcccgtacaaggctgaccactaccgctactaagccgtacctgccggcggacattccccgccgccggcgctatcaccgaggactgctccatgagactgctcgcttactga

SEQ ID NO: 588043 - DNA, 143 bp, Homo sapiens
ggccccctgtggaattggggaactgaggagactccagtgagggtgtccttccagtgtagagcagctataaggggccccctaagcttcctgtgcctaggaagtacagagaaccagtaacagggccatactgcacctaataccca

SEQ ID NO: 588044 - DNA, 468 bp, Homo sapiens
tcctggcactgctgggttgtgtcctgaggaatcaccgtcctgcgtctcacaaggctatgggtcgccaaagatcggatattcggaacccgcaggcgtagtctcgttcaaaatatagtgcatggtgccgatcttgtgcgagtccatcctatctgtacgagagcgcgttgtgtcagctcgcgagaaagacgtaataccttgtgggtcgcctagtagagagtcccggccctttctcagcactcgcggatgtcggctcgtgacggatatcgtacggtacattgtgtatcttgccagtgcgtcagtctctcgttcctttcgtcatgcgtgcagctccggacgattcgcatgatctaatgcgtctctgtattgaaccctgtaaaggttccactggtggtcagtatgggcggtcatacagacaccactggaacggccctggctgccatggtagggacagataggtcagcagaattc

SEQ ID NO: 588045 - DNA, 225 bp, Homo sapiens
  misc_feature (20)..(20): n is a, c, g, or t
aacttacgcgactatcgagnacgtgctttggagcacccctcttcccgcgcgggtacgataatcaaatggtattggggggatctggccccacaagtttgatgagttgacactgacgaacgaaggggacggtgacactcttacgcgaacggtgccttggttgatcattcgtgcagtcggcaatagaacggtcccagtgttctatacgctgggatggccgactaatga

SEQ ID NO: 588046 - DNA, 462 bp, Homo sapiens
ctttaaaatgttcaacatagagtactatgacccagcaatgccattcctatacattatacccaagaaaactgaaaacatgtgtccacacaaaaatctgtttacaggatgttcagagcatcattattcataatagccgaaaattagaaactaccacaatgtcccatcaactgatgaacagataaacaaagtgtgttatatccaaacaatgaaatattattcacctacaaaaataaatgaagtactaatacctcattcatacaacgtggataaaccttgaaaacattatgctaagtgaataagccagtcaccaaggctgctactgcagaattccatttatatgaaatggccagaataggcaaacccatagagacagaaagtagatactggttgccagaggctgcgaggaggctgccagaggctgtggggagtgacttctagtggacactgggtttcaatttggcg

SEQ ID NO: 588047 - DNA, 101 bp, Homo sapiens
tggcgttagctctctctttatatacactctggctctataatctcgcctgcagccgctggttggaccagcacacgctgacggggccggtctatttacaggtt

SEQ ID NO: 588048 - DNA, 187 bp, Homo sapiens
cgttagcaacaggatctgaatgaaagacactgggtgggtcttgattcagaagagctgaatttacactctgtgagtctgaagatacaagtcaggctccaggaatctttgcttacctggatcgtgtgaacatagatgatgactgggagtgcagatcgaaagaggatccggactgatttgcgggcccctg

SEQ ID NO: 588049 - DNA, 252 bp, Homo sapiens
gtttatatcgttggccaggcacaacggctcatgcctgttactcccagcactttggaggccaagccagaagatcacctgtgttccagagttcaagaccagcctgggcaacaaagaaggaccccatctctacaaaaaaaaaaaaattcagctgcccgtgctggcacttgcctatagtcccacgtacctggagtgggaggatccacctgagcctgggaggtcaggctgtaatgagcagtgatcaggccaacgcac

SEQ ID NO: 588050 - DNA, 839 bp, Homo sapiens
gcatagtgctagtactgaggccgcgtgtgaatctggccgagggtcagcccgtgagcaagagcctcgcctttgcctgatccgccgcccgtacacaccctgccgcagctcaccatggatgatgatatcagcctgcgctcgtctgtcgacaactggctccgtgcatgtgcaatggccggcttctgcgggcgacgatgccccccgggccgtacttcccctccatctgtggtgtgctgccccagtgcaccagtggcgtgatggtgtggcatgtggtcatgaatgtgattccgtatgtggtgctgacggaggcccagagcaatgagatggcatcctcaccctgaatgtaccccatcgagcacggcatctgtacacacaactgggacgacatggagaaaatcttggcaccacaaccttctacaaggagctgcgtgtggctcccgaggagcacccctgtgcatgcgtgacctgaggcccccactgaaccccaagggcaaccgcgagaatgatgacccagatcatgttttgaagagcttcaaacacccccagacagtgtacagtatgctatccatggcttgtgcatatccctgtacagcctacttgtgacgtaccactggacatacgtgatggactccggtgacggggtcacccacactgtgcccattctacgagggggtattgccatcacaccatgccatcctgcgtctgacctggctggcctgggactgctgactactcatgaagatctcacgagcgcggtacgttcacaacacggcgacggaatgtcgtattaggagacagggagtgccgattgatgtgcagtggcaacccggagcaaattcgcg

SEQ ID NO: 588051 - DNA, 294 bp, Homo sapiens
  misc_feature (8)..(8): n is a, c, g, or t
  misc_feature (177)..(177): n is a, c, g, or t
  misc_feature (187)..(187): n is a, c, g, or t
  misc_feature (207)..(207): n is a, c, g, or t
  misc_feature (237)..(237): n is a, c, g, or t
tgagagtnttctgtctaattgctgtttttcttgtgagtaatctatattttctctctttgagttcttaagtccgtctgtatgtctttgtcagtaaatgtagctattgtgggattttgcttttttctccttatggcttttttagggactttattgctttcttgggaattcttggaaggnggttaacaanctttttttttcaagttcccngggacaatttctttaggcccatttggtcantctttccccccctcccccttctattattctcctccttaatcctccttccccattctt

SEQ ID NO: 588052 - DNA, 180 bp, Homo sapiens
atcacaccattcattgcactccagcctggatgacaagactgaaattccgtcagaaaaaaaaaaaaaaggaaaccatagcacattgtatttgaattctttgtacataaaaatttttccacatctagatgtgttttcttgggacagaatccccaaagttgatttgggaaaaagtaaagtttg

SEQ ID NO: 588053 - DNA, 135 bp, Homo sapiens
  misc_feature (95)..(95): n is a, c, g, or t
ctaaaagtactgagtttattttaaagcatagcatcaagtttgaatcttatgaaacaaaggcatccctacatttcctgctgagtttttcaaaaagnaaagaccagcatactttagatatacatgataatgtagttt

SEQ ID NO: 588054 - DNA, 123 bp, Homo sapiens
ccgactctagccgctcttagctcgcatgatcccaactgctcctgcccgcgttactcctgcacctgcgccgctcctgcaaatgcaaaaaggcaaagcacctctgcaagaaagctgtgctctgtg

SEQ ID NO: 588055 - DNA, 1179 bp, Homo sapiens
ccagtctacgcttgctgcggcgccaacagggccgactgcagcgtggaagataggcggcggtccgtggtctgtcgggcctgctacctgccgtgggcacaagtgctattgctgctgccacgctcgctcgccgtgcctctgctgcggactgctcagccattgcctggagtatcgtgcttaatcctttcgcatcaagaggcgcatccagttgtacgtaggcccggagacagcagtgttacggcctgtcttggaccaagcgagctgcagtgtgggctccgagacaggtcctctcagcccaacttgccacggtgggatgtagtcggatttgattgtttgtgcacgccgtattctgatgacttgacgacatgaatagatcggtgtgccagcgctaacgtatttacggacgcatactgtgcctcttcgacagtgcgaacacaacgaatccggccctggcatgtgtgaccgcttgtgtacgcacacggcacggctgagcagcagtctcctgtgatgtgtgctcacaatctttacctgctccttacaggtctagccactgagtgaatgtctcacatcacagacagtataccttaaaccattcaaaacgtgcctgtcttgttctctatatgcgtatgtctgcccggacaccagacgatggctgccgacgccgctccctgcgcgtctgcaacgacgttgggtggtccacgcaaaatctggttaggtctccctggggcccacgtcaacttttcgagcccacgcaactttccgcatgacaccgccgcacaccccggcttgcgactgcctggccatctccaccctgggcctgcgccgcaaccggaacgctgcccatcgtgcaacgcaacatagtggcgacttgtcattttccgtcagctgcgctcagaacgcacacttgtcttggcggcatctctctcttcaacagcgtctcaaccccgctagtcactttgcaccacaccacaagcgccacatttatcccgcaccgctcggttcctacctctgcccccttccttaacgggctacgccagaagtcggcccgggctagcgggactcgcgggcggtcccccccaaatgtgtctgtaagtcaacacgtcgggctctcccgagtgggcactacttgcccgcttgtccaccactccgcgccttgtcgaacagtcatcgctttgttgcgcc

SEQ ID NO: 588056 - DNA, 443 bp, Homo sapiens
ctgagggagtacgtggagtcgcagctgcagcgcacagagacttgagcgacggagaccgtcaccggcctcagaggccccccgtgctgtgcagctgagccccaggctgtacaaggggcactgtgtttgggcactcactgtaaaataaccttcgatggacacccattgtcagagaggggataacctctcatcaagttttatgctccatggggtgggtgaatgtaagactctcgctcctactctgggggggggctctctaaaaaggagtttccccgtctcgcggcgggtcacaaaccccgccgtagactacactcctgagcgcggtattttcagcacatatactgctacgacggcgtacccccccactttatcttcttccccccgggggggagagagacaaaaatgcaccacaggagggagaagacccctcttctttacaaccccct

SEQ ID NO: 588057 - DNA, 564 bp, Homo sapiens
gcatgtgctgctgctgcgactgtgaggacgccggcttcaccgtcacagagcccagaacatgagtaaaagcctcactcttaagaatcctggaagagtagcatacgattcaggcgggataaagatgttttgggagaaaaaaatcgagcatcacgcaagacacctgcagaacgaggacatcagggttcgcagaagcgctctgaacaagctccgcgtgggatgggctgagcagctggaggggaggaacaagatgctgcagggcccagggagatgcccagacagggtcccggaggccactgagtccctccacaccaaggacaagaaaggcggcctgagggcccacgagctccagactctgcatgagcttccggagggtcatggagaaggaacaccacgcgtggggtccaagcatccacgccagagttcacaggatcttcatcatggaaatggcccgcacctcgctgaccccgtaataatcccacctcggggtccacgctgcagcagagtcccagggttctctagcgcatctctggtgcccaataaaacctaagtcaattaaaaaaaaaa

SEQ ID NO: 588058 - DNA, 191 bp, Homo sapiens
gtgattctagagtatcctggtatcctgatcaactacgacagatagtgtcattagcaagtgcagggagttcagatcatcagtagagagctggcagaacagaaggcaccgaaaagcagcacatcacgttagccttggagtaacaaaagctggaagaaaagcggtcatttgactctgcagtagcaaaagcatta

SEQ ID NO: 588059 - DNA, 709 bp, Homo sapiens
cggtggacgggcccgcccggtggggcgcttcttcacgcccgctcatccgtccagggccccgaggtgactcgcaattgtcgtcttcggcggtccgctgtctgacgggtgcagaggaggtggcggtgccgcctgtgtctcgttgggatacgtgatggtgacaagaatgagaagaacggtgtctgatgggggcaaaggtcctagtacctccttgtgcgggtattccgggcattgagcgagccaagagagaggagaccgctggagcggaacttcgtaccgtcttcattggcagccactgtccaactttcagaccgcttacaccctgtggggtctggagatcagtcccatggtcgccgagagtgaccaaaatatgcgatgttgggccattatacattgaggacctaagcctttgtcggtcggagcgtattcatcgcatcagtgtgtcccgagtgtactgaggaaccagtatcttgaaaattctaatgttgcgagtcccttcacagccagtaaaccagcttctttggagtaaccgtattcctatccactctcctacatagaatggatgctactgtacactagcaagaaagtaataataaacacatgtggcggaggtcgcgaccgtaaagtaataaatcccacttaggaagtggtgcgccatcacgtttgctttttgtggccccaaggtttatctttggctccaaaaaagtggagc

SEQ ID NO: 588060 - DNA, 119 bp, Homo sapiens
cacgctaacgatagtgattattttaatcaatctgcaataaacgctcgcgtctttttttctattcaaacatgcctgggataaaatgtgcaaggccaatgtatttcaagaagcaggaacag

SEQ ID NO: 588061 - DNA, 832 bp, Homo sapiens
gctgcctattcgatctactaccacatctacggtggcgcgggatctcaagatgcgcctccacctagctcctgctgactacgcgctgtagacggtgcagtgacaccaccgaccgacggagctcagtatacagcttgacgtaggcaacataggagacatctgcaatggtgaacggcctcgactagcgagctgcccgagggcggataccactggctagcgatgcacagacagaccattgtatccagcagggcctgataccagagattcttactacagatattaatgaccttaactacagatgggtctctattgagaataactggaacctatagcaaagacatttaaaatccccatattgacaatatagcaaatggcaacaacagtacacatttgcattcttgcagggcagtaggatacaggaattacaccaacatcctgtatcaaatagacaggtcaactaattgagttgcaaacgacgcaccacactaatgctagcagataagaagtattacgcgtatttgcaatactatcacacacaaaacaaggatgggaacaatgggcaaccgatgaaaacaatccgagatagaaatcatgacgatatccacagaacagctcggcacatagtacaggcaagcacacagccaggacagaccaacaggacgacaacaccacagagccataaccacgcgaacccaccaaaagacactagagcactcaacaacatatgatgacacgaacaggaggtagaaaatgaccaaagtacaaaccaaaagaaacaagggaaaacgaagacaaaaaggaaacacataatacgaaagagaaaacacggagaaga

SEQ ID NO: 588062 - DNA, 442 bp, Homo sapiens
tgctcactcgagtcaccattctccagctccccacagaccagcctgtgcccacctccttgccctactgctttaggctactccaacctagtagtaacagtttttggggttttttttttttgagacagggtcttgttctgctacccaggctggagtgcagtggcatgatcatagctcaccacagccttgaccacctgggctcaagggatcctcccacctcagccacctgagtagctgagaataaaggtgtgtgccaccatgcccaggtaatttttatatttttttgtaaagatggggtctcgccatcttgcccaggttggtctcaaactcctgggcttaagtgatccgcccacagtgctgggattacaggcgtgagccactgttcctgccccttctcagcacaaatttttactttctctcttttttttttttaaaaactgatgtt

SEQ ID NO: 588063 - DNA, 285 bp, Homo sapiens
ctatacacagaagaggagggataagttaatgaaggccacaacggcacgcggcacagatcctttgtggagctggacctttcgcaaacaggccgtgtcatcaccttccaagaaagtttccttcggttgtcctgtgcattataatatacaaaataacttattgggatgatcagaggctctgacggtcttgaccttcttgacatatacacatgaaaaaatgggggctgctatgctatgtgtgtcctacccaaacctgtggccgccacattttgaatttcgggataccga

SEQ ID NO: 588064 - DNA, 401 bp, Homo sapiens
tccctagtggccaggtttatcccctcacatgggggggttcacatacacagcacaaaggcaggggcaccaggggagagggcagcactccgtgccttctgaggggatctgggcctcagggtgtaagaggggagaggagggttcctcttctggccctcactagggcctagggaacccaggagcaaatcccaccaggctttccatctctcagccagggagaagccacctgggtgacgttataatccccaaccattatagtagggggagaagggatgggccgggtcccaaccattacggggctgaagatataaacagtaagggaagatacagttgggatgaggccacaggaaggcagcagatgacaccatcagaagcatatgcaggaaaggggcagtaacggggct

SEQ ID NO: 588065 - DNA, 334 bp, Homo sapiens
gttcgagccaattggttgattgcctacatacaacatgtttgtatctagcaataaaaatttacctaatataacataccacatgattgtttaagcactatggctagtgtatgcagagtcatgctggtaataccggaatacagaagcagatttacaaataaagagacagtgtcattctgcttaagggtaatgtgtgggtgtcataatactctattaccacttatatccagatgagagcatttgctataacttccatacattgtatcctgaaaggttgtttccaagttctttaggaccagcctcctaatagcgtgaaaagtcttctatatgctctcat

SEQ ID NO: 588066 - DNA, 820 bp, Homo sapiens
cacactggcatgcctcctctgggcccgaggaagcctccttctgttgccgctgctgctgctgcgtcctgcttcgcgcacgtgctggctgtcccccgtggagcgaggggcgcccaacaaggaggagacccctgcgactgagagtcccgacacatggcctgtactacctaccgtgtaccgtcctacggaggtcactcgatgtactggagacggatgggcatttccgagagaagctgcaggctgccaatgcggaggacatcaaagatgcgggaagctgagccgagagctggacattgtcagcctaccatgtcacgaaccagagctgtgatgagctctaaggcgaacagtgaggtgtctacgcgcgtgcggagtgcgtgctcgaaaggccaaggatggcacagccgagcaggatcccaatgatacggaggtggaatcatcgtgaactcgtcctgtaaacaagttggaagcaccatgggacccgtcaagaaccagcaagtacatgcgaaggcccggcgtagtctggtgagctgcatgatccaaggacggtgcacgccaggagacgcttgacccaaggtagcgactgcagacctcagtcatgacagacgttcaacgcggctacgaagagtggctatacacggacacaccggagagcacgtgcagttactctggtaggtcatcatgggcagagtgcagcagagaaacagcgaggctggcagcagcgagagcatggcacacggagcgctcaagccgcacgcgccacgcgcggacgccaaccacttaaagagttgcaacgatggcacgtgcgccaggaccaaggacaccg

SEQ ID NO: 588067 - DNA, 114 bp, Homo sapiens
cactctgaccccacgacatgacccaccaacaacacggaccgacgcgactagacggccctgacgacgtccggtaacacgacctgaacggcgtgacgctccccacacccaacgtga

SEQ ID NO: 588068 - DNA, 178 bp, Homo sapiens
ctgtttcgtcatctctgctttgccctgtatccatcactcattcgttatttaacccttcatttttttttttaatatgaaaacttggttggagttcccgctggctccatgggctcaaggacctggtgttgctgccgctgtggtgtcggtctcagctgcggctcggattcagttcctggcc

SEQ ID NO: 588069 - DNA, 199 bp, Homo sapiens
  misc_feature (120)..(120): n is a, c, g, or t
gcatcgtgataggctgttacagtggaaacacgtcgtgcctctggcagtgggcgtgcctggtgtgttggggagagacagtgaacgcagctgagcgtggcaaaggaagtcggacacagcaanagtttgaaactgcttttcattcattgccatattttcaggccttttcctatgatatctaactgagatcatgttaggttcc

SEQ ID NO: 588070 - DNA, 203 bp, Homo sapiens
tctcataaaaattcaaactataggcccggcgcggtggctcacgcctgtaatcccagcactttgggaggccaagaagggaatgggaggagaaactgaggatacagggaattttattattattatgttggtttgttttttgagatggagtcttgctctgtcgcccgagctgcagtgcagtgggtgaaagagtgagactctgtctc

SEQ ID NO: 588071 - DNA, 745 bp, Homo sapiens
  misc_feature (8)..(8): n is a, c, g, or t
tttactcntttgtcacgagcgcgccatgtgttggtcccgggattcggcattatggccgggggtaatgttttttaaatatgggggggggccgatacttcgaaattgttggttccaacgaaccccccccataaaacccccccatcggtattactgtagatctaatcgaaacatacgacggagcgcctaacccatgactcttgttaatacgtgaacaaaactctcttcccttttttgagaaggtcagggggtttaaaataacccaacagacaatcttcttaaaaatgtatgaaagggcactacccttttcgaaacaaaattctttggaatactatatacttacgactgctacctctacccaacgctatggaattattgtgcgttcctgttccactttcactcccccgtgtaaggcccccaccgaacccgtagaatgcctttatataaaccaccaacgcgaccattgacttttaacatttttttgaaccttagcaaaagatctcttatggcggtacattcttattaccacacccctgaaggtgggcttaaaccattcccttaagctaaaggtcctggtgttatgccccaatcccagcttcctggtgaaaataacggattacactaacacaaagcgggcttccccttggcctttgtcccctccaccgttttcttaaaaaggaacaaccgggttagtttgcccgccataacccccgaataaggcaacctctccctttttccaaggtaaaaa

SEQ ID NO: 588072 - DNA, 960 bp, Homo sapiens
caacagacaccatggtgcatctgactcctgaggagaagtctgccgtaactgccctgtggggcaaggtgaacgtggatgaatttggtggtgatggccctgggcaagttgttggtgttctatcccttggatcccacggaggttctttgagttccttagggagatctgaccaactcctgatgctgttatgggcagagtcgctaatgggtgaatggctacattgcgtaaatgaaagtgctcggttgccgttgtggatggcatggccgtggtctcatgctggcacaatccctcaaggtggcacggtttgcgcacgattggagtggagactggcgactgtgaaccaagcgtgtcacgtggaatcctgtagcaactttccgcgctcctgggccacacgtgctggatctgtggtgctggtccgatcgacttctgggcgaaagaattcaccccaccagttgtccgctgccgtactcatgacaagtggttggctggtgtgtgcgtaagtgcctctggcccctaacatagtattcacataacgtcgtctgcattgacattgcttgtccacatttactactttagataggttctctttgtttccctagagtctcaagcttatgtatatactgtggggatattatgacggggcctatgagtcatccttgcgattctggctaataaagagaactaattttcatctactcggtggcggaatatacaataacatacaaccaccacacaagaaccgggggtgggctcgtccaagatgattagacccctacgaagaggtccacctggcgtctttaaccgagaatgaatggttgttcagtagttcacaaaagggcgagtcgcctaagatggccccccacgtttccaatgaccacgtggcatttcttccaggcgtaaactggaaccttggacttagggggacaatttgttccgtgttgggcatccagggatagagacctt

SEQ ID NO: 588073 - DNA, 127 bp, Homo sapiens
acggagtgacgtacagaagcttgagaaatgagagtgggcatcgccgcggtcatcatgacgcctctgcggcgtggtcaccatgtttgagtatctctgtcgttggtgctctatattcgacgggtctcct

SEQ ID NO: 588074 - DNA, 207 bp, Homo sapiens
agacaggggtggcagtggtggtgcctgcagcgagccggagccgtcggcatcgccaacccggcggcgtccacctcgcctagcctgtcgcaccgcttccttgtacagcaagtttctactgtgctgtgtggtcgctcggcgacgatcgtgtagccgaggatgcacctggcggtcgtgccgatcggcaaccatcgatgctcgcgaatccga

SEQ ID NO: 588075 - DNA, 642 bp, Homo sapiens
  misc_feature (311)..(311): n is a, c, g, or t
tacaagctttacaagtgggccatctcataattgaaggtttatcagatcatggggttacatggctatcagaaggtttgttctatcacttgagcagccaaggaaaatttaggagtttgacaatgagtttctattgatacacgacgagacaaaaagtactctgcagattttcacgtacacactcatgttttaagagtagcctttttgtaaaaccattatagcctacttccctgttctgatttggccttctccgtccttgatgcttcttctctagttagtgtcagtgtggctttcatcaaagttcgtacgcatanttgtctctatgacttcccgctaatgactagagcctctgttgcatattccatgtaccttcgtgtagatcagtgacaaacgacttgcacaaaagtgagtgccacggaagcgtcctcaaacagaacggctttcacagctgaatataagatactgatgtctacgggaattccccgagaaagcactatccatgcaatagattcagttaatattgtgaaagcacaagctaattttgatagttatcatgaatagagttacccacagagaagctgtaactacatggtgacctacaaagcaggtctgtctgactccatccttgcccccacttcactcagc

SEQ ID NO: 588076 - DNA, 184 bp, Homo sapiens
taggttgtaagtgataatggattaaaaaatagtagaggtgatgatgctaataattaggctgtgagataagttgtgttagatatcaaataatgtgttaataggaaagtcatgtcagtggtagtaatcatcattattggaacaataagtaataacattgagcgtaggtatcagggtaatgtacgta

SEQ ID NO: 588077 - DNA, 228 bp, Homo sapiens
tcatgtcactggttcgaatggaaactgtcacacaggagtgtcagagacagcgtgctgcccaggtaagaccaccttttccggaagttccactatctccccttcctgccctcaactgaggacgtttacgactgcaggatggagcactggggctcggatgagcctattctcaagcactgggagttagatgctccaagcagtctcccagagactacagagaacgtggtgtgt

SEQ ID NO: 588078 - DNA, 395 bp, Homo sapiens
tcccttccgggaaattttaccccaattttttaaggtgggaagttgcaaaccacggggaagttccctttttaattattgggaaccgaacaaaattttagggggttttttaaatcccttccccgttaaaaaaacctttttttttaaaaaagtttttatttaaagccaagttttttgaatttaacgagggttttacagctttaagggtttttaaaaagggcttttttttcacttgatgggggtttagaccttttttttggaaaacccacaaaaaaattttttgggagaggtttttaaaatcatttccaaaaaaaaaaccggtttttggtgcggggttttttaaagggaaaaaaggcccctttttgggtgtgtttttttccccctttttaaaaaaaaaa

SEQ ID NO: 588079 - DNA, 534 bp, Homo sapiens
  misc_feature (13)..(13): n is a, c, g, or t
  misc_feature (17)..(17): n is a, c, g, or t
  misc_feature (22)..(22): n is a, c, g, or t
  misc_feature (44)..(44): n is a, c, g, or t
  misc_feature (63)..(64): n is a, c, g, or t
  misc_feature (71)..(71): n is a, c, g, or t
  misc_feature (80)..(80): n is a, c, g, or t
  misc_feature (98)..(98): n is a, c, g, or t
  misc_feature (107)..(107): n is a, c, g, or t
  misc_feature (133)..(133): n is a, c, g, or t
  misc_feature (142)..(142): n is a, c, g, or t
  misc_feature (159)..(159): n is a, c, g, or t
  misc_feature (167)..(167): n is a, c, g, or t
  misc_feature (175)..(175): n is a, c, g, or t
  misc_feature (187)..(187): n is a, c, g, or t
  misc_feature (221)..(221): n is a, c, g, or t
  misc_feature (239)..(239): n is a, c, g, or t
  misc_feature (284)..(284): n is a, c, g, or t
  misc_feature (296)..(296): n is a, c, g, or t
  misc_feature (299)..(299): n is a, c, g, or t
  misc_feature (319)..(319): n is a, c, g, or t
  misc_feature (325)..(325): n is a, c, g, or t
  misc_feature (338)..(338): n is a, c, g, or t
  misc_feature (346)..(346): n is a, c, g, or t
  misc_feature (355)..(355): n is a, c, g, or t
  misc_feature (406)..(406): n is a, c, g, or t
  misc_feature (429)..(429): n is a, c, g, or t
  misc_feature (449)..(449): n is a, c, g, or t
aaaagttcctttncccntctcnatgataggatcggaagcttccntcctgttgggcatgctggnncaccaanagaaggatnaaaagggcatgcctgtgncagctcgtntggtgtttgtttttggtcctaataanaagctgaanctgtctatcctctaccnagctaccnctggcagnaactttgatganattctcagggtagtcatctctctccagctgacancagaaaaaagggttgccnccccagttgattggaaggatggggatagtgtgatggtccttccanccatccctgaanaanaagccaaaaaacttttcccnaaaggntttttccccaaanagctcccntttggcaanaaatacctccgctaccccccccacccttaagttttttggaaaagctggtgntgtgagccaaaggatgtcagctnccaattgtgttttcctgcancaattccataaacccatcctggggtcatcccacccaaggtttttaggttgctataccaatggctttttaaatgaaaatggcccta

SEQ ID NO: 588080 - DNA, 136 bp, Homo sapiens
tagagaatgcaaacgtgattacctcaagtcactagaatgtagactcagaggtataaagagtgttcactgtacagccatggtgcggtggctcacaccatgtaatcccatgctgctcagagaggatgagtgcagaaaa

SEQ ID NO: 588081 - DNA, 186 bp, Homo sapiens
actttgagaggctgaggtaggaggacagcttgagaccaggagtttaagaccagcctaaacaatatagtaagacccactctacagaaaacttaagaaaaaaaaattttttaatccatgcaactttaatatttctatcatgcgtacatgtacacataacatacacgttcaaatgcagaacataggaat

SEQ ID NO: 588082 - DNA, 367 bp, Homo sapiens
  misc_feature (297)..(297): n is a, c, g, or t
  misc_feature (325)..(325): n is a, c, g, or t
cgcacgtgtgtacatgctttgtagagacagggtttccctgtcttggccaggctgatttcaaactcctgacctcaagtgatctgccagcctcagcctctcaaagtgctggaattacaggcgtgagccactgcgcccagcccgtggagtgcctatttctaagtgcagctaaaggaatgttcatgaaacttatagctggacagctggaaattaacaattcctggggtcactcacccagggagaacaagatttctctagtttgctggtagagattacctacaggctacagaagaaaacagngttatcttggttttcctccctttctttnttcctttcattatagctggacatgatttattgaatgcccatg

SEQ ID NO: 588083 - DNA, 447 bp, Homo sapiens
  misc_feature (283)..(283): n is a, c, g, or t
  misc_feature (390)..(390): n is a, c, g, or t
  misc_feature (414)..(414): n is a, c, g, or t
  misc_feature (427)..(427): n is a, c, g, or t
actatccaagcatttattcattactagtttttctagtgagtggggtatacacagatcatttcagttagttctgttagccctaactcagttatcatgcagtcaatcaagcttcagattcaaagacaatcttttatccagaacattttagatcctaaacctaattttgaattgctcttaatttctattactgcaattctcttaagattgaagctcacaaaactgaaatttatcatcctactcagcaagtggctgaagacacatctacattattctccttggaganctgctttcaccaaggggtgggggtaaatgggataagttggactaaaactaggctgagatgttgggatgggcctccctccagctatccacttcaactccttccccagntttcctccactctactggcaaatnttccaaaaccagnggccgcccaaggccgggctt

SEQ ID NO: 588084 - DNA, 930 bp, Homo sapiens
gctccttgctaccgtcttctcctgcatctggaagatccacccttctctctgtaggagactgcggatcactgctcgagaggcgtccgtggtggatggacccaatctctgtaactggaggctgggagcctccgaagtcccatccatacttctcgcgtgatcttgggtaggctcgtcactggtatctcattttctggagatgtttccgcacgagtcatcaatctggttttccgccgcagccctgagttttgaggcaggggtgccgcaacagcagagtcctctggacctgacaggagccgcagttggaaacccggggagcagagccaggtggcccacggtaccaatggccattcatgtcaccggcggtctatgactatcactggcaacatctacatctacaatggaccagtactgggggggaccaccgggtcctggagaccttcccagctacccccgaaacctccataccccattcccgaagagggggacccctggccctccgggctctctacaaccccaccaggaagatggcaaggctttggacctagcggagacagagcactgtggtgccacaccctctaaccaggggcccatggaacccatttatcacccatgactgacggatgtttgaaacagggcggaagaaggcgggcacaggcacctttcttcctttgaggctggctgccacggtgggattcacaggggcctgagttaggccgggtaagctaagcctacgggattagcctcacccttctggagtggtgcctgtggtcgggtgctccacgacttcctatgcgtgaacggggccggacccaccctgggtcactagcggaggatttactggctacgccgccaaacggcacgcactaaacccaatgtggcacaacggcacggacacgatagccctcaacgtgttcgtaaatatcactccct

SEQ ID NO: 588085 - DNA, 232 bp, Homo sapiens
  misc_feature (105)..(105): n is a, c, g, or t
  misc_feature (200)..(200): n is a, c, g, or t
  misc_feature (215)..(215): n is a, c, g, or t
aatcccaggatcccagacacctggtgtgggcttcaggtgggctcgtgcccttggccctcccagctaagtggttctgctggaggaggcagaccagagtgggacctncaaagcccccacaaccctgggccgagacccccaaaaaaacaactttaagggtgatactatcctcaggaatccttgcaaagtaggaaaattgaacnccagtgattgttttncaagatagctttatgtt

SEQ ID NO: 588086 - DNA, 214 bp, Homo sapiens
taaagggcacagaaatttagtatatcaagtttagtgtgatgaacactatgttacccactgtgaatgaagtacaagtatactactaacaaacatactatcttgctacatatactaacttagatagatttagaattgtcaagttaataccactacccttaataccagagatccaattatgtgcctatccatcatgaagagttctttaattgtttag

SEQ ID NO: 588087 - DNA, 301 bp, Homo sapiens
cagttaacttcggcctggcccaggtgggtgggtgggctctcaaattcagctctgtgtaaaaattttttaacggggtgggctcccaagttccccttttttgtgaaagtgaaaaattaggacaactgtgttttttaaaaccccctttctgtttcccccccatgggcccccccccaggtgggggaggaggaaacccctgcatttgttggctcagggccccagcctgtgcaaacagggggcctgggctgttgtgtttcctgtttgtgccgatttttattaaaggactcccttttggtgggcctga

SEQ ID NO: 588088 - DNA, 352 bp, Homo sapiens
aattaggtcacgcagggtgtgacaggaactattgcatagccaagaaagggggggaaaagccgacaaatatgggcactccaggctctagtggtaagtactgcacactggagtgtaaggggatatcagaaaggagaaaaatcgcgagaaatgcagtatttgagccttgataacagactcatgtctcatctcttgctgcaagcgtggggaatagataacaattttatcaacgagacctgtatacattactcacctattcacctcattcctagccacctttggttgggtgagtataaggaaaaatgaaacaaacttcttgtatgacaggaactcatgatttactatatacatttgg

SEQ ID NO: 588089 - DNA, 456 bp, Homo sapiens
cggcgactctagaggaccccgatcacgtgcattgtgtgatattccccttcctgtgtccatgtgatctcattgttcaatttccacctatgagtgagaatatgcggtgtttggtttttgttcttgcgatagtttactgagaatgatgatttccagcttcatccatgtccctacaaaggacatgaactcatcattttttatggctgcatagtattccatggtgtatatgtgccacattttcttaatccagtctatcattgttggacatttgggttggttccaagtctttgctattgtgaataatgcggcaataaacatacgtgtgcatgtgtctttatagcagcatgatttatagtcctttgggtatatacccagtaatgggatggctgggtcaaatggtatttccagttctagatccctgaggaatcgccacactgacttccacaatggcacgtggat

SEQ ID NO: 588090 - DNA, 437 bp, Homo sapiens
tgtgtcgaattggtgccggtcctcgttcttaagctcaatttgcttaacttggtcaggttggtgttctgctatttccctttgtcccgcacccctaaaggtcaaaaaggaaaatgtaatgtttcaaaggttgtgttcttcggttgttatggggtcacgacgtggttcaatgaagggtgacaaagggttccgtgtcagttaattattagtcatcaggttcaagattcttgtaaaggaccttttgttcctgcgtggagggcaccgagatacgtaccggacggtgactacttagtttaagaattcttggatgctggcagactatgggaactcctctcgtgggagtatcttagaggtcgtagtccggagtcaaaagggtagacattttctgtcggtacgtttcaccctctaggcgatccgaaggtctagcttcagtagcgcga

SEQ ID NO: 588091 - DNA, 924 bp, Homo sapiens
  misc_feature (409)..(409): n is a, c, g, or t
agtccggccaaggttattatgtgcatctgtatatttcttcagtacttgtaaacagagcgagcatgatgcttgtttaatgtcctgttcttaggctcgttagagccagctgttgaaacgttggtcttaccgtggaacggaggcgtggcttggcttaggcacgcttgatgagtaagtgagggatgtctccatctagagatcaccaggcaagagagtaggctgcaccaggtacgaggctaaagcccctggggtaacagtcgccatcgctaccgaggtgaaaacaataaaagctatgtggttgagctcaggcctctcgtgcctggtgtcagagaaggcagagcccacagtaggtgcaggttgcaagggccctgggaggggactggcagggaaggtggtatagatggccctcagnattgcggggcccagagcaggtccccacctctgcccgtccatcttccctggctccagcctcattctctctttagatttaactatgcaaagagaggaggttgagagtgttctggcaaactggagctctttcctggtccttcctgcctccgatggggccacctgtgtcggggcagagtgcccatgtttatggagatcagaggtgtcctcactgtgtggctggagggagctcgaggcgggtagcaggagtctatccctggtgtccctgcgctggcggtcgtaaggggggtcttaagagaccctccgtggatggcggggggcccgacatggactggagtggagggacgggaggtagggccaagggaacgaaagtgagcgattcggtgcgggtaatggtggcccgtgaccgagcgggggggcgggagatcacacgctcgggagagggcaacgagaggcaggtcagcaagggaagggggcagacaccggggggacaccaaaaggggggggaacacggagcgg

SEQ ID NO: 588092 - DNA, 367 bp, Homo sapiens
agcgaggaccgatatttccttagtttattttgaaacctatatgttttgaatgctctggtgtctcttgtgcctttgacttcctttactcccagctcaggacctagagtctagtgtgtgtggctggtgtaactcacccctgtaccaacttgtcagatggctgtggtcccctgggactttccaggcactgtagcaggaagaagcagactgggagcatgcaggtgcctcttcctctggattccagggggcacagcaggacagggaggaagagggtagcaggaggagacaaggggcatcagcttattaccaattaccaggccctttgcaaacacaaagcctccacctaaataataaacgttaatttatccag

SEQ ID NO: 588093 - DNA, 282 bp, Homo sapiens
  misc_feature (178)..(178): n is a, c, g, or t
  misc_feature (254)..(254): n is a, c, g, or t
caaggggaggtcacctctggcttttattcccttctccgcaggcccaggaactgcatcgggcaggcgttcgcatcggcgacgatgaaagtggtcctggcgttgatgctgctgcacttccggttcctgccagaccacactgagccccgcagaagctggaactgatcatgcgcgccgaggnggctcttcggctgcgggtggagccctgaatgtaggcttgcagtgactttctgacccatccacctgtttttttgcangattgtcatgaataaaaccggtgctgtc

SEQ ID NO: 588094 - DNA, 222 bp, Homo sapiens
ctccactctctctttccgtgtcgtgctcccagatgacaaagaagagaaggaacatggtcgtgccaaataagtgtgccgcggccacgtgcagactattcgctgtgggggactgtgcccgatgcgtgccgcaggacgaggccattaagaaattcgtcattcgaaacatagtggaggccgcagcagtcagggacatttctgaagcgagcgtcttcgatgcctatt

SEQ ID NO: 588095 - DNA, 112 bp, Homo sapiens
gagtggttatcggtggatctgaatcacaatcaggaaatagtctttatctgcgtgcaaccatcaatttcaatttttcttcggagcgaattcgaaggaggtgagatcgttctgg

SEQ ID NO: 588096 - DNA, 949 bp, Homo sapiens
agccgcgcgtgaaggggcggcggaggaggagaggcgcagcgaggacagagagatcgggtgtggagaccgaaggccgtaacctcgttggtgaggcctatgtgcggagccccgacatgtgctgaggcactgtgggcgtggacttccggaggaagcctgcagcgcgctgaggaaggggaccactccccgctctcctgggcctcctcagtcgaacaaagcagcaacagcagaggcagtgagtgatgaggagatagatcgagaaggcctggaataatgcaggccgatgttaaatgatgtaaatttcccagctgtaatagcatagggattttggaagcagtctgctggtggacgtgggacatcagtggggcacaagggttctcctgtccctggttcagagctgtgaataggctttcaccgtgtgcgtgttcctcggtgatggccttgtttcggggttgctgtgggtttgaggtgggaagagggccatctgcctgaatgtaacctgataggctctccgaaggccctgcgggcctggctgtgtgtgtagcgtgatggacaggtggtgggccgcgcgtgtgccgggtgcgtgtatgcctacatgtcccgtggctgttgaggcgactgtatgtcagcctgcacccctcccgttgtgctcatagagtgctccttttgaccattttcaaagaaatatggatggcgagctcctaggcctcttggcttacctggtagagggcggcactgcgcgaacgaggtctgcgtgggtgtggattggatgctggggtgtgggggttggaagctctctgtggcccacttgggcacccacgcgttctgtccacttctggttgccaggagacagcaagcaaagccagcagtacatgaagttgctattaaatgacttcggatatttgtgtgcataagctctgtgattactatatcgccgggccgccggggggct

SEQ ID NO: 588097 - DNA, 154 bp, Homo sapiens
agtcagctaagaggttctgatgtggtctggtgcagatgaatgaatcgatggaccaagctgagggcaagggtagcggtggggagagtgagatcctggaaatcttttggagatggagctactggacctgtgcattagaaggatgaggtgttcaagg

SEQ ID NO: 588098 - DNA, 626 bp, Homo sapiens
  misc_feature (117)..(117): n is a, c, g, or t
  misc_feature (169)..(169): n is a, c, g, or t
atcacatcggtactgggatgctggagaagacggtggaaaaatgctgatctccctgaatggcggagcagccgctggtggtcagctgcattgcaagtcggggtgcggaagactcacaanctgtccttcaggactgtgagtcctgcagggcgtctatcgaccagcctcgtgnccccacatgctccgcgctccagcacgtgttctgggggaggctgttctagccttctctcctgcactggctgaagtgacgcgtggcattggccgtggccgcatggtcatcctgcgcagctaccacgaggaggaggcagacagcactgccaaagcccatgttgactgagatgtgccttggagaggaggattccctgcagctcgagcccaggaaggggttggcatcacttcctgcctcaaggaatccggggggctccttgagctttgcagagtcagcaaacttgaatcttagcattcattttggatgctccaggcccgccatcttcaccatcaaggactcttggctggacggccactttggcttgggcacactctcagaaaccgactcgcactcccaggaccgtggctccccagagggtcaccagccagggcctcagctccaggtcacaggaaccccaccg

SEQ ID NO: 588099 - DNA, 261 bp, Homo sapiens
tggggtggcccggggggggggggcccctggggggggggcccccggtttttgggggggggggggggggggtgtttttgggggcccgcccccttgtgtttgtttttcgggggggggggggggggggccccccttttttttccccccggggggggtattttgggggggggggggcggggggggggggtttttctcccccccccccccccttttttttttttttgggggggcgcgggcgggggggtttcccctttttttttttta

SEQ ID NO: 588100 - DNA, 1639 bp, Homo sapiens
gctctgcagtctcgtcgcgggcaggggcccaggcttacctgtcgaatagactgtctactgggttcgaccgagactccctgtggcaacgtctcacgtctgtgcagaggggtgagtcatctctcttcaacatcgccgcaacgtttgcccgtaatgggcgctgcttggtcaacacggccttactacctaccacctgtgtgaaaatgcctgtgagccgagcacacgtgccttactgcaggcacttctgaacacaaccacgtttccatatgcaattgcacccatgaagcgacgggtgggcacttcgacgcggcacagccctccaatttggtccgaaatctgcctttatctcgtgtggcccacttgccggccctgggcgcgaatttgcccccaggctagccaccacgcggcactcactctttgccctttttccgtgcctttgacctcttcggtagcttccccgcgctcctccgcgctcccacgcgggccatgcccttctggtccacctcctcaggcaccctcttgccccagggctccagggcgccctattgtgctccctcgcggccgcaccccctgcgtggggcgccccggccccttccacttccccgggccagctcccctcaatttctgttccgcgccgccccagtgcgcgtggtctctgcccccgccgtacttgcgactctgcccccttttcacctgcgccactccgctttcccctgttggcccttcctccccagttgatacacgtggccgcgccccgttcgctcgcccaaccctggggctcccccggacacgccgctactccctccgcgcccttccgggctccgtgcccgctgccccccaccgtgccgtcggctcgtccccccttcaacgcgcgtccgactcccccaggctgtcagcccctgggccacggcgcctgcccgtcttcacacccctgtcggacgttcgccaactcggcttgggccccacccgtcggtcacactgccgggccccccggtggcgtccactgtgcacccccatactcgtggccacgcatctacacacttctgcacgcctgcaccgcgccccactttcttcgcggctgtgtcaccctcacacctacgtccccaccgcgccctggcaccccttcgaccttgtggcccctcgttgtgtctccccaccctgcgccgcgctaactgtcacaacggcagatcccctctcaccgcgatgaccctgtgtcgccctcgccgggctgtccgatcccttgcgcgcctcgtctcctgacgcacggtcttggcccgcttgttgtgcccgcccctgtcgcgtcggaccccagccgagctagaattccgctgcggtgaagtcctctccccgccggcccgtgcacctcctcggcgctctcccccactgccactccatccggtccctgctcggcgtgccttgtcgtttgcccgcccccatgcttggcgggcgtctctccactcccatcactcgggtgcgccccgcccccacgtgcggatgcgtcgcgtggtgcgccccccctggtcgttcctcgccgaacaccgcctccctgttctgctgcttcccgggtgtttccaccacgcagtcgatccgcgccgccccaccttgtgtccccgtcggttgtccacccctcgcgcgtgcccac

SEQ ID NO: 588101 - DNA, 416 bp, Homo sapiens
cttttgtaggatctgcaaagggatatttctgagtccattgaggcctatgttgaaaaaggaaatatcctcacttaaaaactagacagaagctctctgagaaacttcttagtgatgtgtgctttcatctcacagatttgaacctttcttttgaaggagcagtttggagacagtctttttgtagaatctgcaaatggatacttggagtgctttgagcgctatggcgaaaaaggaaatatcttcacattaaaactaaacagaagctttctgagaaacttctttttgatgagtacgtacatctcacagagttgaaccttgcttttcattgagcaatttggaaacagtctttttgtaaaatctgcaaagggatattgctgcgaagcttgagaactgtggtgaaagtatcttcagatccagcg

SEQ ID NO: 588102 - DNA, 102 bp, Homo sapiens
  misc_feature (102)..(102): n is a, c, g, or t
tgcgcgccacttgccaggcgttgcaacagcaccgcagcgggctacaggcgccaagctataaacgtcggtggtggcctggcggtgtcaagttagggtggggcn

SEQ ID NO: 588103 - DNA, 153 bp, Homo sapiens
  misc_feature (144)..(144): n is a, c, g, or t
cttggacaactggaatgtttcagtttgggaaatctggatgccaaacgagattggggccatgcaaggactatgtggaggctatgtggttgatgttgcagaatgacgagccggagacttcgttatagctactggggaggtccatantgtccggga

SEQ ID NO: 588104 - DNA, 117 bp, Homo sapiens
cagcctacccccagccccgagtgtgcatcccggtaaaaaagctgagggctctcttcagggagcagcccatttaggtttcttttgttgttgttagggagaatacccctcttttttgga

SEQ ID NO: 588105 - DNA, 519 bp, Homo sapiens
  misc_feature (85)..(85): n is a, c, g, or t
  misc_feature (143)..(143): n is a, c, g, or t
acaaccaaaggaggggcgcggcgtttctttttctttttgttttggtggttttttttttttgggcgcccgcgggtttacacaagancaaaaagggcccccccggggttgggggggccctcccactttttccaagggggcggggnttttggccccgtgtgttttttttttttctttcccaaaaaagggggggttggtggaggggggcccccccctcctttaaaacccccccccttttttttttggggggggggccccccctttccccccccccccccgggggggggggggccttctttttttgtttattttttgaaggcccattttttttttttttccccccacccattttttttttgtttttttttggagagaggcgcctggggcccccccccccccccttttttttcccccccttttggggttttgggggtttttttttcccccggggggggggggggggcccgggggtttccttttcccttttttttgcccccttttttttagggggcccccccttta

SEQ ID NO: 588106 - DNA, 148 bp, Homo sapiens
agagcaaggcacatgaggggtcgctgtcactctattgcgagtggcttcacacccaggtggtcagtgcagcggcacggttgaatgaggccatgactttggccacccgcatgcctgctgacctggttaaatctgcaattccacaggggtg

SEQ ID NO: 588107 - DNA, 331 bp, Homo sapiens
gctgtatctcgtgctcttgtctagcttgggaggttccactcagtatcctaccccacccgctccttgcaagggaccagattctaccacagcagcagttacaaaacaccttccccaggctggcacgtggtggctcacgcctgtaatcccagcactttgggaggccaaggtgggtggatcacttgaggtcaggagttcgagaccagcctggccaacatggatgaaaccccatctctactaaaaatacaaaaaattcagccgggcgtggtcagcgggcgcttgtagtcccagctactctggaggctgaggcaggagaatggcgtgaacccgggag

SEQ ID NO: 588108 - DNA, 1212 bp, Homo sapiens
gctggctcgcaggcgtgtgcgggcggcggacccgttcgaggacagcgcgggcgggtcgggtcgcctgtgggctccgtagacaggaggacgccatggacgacaacggagttaacttgaactactttagagatctcagactgacagacgaatgatcctgaccatgtgactcagcacgtggcatgaccactccggaccgtttgactggacgttcttgaacgatgagagtcaaagggagaggacaatcgcagggatcatgacgggcagaaatgctcacacgagtgcacagtaggaacacccgtgtgtgggatgttggaccgtcactactggtgagcgcagtgatccgtcgtgggccagtggagagcatcattgccgtcacgacattgcatccaggtgctgtggccatcgcctgggacatacatcccgatttacctccgaaaattgtcacacagagcagcatcaatgaatgtggaagcggggtgcagcaaaacgttttaatacgtacaaggaagcaacattatcgacgtgatcgaaggacacacacaagactgtgcgagcatcgtgttgaccactagctgtatcagtcaaagacgactggatgcgcacaaataatttgacctccacctgccatacgtcccagaagatggatccatgcagagctcctgggcaacagcaggactgtggagctggccaacgcacagcgcatacaagtgtactagcgtcaaccagagtacacacgacttgactgtggtcagcgtcaaggaacactggtacacatgccgtctggcagcctcaaaagttcccatgttcacatgtaggtgctagcatgctggctgatcggctacatcaatggagaacagcagatcttggtcatagttgagtgctgacaggagtggtggaaaaacggaggcattatacacaagcatggacaccaaacagatgaatgagtgttacaacagaacagaaacaagctgcaaggtggatgacgcacaattcaaggaatgccggcacatccactacacacagacgagtcacaatcgacagcatagggcgaaccccaaggatgacaaatgaaaaggccaagagaaccaggacaaacagcaagcaacaacggagacagccgggaggaaccacaagaataccacacaagaaagagacagagcagaaaaaaggtctaaacaatagacaagaaggcaaaagagatagaacaaacca

SEQ ID NO: 588109 - DNA, 862 bp, Homo sapiens
  misc_feature (39)..(39): n is a, c, g, or t
  misc_feature (115)..(115): n is a, c, g, or t
  misc_feature (157)..(157): n is a, c, g, or t
  misc_feature (198)..(198): n is a, c, g, or t
  misc_feature (228)..(228): n is a, c, g, or t
  misc_feature (254)..(254): n is a, c, g, or t
  misc_feature (274)..(274): n is a, c, g, or t
tcaggtagtcactgtattttatgggaaaacattgatatntattttccttcacagcttgaactgaacacaatattgcccggtttaaaaaaaacaaaaccaaaacattccgaaaatngtccacagcctcacgcctacctggcccttaccctcagctctnggctggggtctcccactatgccccatccctccttccctcanaggctggggtgccagaggtgtggatagaanaagagattctcaaagctggggcaggncccaggaaaagccacttgancgacctgggcagtgaggggaagcagggggtggggggtaggagtaggggaggtaggtggggggagccagatgcaatgaacagaaaaggggaaaaacacccagacgactgaccggcccacatggactatactggtcccagaggcgaaagtcagaacccaagggcacggatcatgctcatccgatgggggagctatgggcgcaggcaggtggccgagggaagaggcagggaaacaggcgcacggaagcacagatgtgaggaaacggcgccaagtcaccagtgaaaaccgggagcgtgctggcggaccaggaccgcacaaggctgctagaacgctgccgtaccctgggggcacctggccgacacacacgggtgaaatggcagggcgacgttacacacatgagaaccacacggtgggatgagcggcccaaaatgtacaccaatcgtaccccaagcccatgaaggcgtaacccacacatgtgagtacgtgaacagaaagtagaagagtcttacaggggcccaatgcaggggggaacagaaagacacacacaagagcacgcacgcaatattacgaacaggcgaacacatacacac

SEQ ID NO: 588110 - DNA, 576 bp, Homo sapiens
  misc_feature (39)..(39): n is a, c, g, or t
  misc_feature (115)..(115): n is a, c, g, or t
  misc_feature (157)..(157): n is a, c, g, or t
  misc_feature (198)..(198): n is a, c, g, or t
  misc_feature (228)..(228): n is a, c, g, or t
  misc_feature (254)..(254): n is a, c, g, or t
  misc_feature (274)..(274): n is a, c, g, or t
tcaggtagtcactgtattttatgggaaaacattgatatntattttccttcacagcttgaactgaacacaatattgcccggtttaaaaaaaacaaaaccaaaacattccgaaaatngtccacagcctcacgcctacctggcccttaccctcagctctnggctggggtctcccactatgccccatccctccttccctcanaggctggggtgccagaggtgtggatagaanaagagattctcaaagctggggcaggncccaggaaaagccacttgancgacctgggcagtgtgaggggagaacgcacgggggtgtgggcgggtgtggcggtgtgggagacgggtgggtgcgggggacgccaagatgtgaaatgtgaccaaggaaaagggggacaaaaacccagagacagacctgtgaacactgtgcgccaacaattgtgagacttctcactgtgtgtgtcccccaagagaggccgaaaagagtctcaagaagagccacagaggggcccagcggatctcaagtgtctctctctcgcagcgctgttgggggggagagtattagtgggagggccgacagcca

SEQ ID NO: 588111 - DNA, 1749 bp, Homo sapiens
  misc_feature (305)..(305): n is a, c, g, or t
  misc_feature (1446)..(1446): n is a, c, g, or t
ggaacgcgacagcagggctgcgggccctccacgtgaagcttccacatacgtggggactggcgacgagattggaccgtggcaacgcaagtggacaacttggaggaatcatatcaacagtactaacatggtctgcagatgtatacttacggggaagaacggtacagccaatgcgcatgaaagacatgatggcgcagcatacacctgctgcccatggcgctcagccaacgcgggtacgcgtcattcgatgtgaggctgcgtagaagactgatggcaatccatgatgcgctgggactcatcgactggcntactttgtactataccaggaaggcgaatcatgtacgggagttatgagcgaggaggctcgtccatctaagggcatgatcgataacttgttctatcctagtttgtgcgtacgccgagattaatactgtttctacaacccgtggcacgtgtccaacatcgattggttccgctccagtgtgcctcgtgtgggtgtgtgggctgaaggcgagtgtgcgcttgtgccggtaacacgcctcgaaaaccattccataatgatcctatggcctcgccacatcgacatgggggcctgtagcacagactacgtcctatgggaaccttaatcggcgggcataacgcagcatttgcgtagggtacgttaagggtgacaccccatgcgcggatgcgttcgcgtgcatctggtgagaacctttccttgggggctcaatgtcctgtctcggtccctatgtagttgggggccctttgggtctatggcacttttgggcgcgatccacgtggcgttggcgggaatgccgaagtgggtttatcaaatcgggatggcgttttgacccctacgttagctaggcctcgaagggacgttttcgaccagttgcactaggcatttccctaatgaggcctcggttgtggccaaaggcgcggcttcggtaactctataacttgggcgcactccatgcggagcggacgtacagtcccagttgtggggaagagaagaccatttagattggctttttccctagagacaacttcgctggagggcggcgcaaacgcatctgtttggcattgtggcgcccccgttaaaaagttcttttcgcagtccaaataccttttcacacactgggtcggcacaccccaaggagcgtccaacatgatcctcttcaatcctttacacacactttacagttccaaaccggtttcccctgaagaaacatgaaagggggcgggaccctatcggaatgaagaaaaccgcgagtggcggggcgccacacagggacaaggagggggcaggcccagtcacacgagatgaacaagcagacgccccaggaaggaggggtgcgccaacacgcccgccaggggggcgaagagtgcgcccagcgatgagataacaaatagccagaagacatatgcagcagcaacaggagcaggtcnccgcactcagcgcctaagacaaaaacacaaccgcgagcgaagggggcgaaagtgaggagacacacagtcgacgacgtagaaagaaacgacgcgcgcagagaaatctcttcagcgccgcgtgaacaacatattacactcggtacttccctgctcgtcattacacagactgacacgagagcaaaactgatagcaatagaacagaacaccacacgcaagtaaggttgactaaaacaacttcgtcgctccgctacgcccttcccacgttgagtcactcatcaagaagaagaaagagaaagagggacc

SEQ ID NO: 588112 - DNA, 128 bp, Homo sapiens
ggtggctattgcggtgccactggtgtcggcagaggcttaggctgggtggcggacgcagctactcctatggacagatggtctatggcgttggacggtggctatcagttccacgcagctggcagagccat

SEQ ID NO: 588113 - DNA, 995 bp, Homo sapiens
  misc_feature (490)..(490): n is a, c, g, or t
  misc_feature (519)..(519): n is a, c, g, or t
gctggagtttggggcacagtgaggtactgcagcttcctccacagtccggcatgtggagcagcaggacctgggcccttctgcctgggcaggagaactatatagtttggtaccctactcagagacatctattttgctgggctccaatatcgcctagacatgcgcgaccaactgttagactagtagatgttcacataccgtgtactagtgcgtttcgtctcgcttatggagactgtcctaggtgggcgcgctaggatccttgtatcattgccagacggtcccagaagctacaggggctcctatggctagagtggagcctaggagttggggcccctggaggccctcgtgcgcgcgcgctgcctggcatcttatggctcgcgcatggccactcgagtcgctcgtgcccctgttgagtacacgggacatggccatgggtgctgtctcgtgctgtcactatcgccgtcttaaaggagagcgatggctcatatagcantcacgggggatcccaaggcgaacttgggngcatgggggcttggggaccggtatcggggttgtcacccattggttgggcgagattgtgggaggtagatagcgaaggcatgcgctggaggtatcgccccaactggggcccatggatgccatcttgactttttaggggaacacccttgatctacaggatagggtctagctgatgttctcgatcatttcacatttggctcccattaggcccccaggggggcctcggatttccctagacggaacctcgttgttgccatccctagttgaacgtcaacatgggaatgtggcttagaggggggacatgcccttactgttcccttctttcgaggatggtttggatgggggaccaccttaatgtcttggattggcgagtcacctttataggagtaaaaggggcgtcgtaacgtaaagggattacatcccttggatgacacgccattggtgggcgtcatttggtaaggggctgtcgtgggaaagga

SEQ ID NO: 588114 - DNA, 341 bp, Homo sapiens
cccaccctaatatgtaactaacctgcacattgtgacatgtaccctaaaacttaaagtataataataataaaataaaatttggaaaaaaaaaaacttcctgggctcggccagacgtgggggttcacatctgtaatccgagcactttgggagaccgaggcaggaggatcacttgaggtcaggaatttgagaccatcccaggcaacaaagggagaccttatttctactaaatacgtgcttacatacatacatacatacatacatacatacatacatacgccaggctgcatggtggcgtgagcctgtagtccaagctactcaggaggattgcttgagcccaggag

SEQ ID NO: 588115 - DNA, 382 bp, Homo sapiens
ggcgaaggctggtcttgactcctgaccttgagatcagctcacctcggctcccaaagttggaattactggcgtgagccactgtgcctggccgacgggatcctttataagagaggtagtgtactgaaatgaatcttaaggccagagaataaaagtttgattgccatacatgccaaggaatttatatttatatccagaaaccaatgtagagccattttagaaatattctaaactggaaagtgacatcagattttccttttatttttattttttgagacagggtcttgttctgtcacccaggctggactgcagtgacattaacaaggctcactgcagccttgaccccctgagttcaagctatcctctggcctcagcctcctgtata

SEQ ID NO: 588116 - DNA, 226 bp, Homo sapiens
ctcttactatgtgcccaggctcgtctcaaattcctgggctcaagtgatcctcatgcctcctaaagtgctgggagtaggaggtataagccacctcacccagcctgattcactatactatttttatttttatatgagatggagtctcgctctgtcacccaggctagagtgcagtggtgtgatcttggctcactgcaacctctgcctcccaggttcaagcgattctccg

SEQ ID NO: 588117 - DNA, 697 bp, Homo sapiens
  misc_feature (1)..(1): n is a, c, g, or t
  misc_feature (73)..(73): n is a, c, g, or t
  misc_feature (99)..(99): n is a, c, g, or t
  misc_feature (135)..(135): n is a, c, g, or t
  misc_feature (137)..(137): n is a, c, g, or t
  misc_feature (151)..(151): n is a, c, g, or t
  misc_feature (157)..(157): n is a, c, g, or t
  misc_feature (163)..(163): n is a, c, g, or t
  misc_feature (171)..(171): n is a, c, g, or t
  misc_feature (173)..(175): n is a, c, g, or t
  misc_feature (178)..(178): n is a, c, g, or t
  misc_feature (180)..(180): n is a, c, g, or t
  misc_feature (183)..(183): n is a, c, g, or t
  misc_feature (189)..(190): n is a, c, g, or t
  misc_feature (195)..(195): n is a, c, g, or t
  misc_feature (204)..(204): n is a, c, g, or t
  misc_feature (206)..(206): n is a, c, g, or t
  misc_feature (220)..(220): n is a, c, g, or t
  misc_feature (352)..(352): n is a, c, g, or t
  misc_feature (357)..(357): n is a, c, g, or t
  misc_feature (361)..(361): n is a, c, g, or t
  misc_feature (390)..(390): n is a, c, g, or t
  misc_feature (412)..(412): n is a, c, g, or t
  misc_feature (415)..(415): n is a, c, g, or t
  misc_feature (442)..(442): n is a, c, g, or t
  misc_feature (601)..(601): n is a, c, g, or t
  misc_feature (603)..(603): n is a, c, g, or t
  misc_feature (606)..(606): n is a, c, g, or t
  misc_feature (695)..(695): n is a, c, g, or t
ngcgggaggggctcaaacactctttggtgctccagggagcttggatttacctgccaaaagtaaaaagtaaacncaggtccgtgggtgtgtctttaaaanacagccaaactggctgggctgtcagcagaaaggagngncctggacaggaggnggcccnggtggncgcccaangnnncgngngcngggggnnggggnctctccggngnggcgcgcgtgcagnggggagaccttgcctgcggggccctgcccccaaggatggtgaggggcgctccgacaccgatcagcctgggcctctgggcacaggttgacatctgggggttcctcaggccagaggtggcgggcttgggcgcgncccgncctnggccgcggggggggggccggggcgggggnctggggccatgccccccgtgcnccnggcctcacgtggactccagcgtattgngtgggacaggttgtggttggtgggcgtggaaaagtagagctgctcactcgacgcgtggttgtcgcacgggctgcttagccccagcgtccgctcaaagtccagcagctgccccatgaagttgaagttgggcgagatgttggactttttcctcttgacaantngtnggcgtcgttgagtgacaggttcatcttctgcatcagataggccacagtgaccgtcactgagcggctgagcctgccaggcagtgcaccanga

SEQ ID NO: 588118 - DNA, 117 bp, Homo sapiens
ttttttaaaggaaaaaaaatttttttttgggttttaaaagtcagctgtatgagccgggggggccctatcataacctgctgatatgatagaaatccattaattttttcctttccggga

SEQ ID NO: 588119 - DNA, 402 bp, Homo sapiens
gatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactgggcggaaggattcttggaagcttgcacttagtttcccctgacttcaccccatgtgtcttttttcctttgctgatttgtttgtatcctttcactgtaataaatcatggccgtgagcagaacctgctaaaacaaacacaaaacaaaaaacaaacaacaaaaagag

SEQ ID NO: 588120 - DNA, 341 bp, Homo sapiens
ctcgttcttggatggccatgactggactgccgctcatccgtccgcctcgggcagcgtggcttgcacgggcgcatgcgcgttgatcagactctggatctcctcaatgctgtggaccatgaacatatcttgcagatcctccatagcgccctccatccaattgttgaaaggagcagccctcttggcaaactccaggtgaagctgatcaatggtttctagcaatttctccattctctctaagggcttctctcctcttctgagtaagcgttcccagtcggtcccactggtccacaaattttctggcaccgatcattgacattcacagaggcgtaaccgagctcgaa

SEQ ID NO: 588121 - DNA, 274 bp, Homo sapiens
tactgaaactgaaagtgtattgaaaaagctgattgcaaaatctcccttagctccgtagcattatataaaataccggaatccagttcctgccggcattacctcgtccagctcaatgtgctgtacgtccatatagtattcctgtgcaagctgttgtatatctaatgccgggcttatatccatatttacaggcggaagctgtgctgtatcgccaataaatatcattttacagttgtcgccattatatacatagctcattaaatcgtccagcaccgat

SEQ ID NO: 588122 - DNA, 136 bp, Homo sapiens
atttctgtgcggtatcacctgggaacggaattgctaggttcttggatagatttacttttttttcctgagacggagtctctctctgacgcccaggctggagtgcagtggtgtgatctcggcacactgcaacctctac

SEQ ID NO: 588123 - DNA, 1145 bp, Homo sapiens
ggtataaccctaatgatgaatgtagctccgagtcatgctaagtccttccgcagtgctttgagtgaaccgggtgatgctggaacctgtgggttgtaacttgcgttggactgtagaggagccgttgagctgtatcgcagtttccgcgatcccgaaggtcattttcaatcgcgactcgcctctagagctcacgaaatccgccgtcgtcgagaagtcagacgagtgcggtagttcgcctctgtgcttgcctcgtttttggactctagggtactgcttgtactcttcggtaccgtgcgcggtacgagtccttcttcgatcatcgtactctttgtgtccccttgcccattgactcgtatctgagcctctatttggttgtcttgctggttgccgtgtctccaggctgaggctggttcacattatgcccagttgccgcttgcgccagggtcgtcaggtgtgcgcgtcggtgttcgagcggttttgtagctctcgggagaggtagctcgtggccctgcgtcgcggtctggagctgttcaagtggttccagggaacgcgtgagccaccggtccctcccgatctttcgcgcagttccttcctgaggcgaagttgcgtccgatcggtcccccggtgcgcgtcgtgcttatcttggttggaggcccggattcgtctttggcccgctattgcttgcccttggtgttgcctcgcgcggtgcttgtggcttgataggtggtaggccttgttccgtgggaccctggggcccctggcatacgttttccggcacttgttgcctttagaaggctggttcatgagtggtgtggctatcggatgcactggctacatccttagcccgagctggagctgctaccgggggaagttgcctagggccgcattatgccattatatgaactaaagtacctaatgccgacatttgggaagggactttcggccgttcgtatagagatcaagtgcctcgtaaacgaccgattcgggaaggataggtcaggcgtgtcacatgggttacagaagaacgtaggtcaaaaaaccgattatgggtacgtacaataagaaaacacgctgaggaaagcaatcatacacaaaacaccgtgcctacagacctctcaaattttccttttctttactttctttctatt

SEQ ID NO: 588124 - DNA, 1040 bp, Homo sapiens
  misc_feature (499)..(499): n is a, c, g, or t
ctagatcgcgagcggtcgccctttttatttttgtttgggtctttatgtgcattaaactaacgcgtgaattataagttagccacacaaataaggagagtttaatttttttgtatggtggcttcatctccaaattcgagcgcgtggttagggatatatttctcctttcatacgagcacttttccgtgattttggcagtggttctcattctcccaaagataggtcatacctttagttttacacctcaaagggtagcacgtgtggtgggacaactttactgtgcaccagaaacagcgggcctggcaaagagggtggcacgagagggggaaaaggctgtgttccccctcttgtggtcgtgagcaataaactcgaggtgccccacaaccccgagaacacccgaagtatttctcgtggaacacattttatcttctccttttctataagaagcccggttttgtgataattcccaatccattgaaagagctccatccaagttctacanatttctcgcctcgctcacttatggggcggttctacagagacaaaagagctcggtgcttgtgcgaccccccactggggcaagcctgtggggagagacatgtgcagtgggcatacacagagggggcgtggcgcgtggaacacccgctctgtgacactgtgggacccaccttctcggtggccagatcagaccgagcgagcgtatccacgtggcgagacgaaaagctctgtggggccacgtgagcgcaccaagaagcgagaaggggcagtgtataacactcggtggcataaccaacctccccatgtggcgtacacccgagggcgtccaacccaaggggggtgtacgccttctgaaaggcagcacaaccgcggctacaacccatataaacacggggaaacacaccccagaaagcgccgagcggaaaaacaaccgtcgtcagcacaacataaacacacggggtggacactgacgccccacaaaagagctccccggaacacagtcgggactcacacggggggggagcacaaacatcccatcggggcag

SEQ ID NO: 588125 - DNA, 463 bp, Homo sapiens
cacattttcttcactccagtctatcatagctggacacattgggtttgctaccaagctctccgtccattgcgcaataacagctagcaagaggcatacgtgtgcatgtgtctttatagcagcatgatttatagtcctttgggtatacacccagtaatgggatggctgggtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgattgccattaaactaaagagcttctgcacagcaaaggacactaccatcagagtgaacaggcaacctacaaaatgggagagaattcttgcaacctactcatctgacaaagggctaatatccagaatctacaatgaactcaaacaaat

SEQ ID NO: 588126 - DNA, 422 bp, Homo sapiens
gcccagtgtgtgcttgcagctcactttgttgaacttctctttattggaagagatatcatcctacttctatcggaagcatttttcagttctgagcattttcgaaaccgttatctgagacagagtttaccatgtgtaaaatgttcccaccttccttcatttccctcaaatgaaatcacacgttctttaccaccatctggagggaagtatttgccatggtgcttactgagtctgtctttgcagtgtcacctgtaaagttaaaacttctaccttacctggtatttcctttgtttgtatttctgcttaaatattaatcatgtcccctatttgtgaacataatcctttttggttcaaacatcttgcaggtagaatcttaatgtcttcaaaaatagcctggagcccttaggagtaatatgattccacaa

SEQ ID NO: 588127 - DNA, 229 bp, Homo sapiens
tgtgaggaggagaaggaggcagggagtagtatgatggacggagagagctggacagcccgtgggcactcagagccaagttggatgtgagctggtctggagaagagagaaatgcagaggggagaggagagagagatgatgaggggagtgagtgacggctgcacctatgcaggcggtgggctcggccttaagggatgaccaaggctggcttgcaacagttgacgcaaaggac

SEQ ID NO: 588128 - DNA, 102 bp, Homo sapiens
cccgactagcccgacagggagcctcccaggagcccgagtggcaggtacatgcacattggcaccatggtggagtttgcttttgccctgctgggctggtcgggg

SEQ ID NO: 588129 - DNA, 669 bp, Homo sapiens
  misc_feature (15)..(15): n is a, c, g, or t
  misc_feature (22)..(22): n is a, c, g, or t
  misc_feature (27)..(29): n is a, c, g, or t
ttcatgtgtataggnatatccnccccnnncgggtaattggaatcgttgaccaggtctcgggcttgtctggatcacggtccaggaagatctggccagtgggattctactccctggctgtgcacctggtgtatccctacccctgtctacgtcggctccgcacttcgcggcttgagactaaaagagcatccctggcagggtggccttccatgccccaaagcagcctgtccagatgacccccaaattctgatgctgaagttgtgatggcctcctggggatgttctatctttaatcttttagaatgtggttagagcgggttgaggctgcctgaccccagcctaatggggtaggtagtgccttgtggaagtgtgagcatgggggcaaaggatccaagcattgagccttcatacctctattccccataccagtggggtgccgaggctcagtgcagcatgacgacggagacctttgtgaaggatatcaagccctggtgatcaaagaatcttgaaccttactcttacacttgtgcctggacgacagtgccgagatgacccaagacaacagtgacggcgcatgagtgttctggaccttgcaacagttggcgtgacaacaacagtgcagacatcaactatctctgtactgggaacgaatgtcaggacaatcctgatcccg

SEQ ID NO: 588130 - DNA, 183 bp, Homo sapiens
gatatccggaggtaagacacggatgctcacgtgtcgacggaccttgtacaggcaggcatgcaccgcagctggtgaatacacgtcgaccaggctccatctttacgatattatggacgtcaacacggtgctcacgatatcgacggaacttgtccagggaggcatgcaccgcagtggtgaatacac

SEQ ID NO: 588131 - DNA, 83 bp, Homo sapiens
  misc_feature (2)..(2): n is a, c, g, or t
gnttttttcaaaatatgaacttttatttaaaaaattggatgttgatgtatggcaaaaccaatacaatattgtaaagtaaataa

SEQ ID NO: 588132 - DNA, 101 bp, Homo sapiens
ggagagtgacatcatagaggatcccgggattgactacttgtgtcgacggacctgatccggcaaagtcgtgattgtgatgcagcgtcacgaccgtcgtgatt

SEQ ID NO: 588133 - DNA, 1311 bp, Homo sapiens
  misc_feature (693)..(693): n is a, c, g, or t
  misc_feature (1311)..(1311): n is a, c, g, or t
gctccaacatcgattggacggcggataaatagcctttgtcatcagtgacattaagggtgttgggcgaagatatgctacatgttggtgttgaggaaagggtgacattgagctccaccgaaggaagcggccgggatgaacgtctagcttgagcgacttgatgagcttagtgagactcgtagtcgatcacctagtctaattgcagtacaatccgacgccaggtagccatcgaatctccgatgacttcggtgctctttgaactacagaactcgaatcggattcgtaaatcgcgatcggatagagcctagcgatgacgcaggggattcggttaggactcgaaaattgcgctgcatgcgcaccaagacctaaacggcctacactgattggatattgaagccattgaggaatgcccgtaacactggtaacagcacagcgactttcagggggactcgcaaattaaaggaaagaggggcatttggctgctttcaagcccttagtcgtcgagaagcagcccctttttaacacggttggaaaaccctcgggatggtggcctgctaaaagactaatctaggacccccataaaggtatcgcaatcgttttggaggacccgcgcgtccagttttcgtgacccttggagggcccggggtattgtgacgttttgtatgtgcacctaacgggaaaagtcgaaacaattantatctccatgaagtgaaaggaggcgcgtttgggctcgtttatggtttaaagaggttactacgagttagccggtcctgcaatttagtatagcccgttaaacttaacaatcaaaagtcgggaactttaaaaagcggacacactttctgatgaggatgggcgcgaaattcacaatcttcgccgtgcgcgttgcgatgcgtcgccggtaaaaagaagaccagcaggggcgtttagactcgggcacaccctggggccgtgtaggaaccccaggggaggggggtccctaaccataagagagcgaccagacggtagataactgaaattcggggcgacagggggggaccaaaccccttctaaaatagtttcccggccaagaaaggcgatataaggtgtttttacccaaacccaagaaagaagtaccgcgggcgcattctaacaaagtttaaaccggtttcgccccattcccgaggttgtcggaactttcccccgcgtcaatgaacaccgatagttggcgaaggttaagggaacctcaaggtgtcaaagattccattcgccgccaatactcttttgttgacagcggcgtgtctttaaaccgtatgtcgttacggcacgttgaacggn

SEQ ID NO: 588134 - DNA, 735 bp, Homo sapiens
agcggttggggctacaatgagccatgattgcaccactgcactccagcctgtgcaacagaacaacagcctgtctcaaaaaaaaaaaaaaaccaaaaaaaaaacaaaacacaacgcaaaacctggtttaatgtaatcattctccatgttgagcatttggtcttttctaattaggatggcgattattcacagcgtaaaaagtgtgattcttctttgcacgtgcattgcattatgttttccaatagtgtctacagtggcaatacgtgtaaacctttgagtaacacctttggggacccacaataaggtgccatttagtgatgtacggaaggtggtctcccaaaaaagcaaaattgatgggcgtttataaggaagagaatgtttaatcccttgatagggaacaagattggagatctataggctggcagttggcctggccatttcaagacaggatggattcagtctttggtaaacaaatggatataaacttgacgggtatcaataagtaccagtacaggcacttattaacggtacttgcctccttagtgatgtcttggtgaagtaagccttttcttaagcttcttccatcggtaaggaattacggtattgtaccacattaaccaattagaaacatatttttacttgccctggttactcaggtcaaggagtccgggtgacataaccagtctaacgttcgggggagtaaaagacctggttgccaatctttgactgtgtcagggg

SEQ ID NO: 588135 - DNA, 337 bp, Homo sapiens
taggaggtatgaaggcagctgcgggctgagataggtggggcagaggatgtcggaactcacaagcattgaagaggccttcctcgcttaaccctgcatgagatgagggcagcagagggttctgcgcagcgacgccagccacgcatgtgccttggttttacaaagggtggctctggagattctagagcagagagggcaccagcaggcagaccacgacacagtgcaccacgacacagtgcaccacaacacagtgcaccacgacacagtgcaccacgacacagtgcaccacgaaacagtgcaccacgacacagtgcaacaagaaaacagtgcaccacgaaac

SEQ ID NO: 588136 - DNA, 404 bp, Homo sapiens
  misc_feature (5)..(5): n is a, c, g, or t
ttttnaggattcgaagttactaagacaggaccttaaggaagtcagtttgacctcatttccaactgagagagtccatagatgtcattcaagactaattttctgattctaaggaaaaagggaagtctttttttttcttcctctctttatttttgaatgaataatgcttgacatggacaacacagacttttagtgaagacagagagtcctagtgatgaaaccacctttgcaaaaattacaactgagaaaattatgacagtgaaagagatctgacctaaccaattccatcttgcttctaaactctgtccttgttcattcctgggcataggcagaactaactctggaaggaacttagtttatagtgtaactttgaaacaaagatgataacagctcattctgaaaacaaa

SEQ ID NO: 588137 - DNA, 1091 bp, Homo sapiens
tcctacccttatatacttatgtgtgtgtgtgtacttgtatgtatgtatgttacataggtcatatatatatatatatatgttcaccaacataaaaacaaaaaatgaacacaggtccagacaggcgagctataaagagatatagtgagaataaatatacatatatgtgagatagaggggaaaaagagactacacaacgacaacattctaacataacgaatctcagatatcatggaataatagttgacaaatagatcaagaacgtgctgcaggaagatgtcgcacgcgatcgaatgatgtgacatctaaataagtcaacaattaacatataaataagagggattcgtgtaaccatatactaacttgtctaacaatcaacatacatcgaaatgaagatccgtataaagagacaagagaacaaaaaataataacctattataaaccataagacatagaacaaagagacgaaataagaaataagatgaagggaaataacataccatactgactttactatacccaactaccataaaaacaagaggagacacagacgcacaatagatactacaaaaacggagaaccacactcaacgccaacaccacccaccaccacacgacaacataaagcaccaaaacgaagacaagcagaaacgaaatagaaaaacacaacaccaaaccacgagaaccgacaagcacaccaaccagacaaaaccaaccaaaggactacaagttgaaccaaccaaacactcgatgaacgagcacgcggaaaaagcaaataacaagaacggaagaggctgcgatcagaaataaaaagatgtgacgtgatgtatgagacgatcaggcgcgcggaatgagaataacgacagagaagggaagaaagcataggagatagaagaaaagagaaagcaaaatctattgttagagctatcaataagtcaaagtagtaatgaaaagaataacaagttcatgaaaaacaaaacgagataattccgatcataagactgagcagatcagaaattagatggtctgtatcatatgatcaatataggtacaatacgaaagattcagtagcaaagagtgaagctacgatgataa

SEQ ID NO: 588138 - DNA, 849 bp, Homo sapiens
  misc_feature (254)..(254): n is a, c, g, or t
gcgtgccccccccagtctggcccgccctcggttggaaaaagtccttcccgtggcgggaggtcctaatttcgcgccccgttgtagggttctccctcggttctcttctcccccgcttatggagtgcgctccgcccgcgcgccgtcgggttcactctccggagctttcgtcttcctgcgagacctactctgcactgggttccggtctcactcgctctctggtggtgactcctcgctcaccctcacggagaccagtgntcactctctctcggagcgcgcgcaagggcttgcgccccgtggccagtcccacggacccccccctgttgctacaccattcgcagcggaccaacccggtttcctggtcttgccccccgcacacggcctgtctacccggcggtgcttttcccatcgacccggtgtttacctgcgcgcacgtgtacttgctggatatcatcttctgcccccccgacaaagcagaagcggcggtgccctgtttctccccagcgggcacacgcgagattggatcacgcttcgaggactacgggtacggacgcctcctgagcaaagtaattatcttctcgcttctgggtgtcctcccacgcaccctcatggtctattttggtgcgcagctcaacgccccccaatcgatgttggtcagcgtcgtcagcgctcttgttctatctcgcaggtatgcgcgtcgcctcgcgcgatgtctgttcatggacaccacccattgcctcgcgccgctatcacgtatctatggatctcaacgcgcgggctctatgctcgccccacgccatatggtcatcatacattaaaagagagttctaaacaacaggcacaacataacaca

SEQ ID NO: 588139 - DNA, 133 bp, Homo sapiens
atcttctttatagcttattttccttcttcatacccttcccctcaaactaacaaaaggatttaattttacagcataaaagggtttataacaatctttcaacaataaggcttttccaataaagaaggagaataag

SEQ ID NO: 588140 - DNA, 393 bp, Homo sapiens
  misc_feature (275)..(275): n is a, c, g, or t
  misc_feature (361)..(361): n is a, c, g, or t
tcactcttgtcacccaggctagaatgcaatggcacaatctcggctcactgcaacctccgcctcccaggttcaagtgattctcctgtctcagccgcccaagtagctgggattacaagcacttaccatcacgcccagctaatttttgtatttttagtagagatggggtttcaccatgttggccaggctagtctcaaactcctgaccagcggtgatccactcacctcggcctcccaaagtgctggaattacaggcgtgagcaccgcgcccagcctgtntttcatgttagatcataatatgatctcaccagatccttactgaaaatgtaccttattacaagtagctaaatttccacatagagggntaaaaagattggggaatcaggttatgactttt

SEQ ID NO: 588141 - DNA, 1836 bp, Homo sapiens
  misc_feature (272)..(272): n is a, c, g, or t
  misc_feature (313)..(313): n is a, c, g, or t
  misc_feature (323)..(323): n is a, c, g, or t
  misc_feature (593)..(593): n is a, c, g, or t
ggcatctcttcgacactctgtgcctgcctgccggcatccgccgtctcgatctctcgtgccaggctcagcccatgcggatcgatacgacgcatctccgtcccgtggctcaaatgagtccaatgcgactgccggactatgctagacgatgtggctgcgttatatatggatgggcgatcggaccagactttccactccggatgaccagctcgattattcatatacacgagtgctgctgccgcgtgacagtcccactccaggaaaacaaccaaagngggtcagataccatttgtgctcgtggacgaatagtggggcnctatgacatngtgtaaccttcccttagacgatagagcgtcgtccctgattgggcctcgagagacagaccaacttgccgtagcgcctgtccattgagacaccgggagacgggtgaacaccacagatttgagagcagattgagcagtacggtccacgcaagccttgtggagcgagcacttggagagataccgaatccttgagcgagcacaaacgaaccgtttcgtaccacatcagaaggcctgccgccggttgggctcctcggagagagtgtagagcaagcnccaaagttgcttcgcatgaacgcggaggggcgctcccccgatgataaccgaccaaatgtgtctcaaaatcgaggaaagacgacagaggaattgaaccttccatgcaatcttagtgcgttgtgtcgcatggacaccttttgctagagcaaagccaccgcgggtacactagttaggttaaccagtttggggacgcctagttccgcatggcggctccggatttgaccttggttcccccctttccttaacgggcccttccttgggtggcctggccaaagcccaactttaggggcaaattttgttcccactatggtgaaccttccgtttgggtaaacgaaccaggggggggttaccaaacctccgaaaccgagcactggtggttagagccccccgaaattcctttaacctagacaggggggtctttaccagtgacacatccttatctcgcgcccccgatcagcgccctaattacccctttaggcctgtttccctctggggcacaccccttggggcgttacgagggcccctgggggagaaacgcctttggaacgctggaacatttaacacccttccaatttgtcacaaggacattcccctttccaaactttgggaaggccggaaaagtggtgcttttaacacagggggtttttccgagcccaagcccctaacgggggggcccggataaggccgggggggcaacacactatgcctgtttgggccgggccggcaaccaatttccacaaggcgcgagggaaacaagcccttggggtgggctttcacagagtgacggaccccctatcgggaacactttttcgggaaggcccaaggggaaggaatagtgggcccccaccggggcccggctgaaattatcccatcacccctgctgttttccttccttgggggaacgaaaacgcaagcgctttacacgaagaggcttgggcccccggaattagtgggccgcagagtgccacaatcaacaaccccattttggttggcaaattgagagacggcgtgcaccacggggaggtccccagggaagagcagcgcttagtttccacaggcccttatcctttatcccatgcgcggatataggagaacatctgtcgcggggtcatcacacggagagaacaccgtttaagtccccagtcattgcaaacatgtgttcacactgggaacacttcgcagagaaaacattgtgtcagcaagaacacagggaggctgctgctgcagtgggcgagccacacca

SEQ ID NO: 588142 - DNA, 211 bp, Homo sapiens
  misc_feature (143)..(143): n is a, c, g, or t
ggtcgagtcggacagaacatgtagctagctgagatattttgctcatgtgtaacaattatatagagtagtagatatgttgtacagaaactataagcttatatatgtactagtacactaacactctaaagctatataaagatacnaaataaattgagcgaagtgttatagacacatttccaaataacagcactaatttatgggacagaagatg

SEQ ID NO: 588143 - DNA, 122 bp, Homo sapiens
aataaaaaacaggtccaataagaaacaggcctagagattaattgattcagggccatgaaagtcgaaaacgaatccactaagggtttttgttgttgttttgtcttttctgtgccccgtggcaa

SEQ ID NO: 588144 - DNA, 223 bp, Homo sapiens
ttaaggatatctgtatttactaggggtagaaagatgtagccgagtttcttgccgacctcatggcgctacacctagagctaacgtctttacgtgggtactggcgcttacttagaaacctacatcagggatagctgaagatggcggtatataggctgagcaagaggtggtgaggttgatcggggtttatcgattacaggacaggctcctctagaggggtatgaag

SEQ ID NO: 588145 - DNA, 231 bp, Homo sapiens
  misc_feature (181)..(182): n is a, c, g, or t
ctatttagttgatatataagtggcgcagaaaactgtattacgacccttagaaatcagttcagccacaattataatatatatattgaccaggataacggaaatctaaccaagtcaacgtacacgtattgataaatcgaagaagagctgcaaggactagtcacgtaattaaacacagcacctnngcaatccatgttgccaccgcgtgaacgaacgcccagcgagcatatgaaa

SEQ ID NO: 588146 - DNA, 395 bp, Homo sapiens
agcaccacttaacctcacctatgggggttggctctcctgccctgtcacgactacttggacatctttagacatgcttccatcagaaagcaagttaacccactccggggacagccctgcaaggcccagaagctgcaggagtatttacacagttaaccagcatactttatttaactattcctacttcaagctatttggcagggaagtggggcggataccaccctagaacaaataccaattgtaagcttccctttcacattgccagcaagcagatcttttccaactggggagtaatatcctgttagctatgtttaattcctatttacctgggggattgagagtaccaaatgatttcagctgctcaggcattacatttcgatctgtcctctccttctgcc

SEQ ID NO: 588147 - DNA, 463 bp, Homo sapiens
  misc_feature (3)..(3): n is a, c, g, or t
ggntaagaaaaaagtgcgtgctcttgatgtgatatacataaacatctcaatgccttaaagagcagtatgcctccagcatgtctcacctccagccctaaggcggttttctcctatctcagtatatggaatatacaattgggttttaacacccagacattccattgcccagggatgagcgggagacagatgccctcctcttatctcaactgcaaagaggccttcctcttctactaatcctcagcacagcccctttactggcgtcgggctgtcaggtctttcccttcccatgaggccatatctcaggctatcacatggggagaaaccttgggcaatacctggctttcctaggcagtgttttgtgtccctgggtccttgagagtagggagtagtgatgacttttaacaagcatgccgccttgaagcacttgtttaacaaagcacgtcctgcatagcccaaaatccat

SEQ ID NO: 588148 - DNA, 945 bp, Homo sapiens
tcctttgagctaatgaggagcaacgcggacctgttccagctgggctcgcgcccccgcggatgttgctggatcgtgtgcacgacatctgaagcctgcagatggagaagggggaggacccggtccccacactgcctcacccgcacggggcatgttcctgccgatatccatcatgacagacctgtgattcccgcatgtggctgcacagcaatgcaaggagcagcgcatgacgcgacgctgaaggcctccatgtgaccagacgcagaggaccatgtgggacagcacgacgatccggtgccttcacacgagagggatctaggaaagtgctcagagaggctagcaagggaagatccggagccatcccggttcatagatatcccatgagaaactgagagcacaatcacatcacagaaccagtgaacaagaaagtcgtccaaaaacgtgcctagacataacatcctatttccaatccgacacatccgaggcatatccaaggcagattatactccacatggccccatgaatttcataccaaccccacatgcgaatgaaaacggaacgcggagtgaggacacgcatgcgatatcagtcggtaccgtggcaaccaacagccttgagggaaacagtttggagcgggacaccgttagcacgcaaatgccctggacattttaccctagcgaaggtcaggaataaacggacattccgaggtgaaaagccaccccggcaactcctcgaaatcctccaaaagaaacaggaggacgtacactaaccataccattttttggagacacttcgggcatcacactcgaacgacacggcacgacaggccacacaggggccagcttagagaagaggcccaagctgtctgatggagctttgagcggggaattgtttctacctgggagcgattccacaagcacgggaagtttggcgctggggacttgctgc

SEQ ID NO: 588149 - DNA, 165 bp, Homo sapiens
  misc_feature (101)..(101): n is a, c, g, or t
aaataaaatccagctcttaattgagatttgtggctgggcatggtagctcatgcttgtaatcccagcactttgggacacttagcagggaggattgctggagnccaggagttcaaaaccagaatgggcaacatagtgagattccatgtctcccccccccaaaaaaaa

SEQ ID NO: 588150 - DNA, 563 bp, Homo sapiens
tctactagctctacagcttcctcgtgtaaattagtgctatggctccgtgaacatcattcatcataataggaaatgtacatgggcggaaatggattgccttatttccctcttggcagctaatgggctcttagcaagttgaaacaggagagtttatcatgaacgaagaagaagtactactaagtatacactactgtgtccatgtcccatgatcccgctctcttccatcgcccacctctgagatgaaatgagttcctattttttctgggagagggggggatgattagaaaaaaatgtagtgtgttccatttaaaattttggcatatggcacttttctaacttaggaagccacaatgttcttggcccatcatgacatgggtagcattaactgtcaagtttgtgcttccaaatcactttgggtttaagaatttcttgatactcttatagcctgccttcaatttgatcctttattctttctatttgtcaggtgcacaagattaccttcctgttttagccttctgtcttgtcacaacattcttaattggtggcatgtacttggaaaaagc

SEQ ID NO: 588151 - DNA, 142 bp, Homo sapiens
gggtcctggctgcaggcccggatttccacttcttccagtagtttcaaaagaagctattatttttgaaatttggtgaaaattgtggaattctccttaactttataaatcttgctgctgctcacatcgttgggtccgtggccat

SEQ ID NO: 588152 - DNA, 131 bp, Homo sapiens
ttttttccccccaaaaaaaaccccggggccggtccctccttcgggtttttacctagggcggggggggggtaaccatttttccccgggggccgctttttccctttgggcttttttgggggcccctttcaccc

SEQ ID NO: 588153 - DNA, 620 bp, Homo sapiens
ctgtagtctcggcacttggcagctgaatcatcacgcactggtccagtgaaggcctgccggcgctgcgcgaaatgctcacgctttacgacttgtcgcactcggccacctcgcagcgccagatcggcggcatcgtcgcgctggcgcactcgccgaccacgacatggttgcggcacaagcgcggtacttcgctggcgcatggcgtggaggtgcgcatcacgctggacgaggaggcgtttgtcggcagcagcatgcacttgtatgtgcagcttatcgatcattttctggggctgtatgtgcaaatcaatagcttcatcgaactggtggtgctgtcactgcaaagcggagaggagctgatccgatgcaagccaagaagcggattgcagaatctggtgtaatccaacacttgctcgccgaaccgtaccgctaccagttcgtgcaggcggtgcgtattctgctgtgctggctacgtcagcagaacgtgtcccatgcgcaagccttcggacaggtgctgcgcttcaggagcaagctgtccttgagttttccagccagtgaaatcgagcggctctcgctcgacgagcatgaacaactggacctgataacggggtacatgcgttaactga

SEQ ID NO: 588154 - DNA, 1978 bp, Homo sapiens
tgacccaagcaaaaaagtctagatgtgagagaagacaaattggaccactgtgataaggtgtgttttcacagaaggagaagtcaaaagggcccaggggagttgtagggtcttcttctgaaatctctctctctgctctgtctcctttctaagcatgctgttcttatctccccttcatctcattggggtactttcaggtttgggcctctcacctcacactgcggccccagaatggccaggaatgggacgggaaagcactgctgggatgggccatccagctgtaggtctcatagagaagggctgtttcttttcttcatttaatttctgccacagtggagaaaggtcagagctcaatggtcaagatcaaggtgtgagtttcaggtaatggagaccgggatgcatagtatgggcacctctcatctagagtttgaactggttcctaaagcttgccaccaggaaacatgatggaggtgtgtgggcaaagcaggtggacacgcacacatacatgcactcacggagtgctagggtggttggtcaaaactgttgcagggtagaaggtctagatatgaggaatatggaactgggcatgggctgtcctcacagaacctgtggtctccctcagaagacaattacatttctgtaaagttattgcatagcatgaataattataataagaacacaagaagagtaattctgtccaaggtgcatagttgggcatgtccctgtcctggtcattgttgtagttttctgcagcatttcacagaccctcacaacaccatgtaagttaggttccattattgttacctccggttctgcaggacactgagcacaggggtgcagtcacttcctcaggggcacacagagtggaacccaggctcactctgaacctggtgcatcatccttcaattactgaaaaggacaagtagacatgcttgggaagaaacaaatctatctgcatgggagtctgggaggctttatggtagagacactgagtaaatggagtttgctgggtgtgggaaggtactggggaatggaaggcattgaggggaaagcttgatgcctctcccaatgaagctccaagtcgaaggaaccccacattctgaaatgaccttggacagatagtcaagggccaggtaataagtcatttatattttctgaaacttgagtttaagtcatcctttctccttcattgtttcgaaaagttttatatgttcaccatcctctctggcatttatgctttttagttttaccttgcttatgtgtaatattaaaatgcactaagcaacttaattacatggatgatttaaaggatttctgaattttagaaagcttcagaagtcactttatccagcatcagtagctttataccatagatgttcagagtgctagctagcagaaagttctagataatgcaagtgagttcagcaaaataacagaatggtgaaagaatacaaaaacaaggagatctcccagagcaaatgtcatgtaaatgacctttcaattaaggagaacgtgaaggataacgaggaaaattgcctgaccagaaagctctgttaggaatgatggttgaaccaacctgtaaacaatgccattgtagacagttctgcttcaacctgaaatgatgcagccatgctgcctaaaaactggaagatattctaggaatatctttggtgtatgaacatgggctctccactatgaaattatggtattggccgggcgcggtggctcatccctctaatcccaacactttgggaggccaaggtgggcggatcatgaggtcaggagatcgagaccatcctggctgacactgtctctactaaaaatacaaaaaattaaccagacgtggtagcgggcacctgtggtcccagctactcaggaggctgaggcaggagaatggcgtgaacccgggaggtggaggttgcagtgagctgagattgcaccactgcactccagcctgggcgacagagtgagactccgtctc

SEQ ID NO: 588155 - DNA, 142 bp, Homo sapiens
  misc_feature (67)..(67): n is a, c, g, or t
cccacctaggcctcccaaagtgctgggattacagcgtaaccaccgaaccctgctagagctggaattnaacatatgcattatgattctggagtctttgaagtgctattcctaattcatcaacctgaactgcttgcttgatgtt

SEQ ID NO: 588156 - DNA, 141 bp, Homo sapiens
gtgggttttatatcttaagagaggcatgagacatcagttaaatacattgaagaaggccaggcgtgggggtgaggccggtaatccctacattggggaggccgaggggggcagatcacctgaggtcgggagttcgagacgggt

SEQ ID NO: 588157 - DNA, 814 bp, Homo sapiens
gagccagtcccgggatcatcggcgcgcgcccctcccagtccgtgcgcgccctgcctgtcgtgtttgctctgctgcacgtccctggtacggctgcgacttccggatctgctcctggccgcagggggcgccgctgtcgcacatgagtaggcctgggctggggctggcaccgcgtcgactggtgcagcccaggtactatccgtcggcagccgggtccgctatgggcagcaatgccggctctctccctactgcagccctcccgcccgtcctaccgtccggcgcgactggcggggcattagctcgctggaggcggtgcgcaggaagatccggagcctgcaggagcaggcggacgccgctgaggagcgcgcgggtcaccctggtcagtcgcgagcttggaccacgagaggaagtctgagggagaccgctgaagcctgacgtagcttctctgaacagacgcatcagctggttcgaggacagagttggatcgtgcccatggagcgtcttggcaacagctttgcagaacgctggagcgaagctgatcaaggcagcagatgcagagtgagatgaggcatgcacagtccttgacgagtcgagcccaaaatggatagatcgaccaagaatggaaattcaggaagatccaatgtgagaaagaagggcaccacgcacagttcgctgaacaatgccgaccgccccattattcaagcaggttggcccggaagctgatccatcaattgacaaggcacccgtggcaccgtgcaaacgaacaggcgctaagcctctcagagaggcaaacatttgctgcacctagactaacaat

SEQ ID NO: 588158 - DNA, 231 bp, Homo sapiens
  misc_feature (95)..(95): n is a, c, g, or t
ggttaatagaatgtgagtgtcattgtatgtagcaatatgaaccagaagaattgagctgtagccagcatttatttaagcatcatttttgccatctnggattcttttgtggggaaagaaccattcgaagggaattgcctttggttacaaaggtgatttgacttttctctctatttatatgtgcaccattccactggcaccgttgttcaaggttccataaagagacacttttgt

SEQ ID NO: 588159 - DNA, 407 bp, Homo sapiens
  misc_feature (1)..(1): n is a, c, g, or t
  misc_feature (136)..(136): n is a, c, g, or t
  misc_feature (400)..(400): n is a, c, g, or t
ntgatccaccagcctcggccttccaaggtgctgggattacaagcatgagccaccgctctcagcctattaatgtttcaaaaatagcttttccctcattataaaaatagcacatgttgggccggtcatggtgtctcanacttgtaatcccagcactttgggaggctgaggtgggaggatcacttgagtccaggagttcgagaccagcctggccaatgtggatgaagccctgtctctactaataatacaaacattagctgggcatggtgcacacgcctgtagtcccagctactcaggaggctgaggcaggagaatcacttgaccctgggaggcagaggttgcagtgagctgaggtagtgccaatgaactccagtctgggcgacagagtgagactcagcctttnaaaaaaa

SEQ ID NO: 588160 - DNA, 992 bp, Homo sapiens
gccacaacctctgctgtatcagagggggccttcgcggccgacggccccaccaccgcccctgccgccatcgccactccgccgctagcgccttgggtgccctcctccttcaccgcccccttcaccaccatctacacgttctagcgccttctgtcctggagaagaagcatatacgtcgtatctcccatctgtggtgcccggggcagcaagccatgcgccggactggcgcgacgtgctggcctgggtcggacactggccgcgcgtgggctggcggacagacactaagcaccaagagaccatacttgcacccgtactggcaacactacgcaccttgcgtccggcataacatagtgaggcgcaacgcagtgagtgagcacagcggttcgagcccccccatttcagaaccccagagaccttcccactagacccctaccgcctgtgacgcaccaccagaccagccattcaagtacgccttctttcaaatacgactgcagaacagccaacgccgttcacacagaaaacccccgacggcgaacaccttatttattcgaacccagtacgtacctcacgcctcggcgcgacaccttgacccttgagttaccggaacctggcttgatgcacgaagcccaacaacgccacaagcatttataacacaaaaaacaaccctttgaaacgtgcaccggcacaccaggctcggtaacttacaacattatcaccgtgatgagctcctagaaccaaaccaaattcacctggcgacaccccacctgcctcaagggcgaccactctggcgctcaccatctccccccttaccccgcacacatgcgaacaccccgcacaccgcagcacatcaccccacagaattttggccatacacaccaacatcggtcgacctcccactctggctcactcggccaccatggcaacgccactggattgcggacatatccaacaggcgaccacccacagcaggggaccaactcggccttccccgcaca

SEQ ID NO: 588161 - DNA, 138 bp, Homo sapiens
cgatacgtggccatgacacagtgcggctccctaggccctcccctcttcaaggggtctacattgcaactgtgcggcggggagattccgtgtggtgggggactgagtgtggcaggaactccccagacagtgcagggtctc

SEQ ID NO: 588162 - DNA, 323 bp, Homo sapiens
cttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttc

SEQ ID NO: 588163 - DNA, 510 bp, Homo sapiens
atatgtaaaaacttggaaataataaacttcttttttttgagacatgagtattgctcttgtatcgcccaggctggactgccatggcacaaccatggttcactagctgtctctaactcctaggctcaaggcgtatcctcctgtccgtagcttccaaagtagttttgcggccactgtgcaatgcaccaccaccatgccctgctaagttataccttttatgtagagatgtagatcatcgctatgttgcccaggtctggtctcgaactcctgtaaccaaagtgatcgtcctgcctaagcctcatcaaattgctgggatgataggtgtgagccatcaggcttggtcgaaaaatttttgacatttttgaatactccctccccagtccccagctctgcccaggcctctttggttatttgacccacatgttccccttttttgctcaagccagcttgaggagggtttctgtcactctgtaatccaatctaaagcccccagtgatcaccctcctctttcga

SEQ ID NO: 588164 - DNA, 457 bp, Homo sapiens
  misc_feature (29)..(29): n is a, c, g, or t
  misc_feature (74)..(74): n is a, c, g, or t
  misc_feature (89)..(89): n is a, c, g, or t
  misc_feature (96)..(96): n is a, c, g, or t
  misc_feature (183)..(183): n is a, c, g, or t
  misc_feature (185)..(186): n is a, c, g, or t
ccgggaaaacttttcaaatcaaatcctgnaaaataacttaggctttccccagactaaagcagtcccttcctctnatccctgaaatttgnctttccnagttaccttccttctggacacattcatttcccagtgccccttctgttaaaatgggcccccactagaatctctgttgctgggcacggntnncacgcctgtaatcccggcactttgggaggctgaggcgggtggatcacctgaggtggggagttcaagaccagcctgaccaacatgaagaaaccccatctctactaaaaatacaaaattaggcagacatggtggcacgtgcttgtaatcccacctacttgggaggctaaggcaggagaatcgcttgagcccgggaagctgaggttgtggtgagccaagatcgcttcattgcactctagcctggacaacaagagcgtaaatccgtctcaaaaaa

SEQ ID NO: 588165 - DNA, 113 bp, Homo sapiens
tttgtcatccccttcgtctgtcatcagagtttatttcttggttgctattggaaggttcatcttggtcgactttgttctttcctttgtttattaacttgaatgcgttccttgcc

SEQ ID NO: 588166 - DNA, 303 bp, Homo sapiens
cgggaggcggaggttgtggtgagccaagctcgcgccattgcactctggcctgggcaacaagagagacactccatctcaaaaaaaaaaaaaaaaaacgggacccccctttttaaaggaaacccaaggctcactccctttagcccacacagggccccccaattttggggggtcccaatttggaagccctcccaagatttccggaccggggggtccacccccctactaaaggccaacttaaggtcttggaaacatctaaacctttaacatgacaaaaaaaggctccggtggcccccggggaatata

SEQ ID NO: 588167 - DNA, 361 bp, Homo sapiens
aaagaggctcaacagcaagcatatttagcacacacatgccgatgaacagaatagtccgccacatcaacgggtacaagaggccgcccaccacaacctcttggtggaggtacagcacacagaagagccaacaatgaaaacttctaaaaaaaggaagcaaaaaaaaatctggacctccagcaccagaggaggaggcacgcagacgaacgacaaagtggacactacggaacagaagcacaaagaaacagacctgctaatacttttcaaggacgattcctttgccaaaaaaacatgcagcaaagaacacaaactacaagtggaagctaaattacgagctaaacaggagccagaagcaaaacacaag

SEQ ID NO: 588168 - DNA, 433 bp, Homo sapiens
agtgtaaacctttttaatgcaaatccattgtttccattgcatattatgcagataaaatccacagagtcaatttttactgccagaaaagacaccccttttgacattgcaactattttataaatccagaaatctttgtactgatgtaaatgattgcagctatttaggatagagtatggctaacaaaaggagagactattttcatgcatattgctaggttagatattttggggtttatctcattttaaaagtagtaaacgacttggaataatttcacatatactagcaaattaatatgatgccgagtacacaggcggaaccgggaaacccccatgaaattttaaaagcttacacaaaaaacaaaactctctgagcaatttcccatagttactaactctccaggctctgaccgccctaccccaaaagatcccaaacc

SEQ ID NO: 588169 - DNA, 569 bp, Homo sapiens
  misc_feature (26)..(26): n is a, c, g, or t
  misc_feature (238)..(238): n is a, c, g, or t
  misc_feature (242)..(242): n is a, c, g, or t
  misc_feature (251)..(251): n is a, c, g, or t
  misc_feature (253)..(253): n is a, c, g, or t
  misc_feature (279)..(279): n is a, c, g, or t
  misc_feature (359)..(360): n is a, c, g, or t
  misc_feature (383)..(383): n is a, c, g, or t
  misc_feature (405)..(405): n is a, c, g, or t
  misc_feature (425)..(425): n is a, c, g, or t
  misc_feature (428)..(428): n is a, c, g, or t
  misc_feature (441)..(441): n is a, c, g, or t
  misc_feature (446)..(446): n is a, c, g, or t
  misc_feature (451)..(451): n is a, c, g, or t
  misc_feature (472)..(472): n is a, c, g, or t
  misc_feature (476)..(476): n is a, c, g, or t
  misc_feature (479)..(479): n is a, c, g, or t
  misc_feature (487)..(487): n is a, c, g, or t
  misc_feature (491)..(492): n is a, c, g, or t
  misc_feature (495)..(495): n is a, c, g, or t
  misc_feature (503)..(503): n is a, c, g, or t
  misc_feature (508)..(508): n is a, c, g, or t
  misc_feature (513)..(513): n is a, c, g, or t
  misc_feature (515)..(515): n is a, c, g, or t
  misc_feature (524)..(524): n is a, c, g, or t
  misc_feature (526)..(527): n is a, c, g, or t
  misc_feature (533)..(533): n is a, c, g, or t
  misc_feature (543)..(543): n is a, c, g, or t
tgtggctgatgacatggaaggacaangatggggagaacagtgagcatgtgctgaagatactaggggagagcacaacactcgcgttctcattcgcgtgattccgttctctctccacacacactcacgcgctctcattcgctcgattccgttctctctccacacgcgctctcattcgctcgattccgttctctccacacatactcacgcgctgtcattcgcttgattccgttctctctcnatanacactcacncnctcattcgcttgattccgttctctcnctccacacacactcacgatactcattcatgtgatcccgttctctctctatatacactcacgacgctctcattcgcttgannccgttctctctatatacacacangctctcattcgcttgattccgntctctctctctacacacacncgngtactcattcgcntgatnccgtnctctctctccacacacactcntgtnctnattcgctngatnncgntctctctncacanacacncnctctcatangnntgatcncatctctctntctacacacactcgtgttctaattcg

SEQ ID NO: 588170 - DNA, 116 bp, Homo sapiens
caggcaaagctcctacaactgagaaaaagtggagtagaaatatctaggcaggaggaaggatgagatcatagtccatgtctagtggtaggctagaaaaatgccccccaaatagattc

SEQ ID NO: 588171 - DNA, 121 bp, Homo sapiens
agaagtcgagcgcttgtaccccagatgagaagcgcgcctgtttgacagcctggatccaacgctggcacgtggatgcatgaaccatcctgcggtacaggctgcgtcgatgcgctgctgtcgt

SEQ ID NO: 588172 - DNA, 678 bp, Homo sapiens
atttcaacctaaaacaaaacaagggtcaattcatttaatccaataaggcaaatttttggaaaatttacaagccccaagcctttaaaaaattcctaataaaaaaaataccctgcaagccagtaaaattttcgaaatgtccggggccccttcggtgtcttgtaaaagagtacatgggcctttttcaaaagaaggtcagcaaagctgccgtcaaagatacttttctaactttaaccaagggcctgttgggagaacggaattcaaaggtgggcccccagtgccccctactgaaaagggcagtttacctcgtatctttgggcttctagaagatggtagcaattgatcccttaaccaataatggacagccctcatcactgtgctgcttaataggtgccaccttgtgtgtttaaagaaggcaagctttgtacctttatagtggaggtgaaatgaacgactggcttgatgcgcactgaaaacagcatctgatttcgtgctttggggccaatcaatcaccctatgaaattggtgggtggtgtatttataacataatccttgctctgccgaatgaagctgggtctgataaaaaccctgaactgacaaatgaagtgccgggcacgacaacttttcttctagtgtttcctccccccactgacaacccaataatgcatgctcataaggcaa

SEQ ID NO: 588173 - DNA, 138 bp, Homo sapiens
tgcacgtcctcggcgcggcccgtgacgcgggccagcacggtatcgaagaatgcggagtgcacgacctcgacgccggcctccttcagccccatggccaccgcgagcgcgtgaccgtgcacccggtgcgcgatggcggtc

SEQ ID NO: 588174 - DNA, 743 bp, Homo sapiens
cttcacacgcgcttgccgggagatgcggccgcttcgtcctctgcagttaacgaagctgggcgcgtcgaggactgggatttcaaatatgcgtgcattacgagaatgactttttcaattctcccccaagacacaactgttcggtttggtggaactgtgacagaagctcttgctgaagtacaaaaagctccaccctcagcagatgataatactcaacgacacctgccgagcgtctgcggagggccgcttccaccctcacgcggatgactaatctcaagacaccttccgagcgtcagcctcactccccttccaccctcacgctccaccctcagcagatgatacctatcgagcacacctgccgagcgtctgcgggggccgcttccaccctcagccggatgataattctccgacaccttccgagcgtccgctcacctccccttccccctcagctccacccctcacgcagatgactacatctccccgaccccgtgcccgagcgctcctgcggccgaagccgtctgcggggggcccgcaccccacccctccgccggcactgatcactctcaaggacccatacccgaggccgttccgcctcactccccgttcctgccctcagtctccatcctctccagccctgctcctctcacgatccctgccgagcggtcctggcggggccgctccccctccgcggatctactccccgacctccccgcgtggtcctcctcacccagctctcccctccctct

SEQ ID NO: 588175 - DNA, 129 bp, Homo sapiens
  misc_feature (61)..(61): n is a, c, g, or t
tagatccagcattttgggatgaggaaaggaagtgagcagaaggtcatgagtaatagcattncctgtagctctcaaagcaaatttgagctcatttttctttttctgcaagctcagcagcagaatgcccag

SEQ ID NO: 588176 - DNA, 379 bp, Homo sapiens
  misc_feature (11)..(11): n is a, c, g, or t
  misc_feature (373)..(374): n is a, c, g, or t
  misc_feature (376)..(379): n is a, c, g, or t
ggcccacaggnaattattttggtaaggttattaataaccccccatcaaccctaaatatggcaacaaggtgagtgcctggttaataaaattatccttaaaaaccccaactcagtgtgaagagtattaaaatttttagcttgggcccatggtaaactgctcatgatcccattaaaaaaagaattactaaaactcaacaacaaaaacaacccaactcaaaaacaggcaaaggatttgaacagacatttctccaaagaagctatacaaatggccaaaaaaaaccatgagaagatgctccatgtcattaatcactagggaaatgcatgttcaagccacaatgagactacttcacacccacgaagatggagatactcannannnn

SEQ ID NO: 588177 - DNA, 252 bp, Homo sapiens
cagaggattacccaaggaggatatagagaggcaaaggggcttagtaaaaactgaaaatatactggtaggggaaaaggtagaacttctctgggtagtctcctttaacttaaaaaattaataggcccttgatgtattccccatactttgtaacttatagcttgctagtcatatctactggctctagattttatctatcttaaacctacttgtaaaacgtatgtactacagctactagctattgctagacaaagg

SEQ ID NO: 588178 - DNA, 237 bp, Homo sapiens
agggcccccaccccccccccccggggtggtggtgggggctgggcccggccttctttagaaaatgcccttttccccggggatttcctggttctttatgggggaagacccggccctggtcccctttgggcccctttggggggccgggaattctgccggggggggccgggccccgggtgggcctgccccggcccccggccggggggggcaaagggggccattaatccttttcaaggtgga

SEQ ID NO: 588179 - DNA, 215 bp, Homo sapiens
agccgtctctagagtacccccccagaatggaatccatatgtatatatacacaagtatgtatacacttagaaatataagagttacatatcctggtctcttacatgcgaatcagtacatacacaaatagtattagggctacatcatgtaatcttgcacaggtaataggaaaaaaatctgtgaaatatatttcacagattttaacaatatatacataa

SEQ ID NO: 588180 - DNA, 164 bp, Homo sapiens
aatggagacatccagccccacctctctagaacagggagagatgactagtgcggaaacacaagttagcatgggaacaggggtcacggtggacaccgggataggctggctctcacagctcctcacattatgctaacaggtacgccgacacattcaggtgccttatc

SEQ ID NO: 588181 - DNA, 1233 bp, Homo sapiens
  misc_feature (533)..(533): n is a, c, g, or t
aatacaaaaacctttatgataataaggcgaaccctgcaccagctatcaatttttacctatggaaccgaaccattagtgaccagcgatcatcattcccgcgtgcaacgtctacaccacataactagtttcagttctagcactacatgatcccatagcttgctgagaccttcgcctgatacgtatactaataagaacaaaataagaagacaaggaggggcgtgggctggagatgagagaagattagcgcccttcccagtatgagagagggccaatagacccattgtgaggtgcgtgttgcgcataaacgaactttgcatagagcgtagcagacagtggcgctccgcttggatacatgcgacagcgcactgaggtataatacatacacgtatagatgagcgcacatgaggcccgaggcacgctacgcacacacgatgcacgtacatggtgagacacgtgtaatacaatataggtgtgagcacacacaatgggggacgcaacaccgataggcgacgatgcatatagtgccgacaacncttactaccacatctggacatgtgaagcgatgggggtggaccacaatacttcacaatgggggcgtcagcaacatagcttgcactctgaaacccatgggaactattggctaaggcacaatgacgacatctcagaggcagggaggaaaagaagcacaagataataatcccataagcaatacccgtgccctaagcagacgtcagagtcactcctaccacgcagctgaaccaggctttggggacgcacaaatgaaccgctctgggagaggaaacgaccacgacttaggctccgccgtatagtctagttagggaccagtcagtcgaccacaccacgacggcttgagcacgcttggaggtaggaaaatacacatacgaagctattcaacaatgtaggcagcactaccacgcagtgactcgggttatcataaaccacccacccagacacgcgggggccatacagcaccgcgcaggactatatggaacttgtccgcagaaccgccccagatctagaccacagacggcccaaacgacaacctgcgactgcacacttcaatttacggcaccgaggcagcaaagattagggtatcaaccacaggggcaaaatcggtccacgaggcacacccatctaacaccacatacttacaaacagggacaacaaaacacgtcttcgaggacatacagccacaagcagccccaccctagg

SEQ ID NO: 588182 - DNA, 358 bp, Homo sapiens
aacctgcatgatattagtgtgaaattatctgacccttggacagactatgtcttttgtgttagagtcctctttgaacccaacgactagctttaccaactcattcctgactggaacctcccggatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactg

SEQ ID NO: 588183 - DNA, 517 bp, Homo sapiens
tgttctaatttggaaaagattgggaaagtggagaacatgtttggcaggtggacgcggggttttctatcgtgcagagtcacaatttggtaagatatctgtgttggagaataccagtattataatagagtgaaacacatttaaaaaagggagttaatttcctgttgggatagtctacagtattttggaaaatagagtatgagactaccacttaggccttgtattctactgtttatggataagttcatcaatgtttacctcgtttaatacatcacttaggaacaattagtatattacacatgaagaaaggtaatcgttacttaaagggtttggagattttccgcccacattttttttccggatacattagttattgctggacaccctatttatctcaaaaatctaaatatatgcagacccacaggtctcttgcattccttttgaaataactggttgtgacaaagctaattgttgatgcgagattcactgtttcatcatatttattgtaagatagggtcta

SEQ ID NO: 588184 - DNA, 842 bp, Homo sapiens
cctcgtcctgctactctcgtggggccctgtgccctgatcccagacctggtgcggtgctcccactccatgagcgtatttctacacctccatgtcccggcccggccgcggggagccccgcttcatcgccgtgggctacgtggacgacactgcagttctgtgctggttctgacatgcgactgcctgcgagccatgtatggatggatgcctgctgggcgccgtggatagtagcagtgatggggcctggtgtatttgggacctggaacacactgtgaatgtgaaggcccagtcacaagactgacctgaggtgtgacctgggtgaccctgctgctggctactacaaccatgagctgaggcctggttctcacaccatccagatggatgtatggcttgcgaccgtggggcctggactgggcgcttcctccgctgggtaccaccagtacgcctacgacggcaaggattacatctgccctgaaaggaggacctgcgctcttgtgccctgctggcggacatggcagctcagaccaccaagcacaagtgggatggcggccatgtggcggagcagtggagagcctacctggagggcacgtgcgtgtgatgtggttccgcagataccttggagaaccgggaaggagactgcttgcagcgcactggagcccccaaaaacgcatatgactcaccacgctgtctctgaccattgaagccacctgagggtgcttgtgccctgagctttattacctgcggagatcaccctgacctgtgcgggatggggaggaccagaccagggacacggactcgtggcgaccaggctgaggggatggaccttccagagtggtggtggatag

SEQ ID NO: 588185 - DNA, 833 bp, Homo sapiens
gacattgtgtgggtctgatcgtccgtatattgaccgtagtggagtgctctgtagtccttgtatcacatcctacagacctatggatttgctcacgcgtagaaaacctgcagtttgcaattcataggcaagctcactgcgagtgggtgaatgtctggtgccgaacgacgatagtgggaacgctgcatgtgatgtaaacgagtgaatcttgctctagtgatggaggatgtgatagagagagactatgaaggaaggatatgggagtaacaggtgtcgtgcaagaaatatgggtgtgtaatcatgtcttccatggttgacgggagtggccctgtcgggtatgaggagtggctcctggatgatggcatgtgagaggaatgtgatcacgggatcagtggtttctaagtaagcattaatgaaagtgcgggaaatgggggacattcatctatggtgactggattttcaatgcacattcgcaggtcattatagattgatctaggtggaaagaaatgacacttttcctacatgtccgcgtactctacgttttctaaaggtgtaattttgatcatatcgagtgttaacatggtgtcgtcgctatggatgttagaaatatgttgagtattcattgccaagggacaagcataaatgtgtctgaagaaatccacgttttgaacgtacgtttttgaaatatcaagatgagatatatggattttatatcgaatacagtttattggtgcgaaggttatcaagtgaaagtataatttggaggtggcgcggggagaagaaagtgcatgaggggtggagacattctggggaacgcaatgtttgggggaaataag

SEQ ID NO: 588186 - DNA, 159 bp, Homo sapiens
gacatgttgaaggtcttgtcctcatcaacattgatcccatgccaaggttggatggattggcagccacagctaacaggctcacctcttccattcgagatgatccttgacatctttcagccagtagagctctctggaatgctgagtgatacaaaagtacag

SEQ ID NO: 588187 - DNA, 371 bp, Homo sapiens
  misc_feature (318)..(318): n is a, c, g, or t
  misc_feature (349)..(349): n is a, c, g, or t
gacccagaaaatggagctagctacatttctcacacttactgtcataattacatgtttatattctattagttgtaattatttttcacctatcctctcattagaatgttatacctatagagcagataccattccagttttaattttttgccccgactcctagtaagtacgtgacctattacagggaacttaaaacaaacaaaaagtctgctgagtctgggatgttttaaggatcgaaggaacatgttggtccaatttgccttcacagagggttacctctgcttttctaccgaatgtggaattgctcccatgtggattttnaaggaattccagtctaccctcaggggaaggnccacatgtaatgccagaggtct

SEQ ID NO: 588188 - DNA, 176 bp, Homo sapiens
ttaccaccactgagagcgcaagggccatccctggctagacagtctactgtgggactttccttatcacgaaaacgccaaggaaaagatagctcattgatagtgtgagcacttacagaactacaagcccattcgtgatttctacaagtctgtcaactccctctgcaaggaacccacgc

SEQ ID NO: 588189 - DNA, 329 bp, Homo sapiens
cagagtccaacagtgcctattgtgacgcagtcttgccctgttacccaggcaggagtgcagtggcacgatctcagctcactgcaacctccgcctcccgggttcaagtgattctcctgcctcagcctcccgagtagctgggattgcaggcgcccgcaaccgcgccccgctaatttttgtatttttagtagagacggggttttgccatgttggccaggctggtctcaaactcccgacctcaagtgatccacctgcctcagccttccaaagtgctggcattacaggtgtgagccactgctcctggccagtgctttacttctgtctttagtaca

SEQ ID NO: 588190 - DNA, 709 bp, Homo sapiens
aaaaaaaaaaaaaaaaaaaaaacaaaaaaaaaaaaaaaaaaaaaaaaaaaaaaaaaaaaaaaaaaaaaaaaaaaaaaaggaagaaaaaaaaaaaaaaaaaaaaaaaaaaaaaaccttgtggggcccccctgggccccattcgaattttaaaattgggaccaagtttttgccttgcgggcccgaatattggggcctccattgggcccatttcccccctttgaggggagtcgttattaacaataaactgggcccgggggtttaaacacaccgtcggggccgggggaaaacacccgtggcggttcccccacctttaatatccctcttggaagacaatatccccctttttccgccagtggtggggtattataccaaagaaggcccccgccccggtatccctctttcccaaacaattgtgccacacccttgatgggcgaatgggaaaattgaacaccttaatttttttgttaaaatatccggcgtaaaattttgtgtaaaaaaagcttatttttttaacccatatgggcccgaaaatggggaaaatcccccttttaaaattaaaaaaaactacccccgacatgggtgttgaggggctggcccccgtttgggaacaaagaactcacctctttaaacacggggcctcccaaccgtctgggggctcccctttgtttccggggtgtggggcgaccccctgtcggagccgctctcctct

SEQ ID NO: 588191 - DNA, 132 bp, Homo sapiens
tctagaggatcccgtctagcctcgccaggtgcctctccgtggctgaatggtgccactccatgtgcccaccatgccttgtcatatatagaattaatgttgtatcatttataaaaaggaagaaggagctgttaa

SEQ ID NO: 588192 - DNA, 123 bp, Homo sapiens
cgtacagatatgcagagaaccgtctgtctcagtgtctctatctctcttctctcgagtctctgtctccctctgtctctgggtctctgtgtctctctctctctgggtctctgtccctctctctct

SEQ ID NO: 588193 - DNA, 408 bp, Homo sapiens
  misc_feature (138)..(138): n is a, c, g, or t
  misc_feature (153)..(155): n is a, c, g, or t
  misc_feature (157)..(158): n is a, c, g, or t
  misc_feature (165)..(165): n is a, c, g, or t
  misc_feature (169)..(169): n is a, c, g, or t
  misc_feature (185)..(185): n is a, c, g, or t
catctgagcccctgatgccccagctgctctctaccatacaattgaagaatatattataatctttgaagaagaagaagttgaatttatcagtgtgcctgttccatagttcgcagatagtgatcctgccaacattgttcntgactttaacaagannntnncagcctntttngatctttgcctggatnagtgctatgtgatccctctgaatacttccattgttatgccacccagaaagcttctggagttacttattaacatcaaggctggaacctatttgccttagtcctatctgattcatgagcacatggttctaactgatcgcattgaatacattgatcacctgggttactttatttatcgactgtgtcctgactaggaaacttataaactggaacgcggagaaattat

SEQ ID NO: 588194 - DNA, 781 bp, Homo sapiens
cgcacggggaagtcgagacattataaccatgcataagatagcagggactaacacctatacctacttgaataacgaagtaactagaaacaactttgcatggagagccaaagctaagagcctggaaaccagacaaggtacctaataacagcctgaagagtacacacctgtgtgcctgcagatagctggttgatcaagatagaatattagctcaactgtaaattagcccacagaaccctctaaaatcccttgtaaatttaactgctaagccaaagaggaacagacttttggacactaggtgaaaacctttgggagagaagaacaaatttaacacccatggtgggcctaaaagcagccaccaattaagaaagcggtcaagctcaacacccactacctaaaaaatcccaaacatataacttgactcctcacacccaattggaccaatctattaccctatagaagaactaattgttgtatacgtaacatgaaaacagtcttcctcgcataagcctgcccccgatataagcactgtagtgacaattaacaacccatatctacaatcaaacaaaaagacatttttaccttactgtgaacccacacaaggatggctattatggaaaggttaaaataaaaaaaaaaaccctctggaggggccccgggcccaaatcccccttattgaggcgatttactactgggcgctgtctacaaccccgtgaccgggacctggggttaccacatattatatcttggagaacactacctcttttgcacgttgtgttatatc

SEQ ID NO: 588195 - DNA, 176 bp, Homo sapiens
taaccagggtggctcataaaatagccattggccagtttagcagccacttcgggtgcctcccccttctcaaagtatttcacctctttaagagggccccgggagaacgaggcacgtgctgaacacaacaaatatcacacattctatggggtgaaaattttcataattcccaagaattc

SEQ ID NO: 588196 - DNA, 176 bp, Homo sapiens
ccaagattccgaatagaaagaaggccaagggaaagacatggtggctccggctctagcttgtcgtcaagaagcaggatggctaagaaagtggtgaatcccctatttgagaaatggcctaagaatttttggcatttggacaggacattcagcccaaatgagacctcaccctgtttatt

SEQ ID NO: 588197 - DNA, 480 bp, Homo sapiens
  misc_feature (480)..(480): n is a, c, g, or t
tgagccaaaaaacggcacgaggacagaccctgtgatgccctcatgggaccattttggggtatcaagcactgtgcgtactgtaacccctatacggatggggccgagactccattgatcacatctgcttactgtaccaattgtactgctatcagagggcggccaacaactgcatggtggatcttgaaataaaatttacgtcggcctgaatacatgagatacttcccgccaaacctgggaatacatttgaaggacccgcttccttaaaactctttatcatccccgacgccaaaaaaagattgcctgctctaatggaaactacgaatgagggctggatttgtagacctttcactgtagcgtgactataaggcgattccccactcgtctaggcatctgaaggaatcacatagctacttgtgttttaaactacatgtgattctaaggaattggaggaacctgtctagctttaacaatgagaccaan

SEQ ID NO: 588198 - DNA, 334 bp, Homo sapiens
caggctggagtgcattggtgcgatctcagctcactgcaacctctgcctcccgggttcaagcagttctctgcctcagcctccagagtagctgggattacaggcacccgccaccactcctggctaatttttgtatttttagtagagacggggtttcaccatcttggtcaggctggtcttgaactcccaacctcatgacccacctgcctcggcctcccaaagtgttgggattacaggcgtgagcacttgcacctggcctagcctttcttaatcgtgtccctcatcaatgaaatggtagaaaagccaatctgttttacaggtgtgggtagaaggggaa

SEQ ID NO: 588199 - DNA, 331 bp, Homo sapiens
gttgttctgggcgcggtgaactctctcttgtatttgcagtccaggccttcgcgtctcctgcgccacagacggtgcccacggagctcccagctgaggcgctgcttctccgggctgtcgattggacccgccctccggtgcctactgagctgatatcagttctcattttacacactggctcaggtcagcagggacaggagtcgagccttagcaaaagcctcgtgtcttaaggtcccaagttaagagaacttgggcttccacttcgcgcaagaaggccccggtccaactttcgtccaccgggccggcggaagcagggttccaataatttcaatgt

SEQ ID NO: 588200 - DNA, 131 bp, Homo sapiens
  misc_feature (2)..(2): n is a, c, g, or t
antgcctctcatgtgaatggtggcgtcaggttctcctcagcactcgcatgtcgctgctcttcatgtgaatggtggcgtccgggttctctctagcactcgcatgtcgcctgctcttccatgtgaaatggtgg

SEQ ID NO: 588201 - DNA, 819 bp, Homo sapiens
agcggattgccgcctccgggtggcgcttcccggtgtcgtgttcgtggaagcttatcggtcaccatggagcttgctggagagagtacgtcgggcaggaagggaatgccgtcagaaactgcgggtgtcctgtgaggcgccgggtgacggctgatccctttactcagaggccctgattcgtctaggacgtggcacacacgtatgaagggacatggtaagctgcgaattgattcagaacctcgtggtacacgagggggaagtgcatggctaccgtggtggtcggagcagcgacgtccgatgatcgcaggatcttgagacgggtgatgtatgaacgatgattgcaagaagtactgacaaagtaactaagttgatagacgatgaagcgtaaaccttcggaaatggacccatcgtgcgaaaaggcggcctaaagagaatccacgccgtgcttaactgacctaggccgttcatttgacagttccacaagaggacatggcttgttcgtatccctgtagtgtgtcacaccctaggacaattcatccggataagacctttatgcgtctagctttgggaaataaccgcatttggtgattgttcgtcctgtggacaatctttggtcaaagacgaagaacgggattatttctggtttctaggagagatagtaaacggcttacgaaataaaatctagtttacttagagaagataaatttcaggaaccgtggaaggaaaatatgaacacttcagtaagtgtatacaaatggtctaagttgggaactgagtattatcatgtctggtatctttaaaataatcattgatatgcgtgag

SEQ ID NO: 588202 - DNA, 205 bp, Homo sapiens
aacatctatgggtcaagatattgtgagtagccacaggctctcacggacttcacgatcaatgatgggctcacctttcctcactatctgtttcatccgccaactaatatttcacttaacatccaaacatcactaaggattcgatagccgtcgcattgatactggcattttgtaaatgtggtttgactattcctgtaatgtctccatc

SEQ ID NO: 588203 - DNA, 354 bp, Homo sapiens
  misc_feature (7)..(7): n is a, c, g, or t
  misc_feature (259)..(259): n is a, c, g, or t
  misc_feature (289)..(289): n is a, c, g, or t
  misc_feature (296)..(296): n is a, c, g, or t
cgagtgnacctgaagataatggaattttgagtatacatatctttctagtgggcaaagattatgtagatcatctacagcatttgaaaggtttagttcggatttcggccaaagtggtttttttcttccaggctcactgcatagtacttggtaattatattactgctgggtaaagatatctgatataacgtaatgtaatttcttcagtctctagatgggtatatttggtgctactaggcatcaggagacaaaagaatccttnaaattggagggatttcctttagaaaatganattctanaccaattgtcacaatgattgtacccatgatactatcaaccatcatttctttggcaatc

SEQ ID NO: 588204 - DNA, 973 bp, Homo sapiens
agttcagcaaggaaccatttgtgtggtcacatagaatcttgagaggcataataggtcagagtgctgagaacctgctctgtaggttgggccgtgtctaaccgggaaatgcttataggtcaagaacatgcgtccttgaaatgtataggctacacaagactgtaattatcattgagcttgttagttgggcgttgggaatcatataagtcagcggatgaagtgcaatttacaaagtatggctaagaaggttctacagtcattttgcccttatcatcatcataaagcgacattcagtgttgttgatgggagaacgccttttgaagtccctggatgacaccgggatatgagtgaactcaccatattgttgcacctatttgttgcaaaccagtgaggcctgaatatctgtgactgtacttatacacggaggatgcattgatgcccttcctgttagggctcatcactgtagtgaagtgcccctctcaaggtgtccagttttgctcaggcaggttgtgtggcgctgcctgatttaaattaaagaattcaaatgccgtggatgggaaccagcaggctagtgtaactggcgtttgggtacccaagactaagatgatatgaacctagttgagactgaccctttgtgtagctgagtggtggtgatcaccgctatattagcgtgggcacattctttcgttaagctagacaaggatagatagcattgctacccatgagagtggcccgtggcgctattatagtcaatggagatgcctggtcaaaatgttactggtagcaagttaatagtgtcctactggtcatgtagacaaagtgcggggactgcaagcgatttgctgaagagaaacttagttggctttgtcgcaaactgacggggggatacagagaggacggccatatgggtacacgacctggttaaacgagccaaattgcgctttgtcccaaggggcccgggataaaggaaatcggg

SEQ ID NO: 588205 - DNA, 103 bp, Homo sapiens
ggactcttcctgctgctgcctcctcctgctgctgtcctcctcctgctgctgaaagccaaagtagtctacgccgccagaagagagagacggaaacatcggagag

SEQ ID NO: 588206 - DNA, 679 bp, Homo sapiens
tatacatccattcatgagaggttaacacctgacgttaatttcagaaagcttctatatacctatcagggtcattggagaattggcctaagtctccctttatttgcctaaggtactgtaatgagaagggaacttgaggggcccctgaataagggggatccttagattgttcccctggaagttacttctctaactttggtgaatcatttgctattggcctgcctgatatgactactaaaagagctgggttgattttgtgacacctgcaaaggtctagtaaggccatgcccttgtgcaaaagaaaatgagttgatttttctttaaattattagagtcaaaggagtccttgtgcttcagaatgtactccagaggggtgcaagctgaagatgatctgttacccatctagagagagaagtgacaaaaaggcatctcttttttcaccttccttttggtgtgacccagggtggagaggaaaacagtggggacgtccctcctgctgttttccctctgcggtttctgggtcctggcaccttgtttaatgtgccacccatggttgcaggtgtgacccccagccatggaaccagaggaactaagtgattgggattagtcacactgattcatgcaactcaagtcctctgactgtgatttcctttgattcctagactgtgtgatcctcctaagc

SEQ ID NO: 588207 - DNA, 1049 bp, Homo sapiens
atttactttctttaacttatttttttggatcttcttatattaatctacttgttgtacttatacctgttattatattgtacatatttcacttttcttactctccagttttatgctaacaattttttattttcttcttcttgcttctactttgttctctctctttagtactactctattctactatactacttattgctatcttactttcgctcctatcttacactatagtatttatttctcacctattttactaactagtgatacactctctgatcttctctgtataatctcctctgtacttcctttgtgtatatctctttttgttcctttgcttgttctcttttcgtgcgcttatgcctgggtcttgtttttgatggggggtgtctcttggcctccgctcccgctggtgggttgcagccctcccggctttttttttctgccccccgtgtgtttggccgacccgtttcactagtcgcccagttgggtccaccgagtgccgatgtcttgtttgtccttcttgcctgacaggcttccatttactctactgtgacttctttacctgtgtttcacattctgtgcgaacatcttttttttgtctgcccgtattatgcttctgatcttggggtcgtttctgtttttgtgtttctgtcgcatagaatcgtatgttgctttccccttgggaatatcttggggtgatgcccttcttccgccatcacttgtgtggggggcactattgggggccatcgccgggccctcacctcttctcgccgtggttctgtgtctcacacagctgttttctttcaaaattgggaagtccttccctgttgaggcccgccccgagaagatagcgagattttaatctctgcccaaaaagaaaactactttaaaattgaaacacacaagagccaagcaggacttataaaattatatatatatatattaaaagtctctattcttcaccccccagccttcctgaacctgcctctctgaggataaagccattcattttctcccaccctcggccctcttgtttttcaaataaactttta

SEQ ID NO: 588208 - DNA, 409 bp, Homo sapiens
  misc_feature (118)..(118): n is a, c, g, or t
tagagaccgtgttgcaatggagtgtgcacccgcaggttgtggtgcctcacacctgtaatctcagcaccatgtccagctaagtgtttggtctttaagtaaagacagggttacatctggntgggccgggcttgtcttcaattccctgatcggtaagtagatctggcttgtctagggtttcccaaaggtgctagtagggattacgaggcatgagccatgtgtgcctggccatggtcccgtgcatttttaattcacagtcacggtatggatggtcaaagggtgtgtataaatggcggtatctccggttcaataagtccagtgtaggcaaattatgggaaagacgacacgatgtttcccggaagttataagacattttcacgtgacatttgcaacagggtctctcagggtaccg

SEQ ID NO: 588209 - DNA, 145 bp, Homo sapiens
ggcgtctgtgaaattccaccttggtgtgctgtacctccatcgtgtatgccacggaggaagaagcagaccaatggtggaattcccatgaggcccgacaaatatagaggagacactcaagtgtcctaactctatgagacctccccgc

SEQ ID NO: 588210 - DNA, 102 bp, Homo sapiens
gcggccgcctactactactactactgctcgaattcaagcttctaacgatgtacggggacatggcccccaataaaggcagctgcctctgctccctctgaaaaa

SEQ ID NO: 588211 - DNA, 831 bp, Homo sapiens
  misc_feature (372)..(372): n is a, c, g, or t
gttcgccgtactctgcgcacatcgctatggcggttccgaggcagtgggaagagatgcggccctggacatctgtcgagctggcggaaccggaggaagtgggaggtgctggagcccgagggaggatttcaggagcagtttctggctcccggtcatcaacgagatgcgcgaggaacattccgcgtcggcttgaacgccgcaagaacacaaggggagaggggcggtgtacctttgcggggacaccgggagccaagcctggtggggaacgatggcgaccaaaatatgtggcttcaatacccaatggcatttcaagacaccgggcaatgtggttgaggaggggcccttcgggcgaaggagcaaagacgcgtgcccctnatcaaaacaacacatctttccaaagaaaacaccgggtgagccccgcacgtgtcgtcttggccgctccaagaaccccggaacaacctcgtgggagacactggcatcggtcaccattgaaactcatttttttaccacgcgggtgtctgacttttggcgtggacacccttttgttacccaccaacccgttggggaggagcaccacaactacgggttagcaatatcccggtgtgcttgagcattagaaacacaattctggtggacaaaagcaacgggcatgccattcacttgtgccgcaccgggagaaaattttaatccgtggggacaaaaaacacgccccgaggacttatacacgatggattatggggtaccgccacgatgtcggcatctaaataacaccagacaaacacgctccgcgggtaccaaccgcacgggtagacacattactattattagtctagc

SEQ ID NO: 588212 - DNA, 259 bp, Homo sapiens
tatatacttcataagtcaaacaatcaggctgggcgcagtagctcatgcctgtaatcccagccctttgggaggccgagctgggcagatcacttgagatcaggtgttcgagaccagcctcaagacctccaacatgggccgggtgcagtggctcacgtctgtaatcccagcactttgggaggccgagacggacggatgatgaggtcaggagatagagaccatcctggctaacatggtgaaaccccatctctactaaaaatac

SEQ ID NO: 588213 - DNA, 305 bp, Homo sapiens
tggctggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttggg

SEQ ID NO: 588214 - DNA, 397 bp, Homo sapiens
  misc_feature (392)..(392): n is a, c, g, or t
  misc_feature (395)..(395): n is a, c, g, or t
caagttgaaaaatagattcaagttgataataccttagtacctagattctccctgaatcgactttgggaattctgagtcaaccctaaggactatattacaaaggatcagaccttgacttttaggccagttgtagtggctcatgcctgtaatcccagcactttaggaagccaaggcaagtggatcacttcagtccaggaggttgagaccagcctgtgcaacacagcgagaccctgtctctaccaaaaatacaaaaattagccaggtgtagtgtagcacctgcctgtagtctgagctactgaggaggctgaggttggagaatcaactttaaccccggatatggaggctgcagtgagctgtgatcatgccagcctgggcaaggagcaagaccctcnctnaa

SEQ ID NO: 588215 - DNA, 239 bp, Homo sapiens
cagacctcatcgcttatacttcctcgacgtataagcgttaaggaagtataagcgttccagtaagtataagcgttgagcaacgtataaagcgttgaggaggtatacgcgttgaggaagtatcaagcgttgaggaagtatcaagcgtttagaacgtataaagcgttgaggaagtatacagcgtacagaagtataaacgcgttgaggaagtataacgcgttgaggaagtataaagcgttgag

SEQ ID NO: 588216 - DNA, 1010 bp, Homo sapiens
catatagcatctcacgttctaggagtactagtatatcgctcacacctcatatcctccctactatgcctataaggaataatactatcggctgttcattatagctactctcatcaaccctgaactaaccagcataccaccttcttagccaatattgtgccttatcgctcatactagtctttgccggctgcgaatgactggtgggcctagccctacttagtctcaatctccaactcatatggcctagacttgacgtactatataccgtaatacctacatcgcacaatgcgtatacatactaatcgatcccatacacaaatatataacgaccactgacgtgaatttccaaaaaacgcatactttagaatacatacgctaaccactcctacagactaatttatttagcgatcatccttctagtatattttaggctacatatcaagcaaagaactctaagtgtatgggcttgtttccccacttaaaaacctaggcttctctctcgtacacccccttggtatcacaagcacgggtccctctcataaattaactcaaacgtaccctgaacatccataccaccgcttcgggacactacactgggtggagacccatatgggcccacgtatatactcatgtgcaattccgactcatgcacggaaacgataattgcttaacatgcacatgtatgtagttgaccctatcaagaggtacttcgcttttatttcataccacgattgcatcatgcacacacagaacttaaatcatattgtgggtagttccctctttcgaaaatcacaggttatgggcggcacctttgggtgtatcagtcaccccgaatgagtgcaaccagacgggaacggcctgaaacgcgaggccagatacttatcctaatttcttacagcccctagttagtgtcccattccccttattcatgcgcaccttagtgtaccctcgagaaacacctaagggctcacttaaacgatttagtgaggtcactctcactggcccaagaatat

SEQ ID NO: 588217 - DNA, 403 bp, Homo sapiens
  misc_feature (152)..(152): n is a, c, g, or t
  misc_feature (167)..(167): n is a, c, g, or t
  misc_feature (173)..(173): n is a, c, g, or t
  misc_feature (180)..(180): n is a, c, g, or t
  misc_feature (343)..(343): n is a, c, g, or t
cagaaaaattcttatgagaaacaatgaatccctgggtgcttcaagccaacaaagttgggatggttttttacacagccaatagataactgaaacccaaggggaagaatactgacacagacttagtatttattcctgctaggtatagctacacnattcccagcctccgnttgccnctgaaancaacttttaagattaatttaaaaagcaatcagtaagtggttaattgtggtgagcataaatatactttcataaaaggaatggaaaaaatatgttaaagtactgcacggatgaagattcatggctcaggataatacttcctgtgacatgtatgattcaggaagtnccgtgtctctaacgacttagataaaagtgaggacagatgctctgaaaactgttggatgga

SEQ ID NO: 588218 - DNA, 1192 bp, Homo sapiens
  misc_feature (111)..(111): n is a, c, g, or t
  misc_feature (628)..(628): n is a, c, g, or t
  misc_feature (644)..(644): n is a, c, g, or t
  misc_feature (673)..(673): n is a, c, g, or t
cgcacttcggtatgcccttcgggagaacgggcccctaatatgagattgcgccggcacaccccaatggtaaaccaccaattggcgtcccccaattgtccagtggtctatggncacgcgccccgggaagcaagttttaatgtccaatatgcaaacaatccaggctggcgtgcctgggggtttgcttgtgggccacccatgggttcacccattacttgggggttccagcgcagaaagaaaggctgagcttgcaaggcctgcaatcactttccaggaagcttcaagggaaccaagcaagctcagagcaacaagctttctttttatatatcaaacagttttctggagtgtgcccagaaccagggtgacatcaagctctgtaagggtttcaatgaggtgctgaacaagtgccgacttgcaacggatttggcctaataaagaagttcaacctggacagatggagaatcagctctcataactaagttaatttagtataaaaatagaattgatagtgagggtataaagtgtaaccatcagttaaacctctcctgtcattcctaggttccttgcttcagaattgaaatggaagtgggggtgtccctactctgtagaatctgggactgggcaaatgttngtgtggcctccttaanctagctgttatgttatgattttattcttngtgagttaattagaataaagtcagttttcttccagaaagaaaaaaagaaataaagaggaataaaaaatattgttgggggggccgcgggacctggggagaaagttttttgaaaaccacgagcagtgtgggaggagggcgggctcgcaacaagagtgggacgtgtgcagaacaggtggaccagaagaggtgtatgcccaaagggagaacccggggggcgcagggaagtaagcgtgcgggggggattttccccacgactaaaaaataagataggcctcgcggggggagcaagagccggcagcgttgttctagagaaaagatacatcgccatacataagaggagaggtcataacgaggaggtgtctcaacaagtgggggatctctatcatcacaaggggggggggctcccacagtcgggagagagtcctagatattgccaaaatttaggccccgtgggccggggggtcgttggcttgaagcgagcgcaacgcaggggaaggcccgtggcaagccctgaatact

SEQ ID NO: 588219 - DNA, 595 bp, Homo sapiens
ctaggatgcaggtggcatgtcccaggctggggcctgtcccatggaaaccattttctggtccggggcctccaggcctgtgatgggaggggctgccacaaaggtgtctgaaaggccctggaagccttttccccatggtctgggctattagcattgggttcttcttcacgtatgcagatttctgcagccttttattcctccccagaaaatgggtttttcttttctaccgcatgtccaggcggcaaattttcccaaggtttatctgcttccctttaaatgtaagtgctagtttcaggtaatctcttggttcatgcatatgagtatatgctgttagaagcagccaggtcacatttggaatgcttggctacttagaaatttcttcggccagatacactaacccatctctctggacttcaaaggtcgacagatccctagagcaggggcacaatgccaccagtctcttggctaaagcatagcaagagtgacctttattccagttcccaataaattccccatctccatctgagacctcctcagcctggacttcactgtccatatcactatcagcattgtgatcacaaccattcaacaagtctct

SEQ ID NO: 588220 - DNA, 375 bp, Homo sapiens
cttctgaactcttctcccatccagcccatagtgtcggtgacagtgtgagggtggcagacacacttgatggcactcctttccatctgggagcatgactacttccagccttgctgagtctgtgtaggacctggcagacagttcctcttgcttagaggatggaagaagatcaggctgagtgttatgcgcccactgtgtccggcggagagaagtgcgcgggggtgtaccactaccttgcctgggctttacatggggcggggcggggagaagctggcactggaccctcaattgacgggcccttctgtgagcttggggctttggctttcatggcatggtccccgcacttggtataaagcgcaaggtcctgttgggcctagg

SEQ ID NO: 588221 - DNA, 195 bp, Homo sapiens
caatgccagagctatgatcagtcatggcgacactgcagtgcgtacttgagtgaccatatcagtccggctccgtccctcccacacgggggacaatgcttctccgcaggaggcctggccaaggtggaacaaataccctgatgtcgacaaatgtctcaaaatcccacagacggaattttcacaaagaggagaaacctc

SEQ ID NO: 588222 - DNA, 324 bp, Homo sapiens
  misc_feature (9)..(9): n is a, c, g, or t
  misc_feature (62)..(62): n is a, c, g, or t
cggatctgntaggtcgatcactgtactattggtcgatcactggtactagattggactgactngaaggtatggagcctgttgaatatagattgacaaataaaaaagaaatgctagaaaaaaaaaaactatagctacattatgtttattatcaaaattcaccagacattccatttttaaagaacctgatggaaaaatgcttcccctaacatgaactatggttagatagcattgtctgtcaggaaattcaccatttcagtagctgatctttatgtggaaccaacattagggcttggtccttattcataagtccagtgttcgaccaag

SEQ ID NO: 588223 - DNA, 1207 bp, Homo sapiens
ggtgtgtggggttggggtggtgtgtgtgtgtgtgggtggtggggtgtgggtgttgggtgttgggggtgtgtggtgggaaagaggcgcggttgtggggtgggggggttgttggttgtttttggtgtttgcgtgcgggctgccgtgttcctgtggtgggttgcttgtacgggtccggtgcggctcggtgggtgtttgttatggggaggtctggggtcggcggtgaggtctgtgcgtgcggcgttcctgcggtcgttcggctgtggacacggggccgggccgggtcggtttagcgcttttgcaatggtggcttgtgctgcttggcaacgggccgccaggaatgggacgttaacgtgcaggagccggcgccggctggtgggtggcgcgtgggcgtaggcgtgcggttggctgtcggctgggcgtcgggggcgcggcccgcttggtctgcagccgccagtcctggtgcctcaagcgctactgagcgttgagtagctgggccttccacgacgggccagcgcagtccggcctgcggcccgcggcgacgaccgtcgaccggctcggcgtctgtcgtggactacgaggccggcgtcctcgccttggtaggacgtgacgggcggcatgagccaccgtgcagaccgggccgcgccacgttccaggagccgctcgtgcccggccctgcggctctgggagggggccatcagcatcccccggctgccctaggggccaggaccggcgtgacagcctccagaagtgtcatggaagcagaagtcgtacagtagtgttcccttctgcatatgctgcgtttctcactcagcatcatttccttgagatgcagtccaggctgctgcacgcagtcaatagttcattcctggctgggcgcggtggctcacgccgtgtaatcccagcgctttgggaggccgatgtgggtggatcacaaggtcaggagtttgagagctagcctggccaagagtggtgaaagccccagtctctgcaggaaaagtagcaagaaagttagcacgggcagccatggcatgtgcctgtaatgccctgctagctcaggaggctgaggaaggagaatcacgttgaagcccgggcagacggaggttgcagtgagcgcgagatcacaccacagcactgcgagcctggcaagaaggcgggggctcggggtgggggggggcggggggcgggggcgggggggggggggggggga

SEQ ID NO: 588224 - DNA, 193 bp, Homo sapiens
accccgggcatgcctgtcccatcacgtataccccgatgaggagattgccatggcaacgtgtcactgccctgcgtcgcactgtgcccccgtgctttcccagtgagtgacctatcctgctctggtgggtcagacgcgaagaacgaggcatcacttcaaacctcaagtgccactcacaccggctgcaccccttccc

SEQ ID NO: 588225 - DNA, 484 bp, Homo sapiens
ctggtggttacaaataccctcaacatttgcttgtctgaaaaggatcttcttttttgagatagagtctcactgtttcacccaggccgggctgcagtggcgcgatctcaggctcactgcaacctccacctcccgggttcaagcgattctcctgccttagcctcccaagtagctggggctacagctgcctgccaccacgccccgctaattttttttttttagtggtttttttagtaaaaacaggtttcaccttttgggccaggctggtctggacctcctgaccttgtgatctacccgtttcagcctcccaaattgctgggattacaagcactttgagccggctagaattgaaattcttggttgaaccatttttcctggtatagagtctttcaggagttctctgcttttcctgaatttgacggttggcctctctagcaaagctggggaagtttccagggacaatatcctgaaatatgtcctgtaagtc

SEQ ID NO: 588226 - DNA, 742 bp, Homo sapiens
gctgttttcctgcgcaggagccgcaggggcgtaggcagcatggcgccagccggaatggcatggtcttgaagccccagttccatcaaggactggcagcggcgcgtggcacgtggttcaagcagccggtccgtaagatccagctagacagtaaggtccggcgaagccaagaggcgcgccgaatcgtcccgcgccccgagtcgggtcccatccgggccatcgtgcgctgcccctacaggttcggtaccactacgaaggtgcgcgccaggtcgcggttgttagacctggaggagctctagtggtggccgggattcacaagtaaggtggcccggtagcatcggcatttctgtgtgatccagagagatgggcggtgaacaagtccacgggagtccctgcaggctccgatactgtgcagcggttggaaggagtaccgatctcatagactcatcctcttccccaggaagccctcgggccccaagaagggagacagttctgcatgaagaactgaatacgtggtcacccagatgacctggaccggtcatgcccgtccggagacgtctataagaaggagaaagctcgagtcatcactgaggaagagacagaatttccaaagcttcgcatagtcgtccgttatggccgtgccaagcccggttcttcggcatacgggcaaaaagagcaaggaagccgcagaacaggatgttgaaaagtaaaaaattaagccctctgggacttggacatcagtcgc

SEQ ID NO: 588227 - DNA, 240 bp, Homo sapiens
gtccccttgtggccgatcaccctctcaggccggctacccatcatcgccttggtgagccgttacctctccaactagctaatgggacgcaaagctctctcacagcgcttatagctttcataattataggatgccctattatcataatattaggtattagcattcgtttccaaatgttgtccctagctgtgaggcaagttctttacgcgtactcacccgtcgccacccaacctaagtaaaacc

SEQ ID NO: 588228 - DNA, 477 bp, Homo sapiens
agagagaacaagaagtgatcatgtcaaagcactccttcccctacacatgcacggcgagataaaaccccaaagaacgtcaggaaaagagcaataaggaaactgacatcttagagtggcggaatctgataatgcaccacatcccatacctcttaagtgtacacactgaactggcacagacagacacattatcttcattcccccccgccttacttactacactctggcttccatttttcccaagttcttcctctgaaatcttgctcaaattatctaagtagtggtctgatattgtgtggcacaagtcttcaaacgaataatccttttcttgacagagttttatttcatccaagagttttgataattctccagtgacggtttcacttttggtcttttgggaaggagactcaacaggagatgaaatgtgtgtttcttgtgttgcatcttcctgtacaggctcttcgaggactgtagatcttc

SEQ ID NO: 588229 - DNA, 774 bp, Homo sapiens
tctgctgcgcacctgcacgctctgaacctacagcgcaggatacatttgggacttgccggctctcagaaagcgctcccagagggactctccgagctttggtttgcctacggtcggcgagagcgccgcggcagggaaccggtctggcacttcgcggtaaccagccagacttttgtcatggaaccaccgctcccggggctatgctactccctgtgccgaagacgtggcatcgtcttcatctagtgacgtgggtcgagttagtgtgtagtgttgtgtgacacagtatttgctattcatactggacctagaacgctctttatatgtctcttctggagtgatcagtgaaaaggatctactcatcaagctatttcattgttgtcgcgggctgtactcgcgccgaaggatgtctgcttggtttttacctgtctcggtctcctcgggccggctctcaccaggtgtattcctgagtggcgggaagatggtgcattgcgtgctctgtctgttgctgctgcttctccatgggcctggctgcgcctgggttgggtctggtgagtgctgcaaccgggcatgccccgtcaggggggtcacggatgaggcttccatagtgccgtgtgttgaccaacactgatcaacggcccaggaccaatgtagaatggggctgctggaattggactgcgtctggtgctagagcaacgggtgatgatgagctgcagaagatgtttggaatctggtgtcgtcgcctgtccgcggcttgcagggcagtcgaggccctaactg

SEQ ID NO: 588230 - DNA, 219 bp, Homo sapiens
  misc_feature (20)..(20): n is a, c, g, or t
cctagctgggactatgactngatttccgcgtttaaccactattggctcagtgactgtcgccttgttattgatcctgttgctgacccttgttgcttctgttgtcacctccaacaaaagggcaactcagggaacctacagccccagccgtcaggagaaggagggctcccgagtggaaatgtggaacttgatgccaccccctgccccggagagaccgactca

SEQ ID NO: 588231 - DNA, 166 bp, Homo sapiens
  misc_feature (45)..(45): n is a, c, g, or t
gcacaactcgcgccaaacggggcctaagagaagccggacttcgcngcaccatgcagtgataagggcggatcgggaatgctaacactggagattccatcgttagtgctgaggcagtatgggatcacgtcaccatggccacccgggagtacgattgttaaagctggca

SEQ ID NO: 588232 - DNA, 425 bp, Homo sapiens
  misc_feature (343)..(343): n is a, c, g, or t
  misc_feature (368)..(368): n is a, c, g, or t
cacgagggtcgaccacgaagtccggcacgtcgtagccgacccagcgtcgctggtcgggatcccaccagatgtagcgcttgcgttcgctccacggtttgccgtccgggtcggccgacgcgcggttgtagagcacccgccggtcggcgggccacgcccagccccactgcgattggctgggcgatgcaccgccgttgggcacccggcgcgcggcctggttgacggcgttggcgtacaccccggtgtagatccagcagccggcggcggtcgagccgtcggcgcgcagctcggtgtaggacgccaacgggtccgcgggctcgccgacccggtatccgttgatctcggncagcaccgcctccccgtccgggtcnccgtgctcgtcggtggggtaatcccaggtcagatccagcaatcggcggtcccgcctc

SEQ ID NO: 588233 - DNA, 133 bp, Homo sapiens
ctgaacagatatctggtgcaggatcagttcccagtgacgcccgtcagcacgctgtgtgcagaggccagtggaaacggcgcggcgcagctggtgacccactacgatgaaggtgcagggcccgtggtcatatcac

SEQ ID NO: 588234 - DNA, 235 bp, Homo sapiens
caataccgtcctctactcgcggtgctggctgggtgcggggtggtcgcattttatcccagcactttcggaggtcacggtgggtggatcacttgaagtcgggaggttaagatcagcctggacaacatggtgcaatcccgtctctactaagaatacaaaaattagccggacatggtggcgggtccctgtaatcccagctgctcgggaggctgaggtaggagaatcacttgaattcagg

SEQ ID NO: 588235 - DNA, 437 bp, Homo sapiens
tccccctgaatggaatcctcttacttactggtgggaatgaaatggcatggacgtgggaaaatagtttggcagttcctcaaaaatatacagttaccatatgacccagtaattctactcctaggtatattatgagagaattgaaaacatatgttcacacaaaaacttgtacgcaactgttcatagcaccattgttcataatagccaaaaaccagaaataatccaaatgtccaaatgatgtgtgaattaacaaaatggggtctatccatacagtggaatattattcagccagaaaaaggaacgcagtactgttatatgctgcaacatgaatgaaccctgaaaacccgctaagtgaaatcagacagacccaaaaagacaaatactgtatgattacacttatatgaggcccctagaataggcaaattcacacagacagagag

SEQ ID NO: 588236 - DNA, 240 bp, Homo sapiens
  misc_feature (5)..(5): n is a, c, g, or t
tcccnggggggcccttttttttttttgggaaaattttgtttttccctggggccaccctttttcccgggttcccctttttaaaaggcccgggtttttttttaaaaaaatttttttaaaaaagggggcccccccccccccaaaagggcatttttttttgttttttggggaggtttttggggccccttttttttccgtttctttaaaagttttttccctttaaggttttttttttttttaata

SEQ ID NO: 588237 - DNA, 953 bp, Homo sapiens
  misc_feature (277)..(277): n is a, c, g, or t
  misc_feature (284)..(284): n is a, c, g, or t
  misc_feature (536)..(536): n is a, c, g, or t
  misc_feature (586)..(586): n is a, c, g, or t
gtctcgacagtaatagatgtgttatccctctggtgctgtagctgagctgctgctgcggtattgtgcggttttgctgcgtgggtgggcctcgttttgatcgtgtgtgttgctcctgctgtgtgtctgcgcgctcggtcggctggggaccgcgccccgctgggttacccctcccggtgtgttttccccctcctatgcctttctccccccccgatgccgggccccgcgtcctttggcggggaccctcccgaaaatttctgttccgcacccctttacaagngttcctnctccgttcccgcacaaaattccccgggtttcttccccttctccgccccggggtttttttcacaggacgcccccccatcatgcgtccgcggtcttcgcccccacttcctgctatggtgccccgcccccgcggtttttattcaagtactaccttctaaccgcctgccctggcgctcaaagtgttccaccacgacataccgcgcgcgttctcgcgaggagggcgatctcccccttattctccgccccgcgaattntgccgctcccctccaactcgtagttcgccgcgcgtttgtgctcgacgccncctcttgggtagcgagccgataatctacaacggggcccctctcaaggcggtttttcccacttccatggcgcactgaagcggtgagggagacaagaggcactatgctgacccatctattcagtcctcgaggcggttacacccccgtgacactgcgagagagtttctgagactttattctcggcgcactcaaaggcgatctcttacgcttcttgcggcttgcgtccctcgttgttaccaccccttccgcggtgccgccgctcgcctaccccttgggtgatgaattcccaaaccgccttcgggggcccttttgaaattttttcggggcatgtttttttttccaaaaaaattgggccccccccacaaaaaa

SEQ ID NO: 588238 - DNA, 1077 bp, Homo sapiens
  misc_feature (406)..(406): n is a, c, g, or t
  misc_feature (1067)..(1067): n is a, c, g, or t
tcgctgaactctcgtcttcgacccatgactgctgtgttctcatctcagaagctcgtccgtaaatgagccccgaacagctgatgaacctcttctgtgctgggtttaccttagacacacctgatgatagccttcactgagctatgttagcatgaatgggccacaacgctcacccgccgctgtgttcgtaagtgacgagatccaagacaagcgacaagccgcctcgcagagcgctgtggtggttctgctcagattatgctgagctgctgggaagggaggatggatgtcaggctcattgatactgctagaggctcaccatgacatgtaggatgcgcagaggtagtgcgaagcagtgaggaactgtcctccagaagaaagattctcaatagacgcaggttggccatcttanagtggtgctgaagatattctgtgggttagctagtttgaatgagagcacagctgcaacgaagcatcatcctaaatgaaaattcattgggcaaccaagtatggacacacattgttgtccgtgatctagaacattctggagtgcccccgatgctctgcgacaacgcaccaaggggcgtgtgccgttttgtaaccgttagacgaccatgagatcctgttggataagaatcagtccatttcagcaaattacctagtacctagtgaagtggccatatcatgggaatgtaacatagaagccctgtgacaggcaatagatgggtattgctttcaaccgagcgaggaggtccaacttggcctgtcacttgggggcgcggtctgtggcggctggtccctgggcctgcgacttggggcgcggtggcagcgttccggacttagtcggttgtttccgcgcccgcttggattagctaccccggggccgcgaatgtggtgggaggcgggcccctgggttgcgccgttaccgttcgcggtcccaggcgctgtcaactcccaaaggggggtcggccgctctgcgttcggggcctttgaccccacgccggttctcgccttgtgggttttccttcgcgcgggggccccctgtcccccgcggcgactcctgcaccatctancctatctact

SEQ ID NO: 588239 - DNA, 420 bp, Homo sapiens
tgctttggacttattagttttttgttctttcagttcccttgtcaacttcaacttgatcgcttgcatttactggccacctccttaaatgagaatgtggagcggcacacacagctctttcccatggagagagtgccaccttgtggatctctaggatattgccgaggaggctcttagatcctggctccatttttccatttactggtaaactgaagttcacatctttgactttcaagcactttaataccttacctgggttcctgtctattcagttcattaatttacttattaagaaaatatttgagtgccaatcaagcattatgtagtgtatatattgggggtacttaagagttagaggagtttactattgaggagctcccaatgtgaatttatgacgttctggcacctgcgtcacgtgagctg

SEQ ID NO: 588240 - DNA, 477 bp, Homo sapiens
  misc_feature (251)..(251): n is a, c, g, or t
tctagagatctcctgagacgagtgtgctggacggctgttcaataggtgaggcatttgtcattgtacatgtgggaaagcacagtatagacacacagatattcttaggcacgacacagccacagtgacactccctccccagcacagcgtaaggtggaacagctagcaaatatctatacacataacttgcagatgatcatgcctgagtaacatggaggtggaaatatgacccaaattgggcaaacagacttgtnttcccaagaaactggaattttgatgtgagatgcatagagggtgagttgtttacagcccaccaggaggacagtttatggattcctaccagtgagtttcccagagtttccctggttattcaacagttcccaagattccatgagataccccagtatccttccactaaagtcaactttatgagctgcagttgttgtttgagccagaaccttaactactacacttccccaa

SEQ ID NO: 588241 - DNA, 251 bp, Homo sapiens
tagagcggtctcctgtgttactgtttcggaagaggtgcaaaatgaggaagtttcacatcaaaaaagacttagaaataaaacactcggatgagccaaaacataacagtgctaacggagctggtaacaaatcagagcctgagtgagcggagctcacggggcggggcaagacgcaagtggggtcaccgcagcgtcactgggaatcactttaagggaaatattctagatttttgtcctacctctgagtatggacc

SEQ ID NO: 588242 - DNA, 974 bp, Homo sapiens
  misc_feature (1)..(1): n is a, c, g, or t
  misc_feature (112)..(112): n is a, c, g, or t
  misc_feature (297)..(297): n is a, c, g, or t
  misc_feature (304)..(304): n is a, c, g, or t
  misc_feature (341)..(341): n is a, c, g, or t
  misc_feature (350)..(350): n is a, c, g, or t
  misc_feature (355)..(356): n is a, c, g, or t
  misc_feature (363)..(363): n is a, c, g, or t
  misc_feature (368)..(368): n is a, c, g, or t
  misc_feature (378)..(378): n is a, c, g, or t
  misc_feature (384)..(384): n is a, c, g, or t
  misc_feature (404)..(404): n is a, c, g, or t
  misc_feature (415)..(415): n is a, c, g, or t
  misc_feature (424)..(425): n is a, c, g, or t
  misc_feature (429)..(429): n is a, c, g, or t
  misc_feature (432)..(432): n is a, c, g, or t
  misc_feature (460)..(462): n is a, c, g, or t
  misc_feature (479)..(479): n is a, c, g, or t
  misc_feature (489)..(490): n is a, c, g, or t
  misc_feature (498)..(499): n is a, c, g, or t
  misc_feature (511)..(511): n is a, c, g, or t
  misc_feature (514)..(514): n is a, c, g, or t
  misc_feature (517)..(517): n is a, c, g, or t
  misc_feature (530)..(531): n is a, c, g, or t
  misc_feature (550)..(550): n is a, c, g, or t
  misc_feature (555)..(555): n is a, c, g, or t
  misc_feature (569)..(570): n is a, c, g, or t
  misc_feature (578)..(578): n is a, c, g, or t
  misc_feature (587)..(587): n is a, c, g, or t
  misc_feature (605)..(605): n is a, c, g, or t
  misc_feature (611)..(612): n is a, c, g, or t
  misc_feature (623)..(623): n is a, c, g, or t
  misc_feature (626)..(626): n is a, c, g, or t
  misc_feature (635)..(636): n is a, c, g, or t
  misc_feature (640)..(641): n is a, c, g, or t
  misc_feature (649)..(650): n is a, c, g, or t
  misc_feature (678)..(679): n is a, c, g, or t
  misc_feature (702)..(702): n is a, c, g, or t
  misc_feature (708)..(708): n is a, c, g, or t
  misc_feature (713)..(714): n is a, c, g, or t
  misc_feature (721)..(723): n is a, c, g, or t
  misc_feature (728)..(729): n is a, c, g, or t
  misc_feature (779)..(779): n is a, c, g, or t
  misc_feature (782)..(782): n is a, c, g, or t
  misc_feature (789)..(789): n is a, c, g, or t
  misc_feature (792)..(792): n is a, c, g, or t
  misc_feature (795)..(795): n is a, c, g, or t
  misc_feature (799)..(799): n is a, c, g, or t
  misc_feature (834)..(834): n is a, c, g, or t
  misc_feature (839)..(839): n is a, c, g, or t
  misc_feature (841)..(841): n is a, c, g, or t
  misc_feature (847)..(847): n is a, c, g, or t
  misc_feature (859)..(859): n is a, c, g, or t
  misc_feature (861)..(861): n is a, c, g, or t
  misc_feature (889)..(889): n is a, c, g, or t
  misc_feature (895)..(896): n is a, c, g, or t
  misc_feature (930)..(930): n is a, c, g, or t
naatatctccttccatcaaacaccaccaccaacacataccaactcttcccaactctcttcaatccatcttattctcatcactctttcaacaaacaacttcaacctcttcacntccttcatcacatccactcttcaatatatttacatcaacctctcttcaaatttccacccacaaaccactaaactatatcaccatatcaaatcaacaaatcaccattcccatccatacaacaacatattcctctataaacttattaaactactcctctatataaacaaaatcacctccgctctaanaacacantttctttcatacagtatacgttcactgttgtccgcancgtcaccgnaccanntaaggtntttcncacacgtgtnaccaanacacactatccaaaacagtnaccgatataanacacaacgnntgcngtntcaaaacactatcacgttgcgtgacgtnnngtagtacagtcaggtangtgccacgtnnaagtaagnnacgtccgtagtngtnggncgtcccacgcgtnnctaacgaccacgtcgcgtnccgtncgtagtatcgtcgnngtcctagntcgtgtgcncaaacaacccacccagtnggacgnngtaaacaagtnggnaaagtaaanntgtnnaacaacgnnaaaaagtagtgtacgtcccacgcgtaannaaagtcccaaaacaaacgtgggnaacggngtcgnncaaagtnnngtagnngtcgtatcaaagtaacgcaagtcgcgtagtaacgtccccactagggttgngtncgtccgnccnaanagtncaactaacaaacaactataactacataggcaacgnaaaancngtaggngtttaaggggtnancggtaacaggccaacgggtggcccattnttcgcnnaacaggtcccggcaaaacaagaaacggcggtccnatagtcatccccaatgaaaatacacttttacaatcccaaaggaa

SEQ ID NO: 588243 - DNA, 231 bp, Homo sapiens
gaggaggtcagtcatagccgccttaacgccggcgcctgatacggtcccaggagaggaggacgatgaacctgtttccccacagacaaccgaactgttactacggaaacaggggtcgacccgactcgtcccaccgagggattacatccaacccccggaacaaagatcgtacaagagatgaagagcgacgtggacccgtccctgtctccctacgccggcgcttaaggtcgactc

SEQ ID NO: 588244 - DNA, 699 bp, Homo sapiens
gagagaagccaaagcaccaccccgctccagcctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagtcacaaaaccagtcatgttgcttccatgaagcttctctttgatagaattttcgaggccatgccacctcccttccagtccactatggaattccagaatcagtcacagcctctgattttttccaagaagagattgccttcaggcattgttacaatgtcaagccgtgtactgtgcagagacgatgcgtggtcatgcacagagcctgagacgaagttcttaccactatgtgactggctggagcaaccacctgtgaatgctacatcccttggacaggactttcttggctttggcttatgaaaagctgtgcttgagacttaggtacttttctcacgtggacacactgatcccatcccatattgcatctttgaagagatggatatcaagtacactttggtagctgaactaatcatatctttctgatgtctatcgtatctcctttgaggaaaagaagacacatggtaatggatgattgggttgttcaggtatg

SEQ ID NO: 588245 - DNA, 847 bp, Homo sapiens
caaaattttttttagggtagcacccaatatttttacaaaaaaaaacaatgtcaggggcacagtgccctcgatttcatgctggaatccccgccgcagcctactcagaagacatcgagcggttctgagagcctactgggcacgttagtatgagtgctgtaacctgaagtcaaaccttaagattatggataatcttcggccaattaatgcagagtcagccattcctgttctctttgcacttgatgttgtggtgatatcattaaagatttttttttcggtcaattactttgagtggcaaaataaaaaatagcacataactgtatataataagataacgatcctacaagttcgttttgtcatcaccacataatttaaatactgaccaataacaaaatataatgccgcaaagaatgaataagtatgataagcattccccgaccacttatcattgcaacaacatgcgattatctgaaaacctaaacaataatcgatttacaaatatcacttataccaaattacgacgactccattcaaatatgtgaaatagggaatagtggaggcggggtgacgagacattcaccgtgctttacaccgctcccgtgaagtatattatacataaacctaatatctaatagaagatccatttataaaaatagaataaaaaattctgaaaagatcgattataccaacctacacgggtcaagtgtaatttctattgtgccagcgatgtttcaaatgttattattatgccgaaattaactgtaagtagtcacgacgacatcacacctcgttgcttattactaactcctatatcactcgctgttataaaagtcactaatatataagatat

SEQ ID NO: 588246 - DNA, 136 bp, Homo sapiens
  misc_feature (73)..(74): n is a, c, g, or t
ggcggcgcggaacggtagatgctgtggtgtccgctctgagctcgcagcttaaggagcttgaagatccgcgganngagggcgttgccgcgtcccgagtcccggccataaagttgcttcaagatcccggaggccaagg

SEQ ID NO: 588247 - DNA, 674 bp, Homo sapiens
tatgatcacagtgactttacgaggaggttgtggatgctccatggcagcctccagcttgctcttctttctgagagtcggctcaggcagacaagagctgctgtccttttaggaatatgttcaatgcaaagtaaaaaaatatgaattgtccccaatcccggtcatgctttggccacttgggcttctcctgtgaccccgaccgttgatcggtggggcgtagacttgacaacatcctcacagtggcacggagagaaggcccataccttctggttgcttcgatgacctgacaccgtgccctcagtgatacgtacgagtcaaaaaggaccaactggcttctgtgcactagcctgtgattaacttgcttagtgatggttctcagatctatgaccagtatatttgaagactgtaaatatgtctgtgccttaaagaggagagaagcaagtgtagatggttaaaagactgcagggtgctgaagttctgagccggggcaaagtcgcacagggctgtcggccagctgttgtgggccccggagtcaatcaggcagccttccataggcggtcatgtgtgcctgtgagcacaatgcgtatatgtgcgtctctctttctcccttcaccccaggtgttcgccacttctctgcttagcctttcaccttgggtgcccaggttcctcgatttctg

SEQ ID NO: 588248 - DNA, 726 bp, Homo sapiens
atcatactagacattgaccatctcacttctaggacatactagtaatatctgactcacactcggttcatgatcctccctactatgtcctagaaggaactgagtactatcggcttgtgccattagtagtcgtatctgctcataatcgcctcaacaccctcgactccctcttagccacaactattcgtgcctattgccatactagtctttgccgcctgcgaagcagcggatgggcctagccctactaggtctcgaatctccgacacatgaactggcgctagatcttacgtacatagcctaaatcctactccaatgctaaaatgtaatcgtcccaatcagattatagttagctaccagctgacatgactttccactaaaacacataatttcgaatcaacacaatcacccacagcctaattattagacactcatccctctactatatattatgataccaatatcaacaacaatcctattggagggctgttgccccaaatccgtttttacctccgaggccccctcaataagacccactcttccatgaatatctgagtcttagcctggaggtaccgttgcccctgcatcaatacatggcaaggcatggcccacttatccagtgaagcactgatgcgggggaaagagaagtgctaaggctctctataactaatgctccctataattctccttaatttattatccttcgacagtcatcagaatcttactccagtg

SEQ ID NO: 588249 - DNA, 1022 bp, Homo sapiens
ggtcgcgggacaccgggtgtagagggcggtcgtcgtgcgggcagtggcggcgagaatgttggctaccagggttattatagcctagttggcaagtgagcaattaccacctctgtgtgtgtacgagctcatgagacatgtgtcgtgacagagctgagagacttttctgctcccatgcttatatggatcggcagtgaccaccccttgccaggaggtggcccatgtcaagcacgctgtctgccagccagaaggcacatgaaggagaaggagaaggcctccatggagcagcctctccatggatgaggaaagtcgagttgtgatctgcaattaagttcaaggagagctattgctgtagatgaacagggggctctgagacgagtaggaagacggtctcgtcgaggcggtcgccagtgttcttcatcggtttcaccgcagctactgtgatcatgtgtgcatgaaggcactcatgtgtacggtccccctcccggcaaaggcgttcgactagaagtagtcgcggtggccaagacagtatccacagaggattgctggaactatgaccggtgaacccccgtccagggcttagcctccaaagtgggaactacgaaaggaaccgagtggacactaaacgtgagagatgctgggccttgcaggccgagtaccatgggacgtgggcatctgtacaccggccatgacaactccagtggcctatttaccgggaaaagcttggtggatgcccaaacgagttgtacgaactgctaagtaaagtgaccaagtttaccctggaagacggcatccaagcacagaggaggacccgtacaacatcgtgagacattcctcttgcttcagctgcatcctactaggcctcggcgacaataaggctggactaaaagagcccacggccggtttatgccgcgtgtggacccccagattgtgctacatcgtcacgtgctcccaaatggcggtgttcccgccagcaactaccccgggatccaacaacataggccagtgataatccgccgcatatg

SEQ ID NO: 588250 - DNA, 361 bp, Homo sapiens
attcgcggccgcgtcgacaaaggtgaaaaacagtgaaataaaaatgaagaatgttttaaatgagttcattggtagacttgacacagctgaggaaagaatctaaaaccttgagtatatgtcagtagaaacttccaagatagaaaagtaaagggaaaaaagactgaaataaactgaacagaatatccaagaactgtggaacaacaataggtgtatcatatgcatgatgagaataccaaacgaagtaaaaaaggaaaggaacagattaaatatttgaagcaggaacaacagaaattttcctgcaaattaatgtcccacactaaaccacagattcaggaagctcagaaagcattaggataaatgc

SEQ ID NO: 588251 - DNA, 506 bp, Homo sapiens
  misc_feature (1)..(1): n is a, c, g, or t
  misc_feature (345)..(345): n is a, c, g, or t
  misc_feature (357)..(357): n is a, c, g, or t
  misc_feature (389)..(389): n is a, c, g, or t
  misc_feature (428)..(429): n is a, c, g, or t
  misc_feature (470)..(470): n is a, c, g, or t
  misc_feature (475)..(475): n is a, c, g, or t
ngatctgcattcatcggcggcggcaatatggcacgcagcatgatcgcaggcatgattcgccaaggcgcccccagcacgtcaatatgcgtcatcgaaccaatcgccgcactgcgcgacgcacttatcgccgacttcaacatcaaggccgtcaccacagccacagaagcggccaccgacaccagcacctgggtgctggccgtgaaaccccaagtgatgcctgacgtgtgtgccaccctgccacttccagtgcaacccaacacaccactggttatctcaatcgctgcaggcatcaccacctgcaaactcaaacactggcttggcgacacctgtgcgattgtgcgcgcnatgccgaatacnccagccctgctaggtgccggcgtgaccggacnattcgccacctcagcacaccacggccacacaacgcaccnntcgctgaagaactctttaaccggcgtaaggcaagaccctantggancaccgaaggaagcgttaatggacgccgtgac

SEQ ID NO: 588252 - DNA, 309 bp, Homo sapiens
ccgatgactgatagcctccggagtagctaggggtatatgcgccgggacacgcccagctaattttgtatattagtagagacgggggtatcacctatgttgggcaggctggtctcttaactcctgacctcaggtgatccgtccgcctcgacccccccaagtgctgggattacaggcgttagccactgggcccgatctaagagctctaaagtgttaatgtaatgtgggcagccggttgtagaagtaaagtccctttctgtgtggtcctctggatgttactctttattacccctaggagggcaacagcgcgtt

SEQ ID NO: 588253 - DNA, 1416 bp, Homo sapiens
  misc_feature (1131)..(1131): n is a, c, g, or t
  misc_feature (1273)..(1273): n is a, c, g, or t
ttgcatgttcgtctgtctgtcgttgtaatacgactgactgtggtctctagtggtcgatcactcccctttgtgggtgtttttgcaccagaatttttccatttggggggaacaaaacccattgggtcctacacaacaccggtgtgctcatagattttcccacatgtcccccttcctggggaaacctttgggttttctattgggtgcacagagaacccccccctgattggtctccacgagctcattttcaggggggccacctgtggggaaacacaagctcccagccttttgggagataacctggtctgcccgtcaattattccccggggggaaattttgggccctttttggtggttctccccccaaggggaggcgcccctctccgttggaggatcaaggggaaacaagaatgtttcgtggcccaacaataaagagtgccccaagcatgctattccccccaggtgctgtgggggcccacagtgggcccgcccaaaggggaaagggtcaaccttggtgcacaacgccccccagaggaccacctggggttcatcaggggccccccggaaggaaaggacccctctcccgtggtggtccacaggcttttattgggtatttcaccccccgcgtttaaaagttcttcccacagggggcacacccaggttgaagaaatccctgagagtgaattgtggcaaaacgtgagtcacaagagccttgtgaagaccccaaaagtgggggaagcctcaaacgccgatatagcccacaccgctttccttgaaacaatttgcgtccacaacagctttcgtcgcccccttttcgtgcctctttggcgcttggtgcacagcacacagcacagggttgtttccgaccacaaatgggcacgagcaatttatgcacacccccctctaagagtggctttgaatatttcccacagagaggaaactcctcgcactttcttcgctttctcttggagggggttgtccccacaatgttgcccacagtggttctgttctcgcacagagttgggctaacccacacactcgtgtgcaatccacgtaacccccacttgctatcacttccaacgggtatccaaacgagtcctggcctctgtctgtggaagaccggattacacccttncccacacttgctgagaaaaggttcaaggcctcttcttggctaaatccactctcgcctcttgtggctgctgcccccgtggctgctgccacaccaccacgctgctcctgctgctgctgcacgccccacgctaaaggttgaaagnccaaggaaagaagtcgcgagaggaagtcggaacgaagaataatgggagatttggtctctttgactaatcacccaaaagccacccacttagcccgttttatttgccaaaacacagggaataaaggcttacttctttaaaaagtc

SEQ ID NO: 588254 - DNA, 437 bp, Homo sapiens
  misc_feature (1)..(1): n is a, c, g, or t
  misc_feature (345)..(345): n is a, c, g, or t
  misc_feature (357)..(357): n is a, c, g, or t
  misc_feature (386)..(386): n is a, c, g, or t
  misc_feature (403)..(403): n is a, c, g, or t
  misc_feature (411)..(412): n is a, c, g, or t
ngatctgcattcatcggcggcggcaatatggcacgcagcatgatcgcaggcatgattcgccaaggcgcccccagcacgtcaatatgcgtcatcgaaccaatcgccgcactgcgcgacgcacttatcgccgacttcaacatcaaggccgtcaccacagccacagaagcggccaccgacaccagcacctgggtgctggccgtgaaaccccaagtgatgcctgacgtgtgtgccaccctgccacttccagtgcaacccaacacaccactggttatctcaatcgctgcaggcatcaccacctgcaaactcaaacactggcttggcgacacctgtgcgattgtgcgcgcnatgccgaatacnccagccccttgcttaggttgcctcgggcnttgtacttgtgtacttntccgcctnnactttctaactatctagtcaggctc

SEQ ID NO: 588255 - DNA, 264 bp, Homo sapiens
gtaaaaaataaaaagtctaagaggatacacagaaattttaagtggttacctccacggaatgggattaggggatcagaggtgaggaactcatggtttggctatttctcgttctttctgcactgtttcaaattttacagtgtattattgtacttttaaaagatagctgcacagctagcctcaatggctctatttgactagtcttagtaaaagtagatttaatgagcaccctaactcagcagtccatttttttacactggatatcta

SEQ ID NO: 588256 - DNA, 919 bp, Homo sapiens
  misc_feature (15)..(15): n is a, c, g, or t
  misc_feature (36)..(36): n is a, c, g, or t
  misc_feature (46)..(46): n is a, c, g, or t
  misc_feature (59)..(59): n is a, c, g, or t
  misc_feature (120)..(120): n is a, c, g, or t
  misc_feature (127)..(127): n is a, c, g, or t
  misc_feature (131)..(131): n is a, c, g, or t
  misc_feature (133)..(134): n is a, c, g, or t
  misc_feature (140)..(140): n is a, c, g, or t
  misc_feature (143)..(143): n is a, c, g, or t
  misc_feature (151)..(151): n is a, c, g, or t
  misc_feature (162)..(164): n is a, c, g, or t
  misc_feature (166)..(166): n is a, c, g, or t
  misc_feature (181)..(181): n is a, c, g, or t
  misc_feature (188)..(188): n is a, c, g, or t
  misc_feature (191)..(191): n is a, c, g, or t
  misc_feature (197)..(197): n is a, c, g, or t
  misc_feature (204)..(204): n is a, c, g, or t
  misc_feature (206)..(206): n is a, c, g, or t
  misc_feature (215)..(215): n is a, c, g, or t
  misc_feature (230)..(230): n is a, c, g, or t
  misc_feature (234)..(234): n is a, c, g, or t
  misc_feature (326)..(326): n is a, c, g, or t
  misc_feature (336)..(336): n is a, c, g, or t
  misc_feature (357)..(357): n is a, c, g, or t
  misc_feature (383)..(383): n is a, c, g, or t
  misc_feature (386)..(387): n is a, c, g, or t
  misc_feature (399)..(399): n is a, c, g, or t
  misc_feature (401)..(401): n is a, c, g, or t
  misc_feature (404)..(404): n is a, c, g, or t
  misc_feature (414)..(414): n is a, c, g, or t
  misc_feature (442)..(442): n is a, c, g, or t
  misc_feature (448)..(448): n is a, c, g, or t
  misc_feature (451)..(451): n is a, c, g, or t
  misc_feature (469)..(469): n is a, c, g, or t
  misc_feature (485)..(485): n is a, c, g, or t
  misc_feature (489)..(489): n is a, c, g, or t
  misc_feature (493)..(493): n is a, c, g, or t
  misc_feature (498)..(498): n is a, c, g, or t
  misc_feature (513)..(514): n is a, c, g, or t
  misc_feature (525)..(525): n is a, c, g, or t
  misc_feature (539)..(539): n is a, c, g, or t
  misc_feature (544)..(544): n is a, c, g, or t
  misc_feature (555)..(555): n is a, c, g, or t
  misc_feature (566)..(567): n is a, c, g, or t
  misc_feature (575)..(575): n is a, c, g, or t
  misc_feature (585)..(585): n is a, c, g, or t
  misc_feature (886)..(886): n is a, c, g, or t
acataactgggacangccctggccgggagtattcanaagccaagtnggttgctggtgancacaccaccccgctccaccaaggccttggagatgcttttgaagttgcggtagagctcttantgccagnagtnannttgcanggnggccatgncctctcggatnnnanctgcagcctcgatanaccaggngtnacagancattttntnatgctgggncgtggggtggccctnattnagggattttgaggccctcgagagaaccaccaccatggcatagaggtcgatggccccgtctgctagctgctgcagcagaaactgttcattganaatccccttnttgtgttttattagcttggcntccaccacagtggcaaactgctccanatnncgtattgctagntngcnacttcgattnaactccgggtggacaagttcgctgaganttaggntgntgctcagccctgcccgcngcctcatctgtttgcntgcntctnctagnaggaggccagcattnncaaagggattntttagagcactgcnaagcncagagagctcntttcctttgtnnatacagcnctgcagagcnacaaacagccgaagaatgtcatttgtcccctcaaagatccggaagatgcgaagatctcggagcacacgctctactccaggttccttcatgaagcccataccccccatgatttggatgcattcatctgtcaccttccaggctgcctccgagccaaagattttgctgatggcggcctctatctggaagtccgtggctccctggtccatgttagcactcaccatgtaagccatggactcagttacatactgcagcataaccatccgtgccagcttctcctggatcagccaaagttgtgaatttntcccaaactgggtacgattagtggcatgatcta

SEQ ID NO: 588257 - DNA, 779 bp, Homo sapiens
gagccggggtgacgagggcccggccctaggggctggtgggcaccgaggagctccgcgcggctgcagcgcgggcgggagcggggacgcgatgtcgcctgccgccgcgtccttgcggtgcctggggcatgcgcctccggggctgagcctgccgctcagagccaggacagcctgagcatgcgctgggctgctccctgcgggcgcaaggaggatggtgctgctgggctgggagcctggtgctggatgccatcagagcacccgctactacgagaagctggaccctgggagacagaatccagctggctcagctacacgcgacatctggacgctgccgacccagtcgcctgacggccccggagcagcggacccgaaagcgggccggcctgcacactcgggctaaaagagatgctaagaagaatgcctgcaaggcgaagtcaccattaatgtgaccagctagcatccaacgcagatggcacacgaagtcgaagaatcagcaagggaactgttgtccacactagcacgagagtgcgaagcaggcagggcagatggacttcttcagtgtccttcacggcactggatcccatcaaagcacaccttgaagcaacgtggcctgccccttggctgggacctgaactatctacctcgacgtccctgggcacaagaacgtggccttaccctggccatgcaagactggctgccctgaatatggaggagacccttactgcagccatactacattatccattgtacaactgacttcggcacaactcgctcacattatg

SEQ ID NO: 588258 - DNA, 109 bp, Homo sapiens
gttgtgcttcccacaggagaatgcagacgtgtcctcgatgccagcccttccccagatcaggacccatcctcttggtcacttggccctctggctgcatccctaccgagcc

SEQ ID NO: 588259 - DNA, 257 bp, Homo sapiens
acaatccaatattacactgcaaatgaagcatgtagaaaatagctgaccgggtgcggtggctcacgcctgtaatcccagcactttgagaggctgaggcgggcagattatgaggtcaggagatcgagaccatcctggctaacatggtgaaaccccatctctactaaaaatacaaaaattagctgagcgtggtggcttgtgcctgtaatctcagctacttgggaggctgaggcaggagaatcgcttgaacccgggagtcg

SEQ ID NO: 588260 - DNA, 100 bp, Homo sapiens
cgctcatctagtgagatcatgtgtgattgtggcacaacaagaaaacggatgtgacaagctacagagcgaatgtcatccacctaccaaaggcattctcgtt

SEQ ID NO: 588261 - DNA, 411 bp, Homo sapiens
actcactagagaacacttatatccatatctgagggagaactcactgtggctcaatgatctggacatacacaggaaccaacacagatactggaacagaccaggagaattgaaatggaattcactagaagagttaaacagcagattcgacgcaggcagcaggcagaatcagataacttgataataggacaatggaacaatatctagtatgaggagcagcaaggagagcatactgacgaaaagtgaacagagcatacgggacctgtaggacaacatcaagcggattaatatatgtattatggaagtcacagaaggaggagagagaaaggagacaaaacatctgaaacaataatggctaaaaatgtctcacatttgacaaaacatgtaaatctacacatccgagaagctcagctg

SEQ ID NO: 588262 - DNA, 249 bp, Homo sapiens
gcccttaaggggcgggttttttaaaattggggaggggggagcccccccccccctttcccccaaatttggggggggggggggggaatttttttttttaaaccccccccccccccggttccccggggggttttttttgggggggggcccccggggtttttttttttggggtttttttcgggccccctttttttttttcccccgggggggggtttttgttttttttaaaaaaggggcctttttttttgggga

SEQ ID NO: 588263 - DNA, 479 bp, Homo sapiens
gctgtactgaaaatacaaaaaattagctgggtgtggtggcaggtgcctgtagtcccagctacttgggaggctgaggcaggagaatggtgtgaacccaggaggcggagcttgcagtgagccaagatcgcgccactgcactccagcctgggtgacagagcgagactccatctcaaaaaaaaaaaaaaaaaaaaaaaaaaaaaaaaaaaaaacacccggggggcttatatatgtgggggggcgcgggaaaaaggggtaaacgaaaggggccaaggggccaaatacggggttcccggtgcacccagttttttgttggcccaaggggggaaaaactgggcgggggctccccaaaagaggggaggggaaataaaattccggaaatacgcgcgggggttacacgcggggatatttgaggattccgcggaacaatgccccacgagaaaaccccacccggccaaccgcgcggctagtcgaaaagggta

SEQ ID NO: 588264 - DNA, 567 bp, Homo sapiens
  misc_feature (36)..(36): n is a, c, g, or t
  misc_feature (54)..(54): n is a, c, g, or t
  misc_feature (73)..(73): n is a, c, g, or t
  misc_feature (111)..(111): n is a, c, g, or t
  misc_feature (130)..(130): n is a, c, g, or t
  misc_feature (149)..(150): n is a, c, g, or t
  misc_feature (206)..(206): n is a, c, g, or t
  misc_feature (364)..(364): n is a, c, g, or t
  misc_feature (388)..(388): n is a, c, g, or t
  misc_feature (393)..(393): n is a, c, g, or t
  misc_feature (402)..(402): n is a, c, g, or t
  misc_feature (483)..(483): n is a, c, g, or t
  misc_feature (520)..(520): n is a, c, g, or t
  misc_feature (532)..(532): n is a, c, g, or t
  misc_feature (560)..(560): n is a, c, g, or t
tcagctcctccgatgcccttaccagttacatcaccnctgctgccatccccaccngccgccgtcggaggagccngcgcgactgccgttccctcagctgcttcgatgacttcnaccagggctgcttccgcancttctgttcacgttcctgnntctgctcttggtgcaggatctgcagctactgctgatccagaagaaatgtatgtgcntagagttgtattttctgttataacagattttaggttttaactattacagcccggatcacaggaagatgtgattttgcttcaaaaaatagaattagcagcagtttagctataatgggagtttctcctcccatggagctcagttgttgtgggaaaaaccntcatgccagttcacagtggcaaancattncttcaaggnaactgcagtcaaaatatccccgggaccattcatcctggaaagtagtaccttcagctttccagatcactgggaaccaggatnagctcacacccagtcttttaaaagtgttcattccctnaaaagtggttgnctaaagtgaatatggtccatagtggggncttttaa

SEQ ID NO: 588265 - DNA, 106 bp, Homo sapiens
gtgctatgagagcgaggggaggcggagacggaggaaggtctgaggagcagcttcagtccccgcacgagccgccagccgcgaggtcgcaggacggtctggactcccg

SEQ ID NO: 588266 - DNA, 110 bp, Homo sapiens
ctcggacactgaccacatgaaaaaccccgtctctactaaaatacaaaattacgtcaggtgttgtggcacatgcctggtatttcgagctacttgggaggaattcgcttgat

SEQ ID NO: 588267 - DNA, 350 bp, Homo sapiens
agtggggtgggttatcaaagcagtggacagaaggtgtggagctgcaaggtcacaagtctgccagaaagctcagaaggctaaatgaatattatccctaatactggcacccaatcttaatcagtgggtgaagaccggtctcagaacggttggtttcaatttggccatttaagtttagtagtaaaggactggttaatgataacaaggcatcgtaaaaccttcagaaggaacggagaaggttgcgtgcaccacttgggtttcctttttggcgtgtggcagttttaagttatcagtttttaaaatcagtactttgtaatggaaacaacttgaccaaaaatttgtcacagaatttg

SEQ ID NO: 588268 - DNA, 125 bp, Homo sapiens
tgcagctgacagcctatgtaatgtactgtaaagactgtaactagactctcagttatgaacacatcagactgctgctctgagtgttctactataggtattatcttgctctctgagtacgctgtagc

SEQ ID NO: 588269 - DNA, 403 bp, Homo sapiens
  misc_feature (403)..(403): n is a, c, g, or t
ccgcactgcatgcgaaggcctgtgcgcagtgctatgcgctcagtaacctgaggcaacatgtatagcagaacttggctagactcgattcacaagtactgtatatttctaatgagtgagagcagcagtcttacacattgcactactctgatttgagagactaccatgaccagtacactctgcccgtcagaggaactataatgaccacatccttacactctatggccttgactaacgcacttatagaatatgcacaccaagaagcgacatcatagagcggagacaccgggagatgtgtattgaacaaaccgcagctgtcagattgcaacgtcagcagtgcacgaacctatgctagaggactgtgacacgaagccacagaccaagtgactggtactctggtctgcgn

SEQ ID NO: 588270 - DNA, 108 bp, Homo sapiens
ctagaggatccctttctccagtgtgggaggggtgtcggatgagtctgagaagcagaaggaggtcggggagtcatgcaagaagggacgtctatgcaagaagggacgtct

SEQ ID NO: 588271 - DNA, 150 bp, Homo sapiens
tacttcagtaacactgaagcaatactggtccaggatgtaaggcatgatagctagctgacattgaagaattatgtggccatcagaaggcactttcttcaataaaagatgaatattaatcagacacaactttatatgtaatcttcaactaaa

SEQ ID NO: 588272 - DNA, 239 bp, Homo sapiens
tggttgcggctcccactggtgttgtggcctcccactgggtggcttcatttaatccttactataagccttatgagatacatataattatccccaggatgtagtcaagtaactggctttttttttttttttaaattaaggggtagggtttggcccggtaaccagggccagggtacgggggcgggattcacaattcatggcagccttgaatgtctggggctacagttgatcttccaaccttc

SEQ ID NO: 588273 - DNA, 123 bp, Homo sapiens
  misc_feature (36)..(36): n is a, c, g, or t
  misc_feature (76)..(77): n is a, c, g, or t
tccttatacttctttcttttctctgttcatttttgntttccttattgtgaattttttaagttgatgtgtttcattnnttattttcttataactgacaaaaccacacacacacacacacgttgt

SEQ ID NO: 588274 - DNA, 360 bp, Homo sapiens
tgctgggcgtgtatctctgaggttgtttcatgagtctggttctaagagtttggcagggtgaatgattttgctaaggtgatgctcacaggaatgggaaccaaaccttgaagaagcaagtacctttgcccttcatggcctgtctggtttcctttagtttctaatatttgcaaacacataccaaagattcccctagcaaaccaatgtgtgtttacagagttccagcggtagtaccccagagtttgaaagtgtgggtttgaatctgagggacaccttaatgactagttcacttggcgcctggttgaatatcgatcacagttcgcatataagagagatatctcagtccacacaggagacccgtgc

SEQ ID NO: 588275 - DNA, 166 bp, Homo sapiens
gccccttgggggggggggtttttttttcccccctggcctttcccgggccccgagtgggcctttttttcccctttaacccttttcccccccttttttttttgatttccccgtttcccttttttcttccccctttccaaattttttttaaggtttttttgcctggtta

SEQ ID NO: 588276 - DNA, 460 bp, Homo sapiens
ctctaaggtcctctagaggatctgctatgctggacaaggggagcagaataaacaaacaattagccattagctgtctcttttgagacgtcctggcctttggaggagagcataccagattctctagcacaggtggcatggccgttggtataaggaaaaacaaaggcagcaaatcctcgtctttaaaccagaacagacacaaacttggtcaggaaattttaccattctgaaagtccgtatcacctaacaaggaaaaccttcttatcctggccatgaatctagcagtgatctttcatatcagcaaaagcagcctaaccagtcccccagaaacgtcagaaaagccctcgattggggtcacaggcctgggtgtcctcaggtggcagaactcgaacagactgctgcctccatgccaggtgtgacactgggatgtgaacctaaatgtgataataaatatcaggctcca

SEQ ID NO: 588277 - DNA, 319 bp, Homo sapiens
taggaagtcagggattgtgtgatactatcccacacgtcgggcaggcctggacttacctatccataatcccagcactttgggaagccaaggtggaaggattgcttgagcccaggaattcaaaacgagcccaagcaacatggtgagactccgcctctacaaaaaatttctaaaaattagctgggtgcagcagcacgtacctgtggtcccagctactcaggaagctgaggtggaggatcacttgagcccaggtcgaggctgcagtgagccatcattgcaccactgcactccagcctgggtgacagaatgagaccctgcctca

SEQ ID NO: 588278 - DNA, 603 bp, Homo sapiens
  misc_feature (37)..(37): n is a, c, g, or t
  misc_feature (233)..(233): n is a, c, g, or t
  misc_feature (248)..(248): n is a, c, g, or t
gtcggtacctgatacatcttgtagtcaatattttctncaatagcaacctgttttgcctttttctttctttcttttttttactgagatggagtctcgctctgtcacccaggctggagtgcagtggcacgatctcagctcactgcaacctccacctcctgggttcaagcgattctcatgcctcagcttcccaagtagctgggattacaagcatacgccaccatgcccagctaatntttgtatttttagtngagagggtttcaccacttggccaggctggtctcgaactcccgacctcaggtgatccgcctgcctccgcctcccaaagtgctggaattataggcatgagccaccgcgcctggccatcatcctaaattcctttctatacctcactccctacatgtattccatcaaacagtctcattggctttccctccaaaatactaatatatcatgaatctgaaaacttaagttgctttcttgccaccagccacaccagacttctcatctggattactgcattcgtgtcctgaccattcttacttcctccactcttgcccaatatagtctttctcctagatgttcgggggatctctgagtgactgc

SEQ ID NO: 588279 - DNA, 270 bp, Homo sapiens
gtcgactaaaaacattagtgttttaggccggcgacgtaggctcatgctgtaatacgctgctgaggtcaggagttcaagaccagcctggccaatatggtgaaacccatctcaactaaaaatacaaaaaattagctgggcacactggcgtgcacctgtaatcccagctactcaggaggctgaggcaggagaatcacttgaaccagggaggcggatgttgcagtgagccaagatcgcgccactgcactccaccctggacaataagagggaaac

SEQ ID NO: 588280 - DNA, 1226 bp, Homo sapiens
  misc_feature (1226)..(1226): n is a, c, g, or t
tgggtaaaggagggggtttttgcggggtcaccggtggactcaggagcagtaaaatcacccacaaattcgacaggggctgaggaacctccagtgcgtgaaggggcagaaatagcagcaaagggcgcgtagggagacggaggggactcggggcgggtgcctcgtgcaggtcctccccagagagtgtggctcatacggcgagggatgccgcctcgataggacacccgtgacagccagaagcgcgctccgccgctcgggggaggcgtggcgcctccgtgcgcattctatcagcggggaagaagcagggtggcgatatcagtgtcgtgcgtgcccggggggccagaaggtccgatcagtggccgtggggactggccgccaaaaggcagcgggaaagcgagggccaacaaatgggaaacccaaattcccccaaaacactcgggcaaccggggctaaggtatcccaggccgaacgagctgaggaactcgggctcgagcgataaacagaggtctggccggcgaggaatcacactaagccgggcactcacaacgggggcccacgggtctccaacagctgggggtccccggggcagccacagggcccacggctcccttgctcccagacaaggacacatagctcgtccgactcgctgcagcagtgcccctaatcgcgagcatgccgggggcgaacacggccggggcacaacctctccaccaccatagtcagggcgacagcacccccatcacacgccgcccctagtgccctaaacccgccaacccgtaaacaccccccccacgggacccaaccaggcaaacctggaccccagggagtggcacccgcacaccaacggggggcacccccacaacgacaacccccgaaataggcacaccaccactccacagacagcaaccacaggagacccacaagcgcggagacaacaaattccttccacaaccaccagaactacagcaaaacgacgacgccggggcgcgccaacatcacagcgcagcccggggagaaccacacaccatggaacaaccccaacgggcgtaagacaagacaaccgagcggacggagagccacgaacacaccgatcgctgcaacagaacacgcgcgccgagaagacgcacaccagcaacgccgaccacacaccacgcggaagcaagcgaacccgcccaacccgcacaacaaggagcgagcagcacagcaaaaaaccgctcagagtcgtcaan

SEQ ID NO: 588281 - DNA, 408 bp, Homo sapiens
  misc_feature (63)..(63): n is a, c, g, or t
tattgtccccgctaaaacaaaacaaaaaactctttaatccttccccattaattagatttctcngccgtttttttatggcatttttttaaagatgccctaagtgttgaagaagagtttgccaatcccaccaaatatttaattcccggttgttaaaactgggttagccccatttatattttccctctcttgccttttttatttgcaataaaagggattgagcccttttttaaatgccctttttgataaattatgtttgggctagttgatgaaggagttttttttaacccgtttatataattttgcagccgaagcccaattttttgtttatttaagccccaaattcatggacagcatgcatcccggatcaatagactggacttattttccaataaaattttccaactttta

SEQ ID NO: 588282 - DNA, 571 bp, Homo sapiens
tgcatcttgcacaccctctttcataaaacataatctaccattgctactttgagtttcttttgggtggggtcagaacttaaaggcgtatgaactgatatgcttcaggagttttaatttgttttcaattttatacagtagtttaggacacccctcatctgccaagaacttttttctgtgacattcctttattggatttttcaaactgttcagcttagtttgtggatactctttttgtcagtttatatgataattaaattactcaacacgacgataacaagtacaactgacatcaaacagatgtgtgaacaaacaattgattcttgacaagcactgaattcagtggtgtgccagtgtgctagggagtggcctaaaatctagatgtgggccttggtcagtttacgtttggaatggagaatcttgattgacccagcagtccatttaagtggaggttggcaaggaaacttggcctgaacttcattttctggtttgaaggcaatgacatgctttcattctttaatcaggaacatgtgaaccgactggcattctgtattctgaattcctcctgttttta

SEQ ID NO: 588283 - DNA, 188 bp, Homo sapiens
  misc_feature (75)..(75): n is a, c, g, or t
ctagtgcaatgaatctgagagaggctactcagtagacaggtcccagcgcctcacacgattctttacctttcactncatcttgcccttcattattgcagccctagcagcactcctactcctattattgcactactcgggatcatacaacccattaggattctcattccatccctatccatggacgttcc

SEQ ID NO: 588284 - DNA, 439 bp, Homo sapiens
  misc_feature (389)..(389): n is a, c, g, or t
gttgtcacaatggtacttgggattgaattctgaagtacagtgaaggtaaagcgtgactgtggctttcccacgtccatttggctacaaagcttaattaagaaccaactgaacacataaagaggaagcctaacgaaagcagaagaggcatttgcgggaacagctcgtggggaggaccctcaaccagtcgtgctagaggaattaaagacacacacacaggaatatagaggtgtggagtgggaagtcaggggtctcgcaaccttcagagctgagagcttccaacaaagatttacctatgtctttattaacagcaagccagttaataagcattgtttctatagattatagattaactagaagtattccttattggaaataaagggatgggtctngctagttatctccagcaggagcatttccttaaaggcacaaatcactcatg

SEQ ID NO: 588285 - DNA, 424 bp, Homo sapiens
  misc_feature (37)..(37): n is a, c, g, or t
  misc_feature (137)..(137): n is a, c, g, or t
ccctgcaaatagaatagatgttgccagattgctcttncaaaaaggactttttaagatccagggagacaagactggaaagtcctttgttttttgaaaagatattttaatgggtatagaattctaggtttattttattntatttttttgagacagacagggtctccactctatcacctgggctggagtgcagtgacatgtgaacatggttcattgtagccttgacctcctgggttcaagcaatcctcctgcctcagactcccaagtagctggggtccataggtgtggccaccatacccaggtaatttttaaattttttgtagagatggagtttcgctatgttgcctaggctgatctcaaactcctgggctctagtgatcctctgcctcagcctcctaaagtgctgggattacaggtgtgaatgact

SEQ ID NO: 588286 - DNA, 353 bp, Homo sapiens
  misc_feature (353)..(353): n is a, c, g, or t
acgtgattgggtcctcgctccctcgatgggcaggcttggacttaacctttttgatcttgaaggagaacacaatatgtaagctgcaaatgtgtttccatgacaacagatacgacatgtctcagaagaggtatgaatatgaggaccagaatgttctatttccaagtgcattggagattcctgttcacaactaaggtttgaactgacgctcattggaatctcttgctgttccaattgcaaagatttatctggggctgaagctaccacttcttcaggtctattttcatgtagaaaggtacatcatgttgggtcgatatggagtcattatactttatttgcagccattccaccccccn

SEQ ID NO: 588287 - DNA, 1088 bp, Homo sapiens
  misc_feature (254)..(254): n is a, c, g, or t
  misc_feature (796)..(796): n is a, c, g, or t
ccgcgacccgcccccgcacaaaactcacaaaaagagaaaaagcttggccgcaacggagacttattatttatggcgcattaaactgacttttactttgaggtaaactctcaatttcttgactctccttaaaggaacacggtggtggggggagaggcggtgctaagagagcctcctataatattgggtccattttagttaaataaccattccattagtgttatcacgcgcagaggtagaacattcatccttacatngaatggcataaatatagcttgtcatgaatgcatggcatgcatatctcgatgctctcattctagagttggcccgtgcaagacccgctattaatccctctgggttgtgggtggctcgttatgtccttaccatcgacttgtggtctcagaacataatagcacatggttacatgatgtaaaacaagtgtcgcgaatgtccattcttgattccaccgagtctgtttatacatcgtaggcttgtatacatcaacatgcggggaactaactcttaggggaatttgcatgaccccctcacagaactgtttggccttgtgtataacgccctcttataaatgcttatgttaatggcgcggattaggaattatataatttgattaggcgtgccctgtcaaaacttatcttttcacgagccttgtatgtgccatattttttactgaagtagcgtgacgatatcttactcccgctcgttatcgccctgtataagccatcacatgatcgcctgtgaacatccacagcaatatttattattccgtccgtgtatctgnatagatgcccttcctacgtggagttctatatacccttgtcgccgagcgaatctcatgtcccaaatgggatatacacctggttattattatatcatcctttgtgtggtacctttaggacatgtacactaattttatgttctgaataccacacctgtttatgcaccagtcgctaataatcggaagatagatcgcctcgccgccgactatcttagcgttttatcataaataatcggcgccgtaccatgcttcattagacactccacgtgcttcattattgttaatatcaccgttt

SEQ ID NO: 588288 - DNA, 854 bp, Homo sapiens
ccgatttttcaaatgcgtttttgtcaaaccctcaccaaattttttcccccccggctaatcaccattgcggcccctccttgtccaagtgccccttggacgccaaaattcataaccaacgccgcatgatcgtccttggcccaatctgaagccttcatcctcgctccctggcaaaaatgttctccaatcctccccacacagcccctcgcttgtaccaccacccaatgctcgtccccccgacccccctgcaaagttctaccccggcgccataaccatttttcttatatcatctgcccccccggacattgacacatctccccactcaatatattctcccctaccccaactctcgctcaatttacgggacacccacttctcccaggtcgcctattctcacacctcctcttcttcaaggactcgtctcaacaggtctatctgtctccgcccaaggtaaagacaggttttgatcgagacttcactagccaaaccttcttggcttaacactccgcctcatatcccccccccctaggtcacaacatacctgggaggaaccctcctctgtgcttatgatacccccgttttcccttgaccaaaaactactgctcactagagtacacgggcttcacacactaactatggtcgcacccgctcataactcgcctgtgacaacaagatgttagccgccgcacaccatgtggggtcacattcagcccagcaaaccacgtaaggcaacacatgaaccccctacatttaccaccgacgacaacacccctcatagagttgaacaacaccctatgccccccttttcctccgtaatcccgatcaccccggacaaccattcccgggtttcccatggc

SEQ ID NO: 588289 - DNA, 124 bp, Homo sapiens
aataactgggttctccatactgtccattggtctgtctgtctgctttagtatcagtaccacactgtcttgatgactgtggctttataatattgcctgaagtctgggagagtagaccgctcttacc

SEQ ID NO: 588290 - DNA, 231 bp, Homo sapiens
tggaatgcctgggagttcagcagctctaaatggcaggagcttcttggttgaggaataactcatgtgaagcgtggcttggggccttgagacccctgcatccacgcgagagtgcaccccaccctccccgccgtggaccccagaagaccatgtcctccacgctctattgggaaggcgggaaggtgggacctgggggtgtctgaaaaagcccctttgaacttgaggccagtttgg

SEQ ID NO: 588291 - DNA, 354 bp, Homo sapiens
aaaaacacttaaacagggggggggtcttttttttatttttttaattaacaaataataattgcccatattcatggggtacacaatgatatttccatacatataatggggagtgatcaaatcacggtaattagcatatccatcatctcaaacacttaacatttctttatgttggaaacattcaacaacttccttccagctattatctatttgaaactacacattattgttaactacagtcatcctacactggtacaggatattttaaacaatgagtatttttcttaaaacatgaacaatggcttggaaaacaccacacgttcaaaaattgtgtgcctagtatggcgccaaaggaaa

SEQ ID NO: 588292 - DNA, 713 bp, Homo sapiens
gagaaaagagagaaaaaaggagagggagaagaaaggaggaaaggaagaggagaaaagaaaaaggaagggggaaaggaggaaggggaaagaagaagaaggggaaagaagaggaaagagagaaggaaagagaaaagggagggaagagaaagggagaaaagaaggaagaaaagaggaggaggtagagaaaagaggaggaaagagggacagaaaaggagaaaggaaaagagggggaaaaaggaggggaagagagaagggagaggagaacgaaaaaaggagagaggaaaaaaggaaaggagaggaaagggagagaaagaaaggaagaagaggaaagataggaagaggaaagagagaataaagaagaggaggaaagaggaagtgaagaaggagaagaaaagtggagatacaagagcagagagagaggaggaggagaaggaaagaggaggaatagaaaagggtgtagagggagtgaagagaagttgagaaaaagagggaggaaaaaggagagaggaagagaggagaaaaaggaaagggaggagaaagggaatagaggaagaaccagggaggacagagaagttagcaagaaggggagagagtaaaaaaaactcacagtataagggacacagtcacacacactatataacactactacactactactactactactactactacactactactatatatatatatatatatatataatagtg

SEQ ID NO: 588293 - DNA, 1396 bp, Homo sapiens
  misc_feature (515)..(515): n is a, c, g, or t
  misc_feature (776)..(776): n is a, c, g, or t
  misc_feature (779)..(779): n is a, c, g, or t
ttttgttcttgttttgtgttgttggtgtgtgtggtgtcgttgtgtgtgtcttatttttgctttttgttgtctgcgtttggttgttgtttttgtggtctgtagttttcttgtgttgtcttcgttctgttcgtgttgttgtgtgtgttttgtttttgttctttgtttttgtgggtttggtggggttcgcgcgcgtcagctgaagtcccgtcatttaactaccctttggtgtcaaacacccacgatttggggcacactatgtgaactcctgagggtcccccccaggtgggcgccacacaacccacggcgtttgtttaccgtctgcccccgtgacttattaccggtctttaaggtacctaagctcttgtggtgcgcaattttggcaccgaagggggaaacaccgcgggtgactagttagccactgggtccaacacccccccgcgcgtttttcacaccattggcccgtcggaacggcgagaccccttggcccgcggttgtccctttgaacctgtttgccnagaaccaaggtccccacagagcacccgccaggaagatttttccgtgctcttggacgccactgggagaagataagagatattggttatttaaagaaggttctcctgcgtttctaccacgaattttatatttcccacgcggtttttatatagtgttcccacagcggttgggtggaactcttgcacacacccgccacatatattgcggcacctcgtgtggcgcacacagtgcacacatctttatatggggggagagaacacatnttngagaaagagtttgagagagacacttctacttccctttaaaggacacatattccggggtctcttggacacatctttgtgtccaccatggcacacaaatgcgctggagcgccacacacacacacacaatggagtttctccacacggtgtgttgtcacatctgtgacacacgtgtcccaagagactgagaggtgggttgtgagatgtgcacagccatgttggtgttttgcgccaaaagatgtgaaagaaagagccatgtgaattattgttgggagagcccatgggagcccctttgggtcccagaggaatggccagaacccacacccagaaagaatctcacccattgcgtggaccggtggaccaacatctggataaagtttgacattgtgtttttatctttaacccacccagatccattcctgtctgtgagctccaggagagccaccccctcccacccccatattgcgtccgccagtgatccttagaatcttttgggcgtcttccgcgcccagattccccttgggtgtcccaagttttcccttggtcccctccccagccttagctgggttgccagagttaagatttatgattatgaaattaaaactataatacacccattt

SEQ ID NO: 588294 - DNA, 342 bp, Homo sapiens
  misc_feature (10)..(10): n is a, c, g, or t
cctagaatgncaaatcctgatcattttaccttgaaggcctaagttttgccagtgacatacctttagagcagcactgtcctgataggaatagaatgttagcttccatgtatacagatgtctcccttgagcttaggatgggtttatgtccccaataaatccaccataagttgaaaatattgtaagtaaaaaatgcatgaaatacacataccctactgaatatcatagcttagccaagcctaccttaaatgtgctcagaacactgatgttaacctacagttgggaaaaatcatcttacacaaaccctattttataataaagtgtgaatatctcgtgtaaaaaaaa

SEQ ID NO: 588295 - DNA, 204 bp, Homo sapiens
  misc_feature (4)..(4): n is a, c, g, or t
  misc_feature (73)..(73): n is a, c, g, or t
  misc_feature (91)..(91): n is a, c, g, or t
  misc_feature (112)..(112): n is a, c, g, or t
  misc_feature (127)..(127): n is a, c, g, or t
  misc_feature (142)..(142): n is a, c, g, or t
  misc_feature (156)..(156): n is a, c, g, or t
  misc_feature (159)..(160): n is a, c, g, or t
  misc_feature (164)..(164): n is a, c, g, or t
  misc_feature (169)..(169): n is a, c, g, or t
  misc_feature (174)..(176): n is a, c, g, or t
  misc_feature (190)..(190): n is a, c, g, or t
  misc_feature (198)..(198): n is a, c, g, or t
tgtnacctaagttgtaggttacttaagacttagcactttcactaaatggcatacatcgaagggcatcaattcnagagcaaaaatggttganctcaccatacctacctatgtngtcattccagccttngagccgtccaggttnctgagctccctgtnggnnacgncaggnctgtnnnccaaggcgttttgncttttctnctgtgg

SEQ ID NO: 588296 - DNA, 126 bp, Homo sapiens
caaattgtgggaagatttataggtagaggcgacaaccagctatcaccatggctcggtatgtttgtcgcctctagtcctataatcttcccactatttctgctacagtagactgggtgtgctctcttt

SEQ ID NO: 588297 - DNA, 303 bp, Homo sapiens
gttaattgttaaaatttgaagagaggagtgagtactctctctagtatctttactatttaggggggctggtggtgggactgcattgatttaaccattgtgaaatctagtgttccattcttgaaaacagaagagcatatatatgaccttcatgtactcttgcatatacactagtgtacttcgtttggtgcctcagatctttaaggcattaactacggaagaattttctttctagcatagacatctttataaaagtaacgcacattagttcataattcagggcataatattactattatacgtgtg

SEQ ID NO: 588298 - DNA, 628 bp, Homo sapiens
tcggacgacggaggcagggaagtctggctctggtcccgcccagtgttgggatgtggcagtgggcgcgatctcggctcattggaaacctccacctcccggggtccaaggcgattctcctggcctaagcctcccgagtacgctgggaaactacgggcgcgcgcggacagccgggtaaatctaatatttcagtaagagcagcgggtttcccccatgctgggccagggttgggtctggaacccggacctcgtgatcacggccctctttagcttcccaatcctctcttaaaaaggtgatgcgttcagaacacttttggtaaaacgcagggttgaatcacattggggctctgtcaatttcagagcgcaaagaatgtgggctgtaaaatagagtgtagagcttaagcccttcccttttttcccaatttcttatttcctagccttttttataagttccaaaaatgtttaaggagaaaccttttagatgcgatgaagggtgcccaaggggggaattctgacaagggtaaggttgggccaggtaaattgcctacaaggaactgtgctgcgaaaacttcgaaagagtattatcccatgtgttatggaaaatcttcgggaaataggctagtgtattgtga

SEQ ID NO: 588299 - DNA, 1065 bp, Homo sapiens
  misc_feature (114)..(114): n is a, c, g, or t
agcggagatacccaatcagcggccttcaggcgcagatcgtgggcggagcggtagccaggccgcgggccggccaatcagcgggcgagcggctgcctcagcgcgcgcggcgggcgnggcggggcctgtccgcgcctaggagcagtggacgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgacttggcatgcccagaccttacactttcctttcatgaaccctaaggttgttggatgatgtcagcttccatccttgtgtccgtttcaaacgctggggatctgagcgcatcctctccttcatccctccgattgcaaattcgcctgtggttctacacgttatggcgcacacatcagaggcttttagtgagatg

SEQ ID NO: 588300 - DNA, 474 bp, Homo sapiens
ttactaccagatctcttggactgttccagatacatggtggtaacatggtgtgtacggaggaacagatatcactggtcaggtgagatcatacaagtatgaaggtgacacgaggaaaaaaaattgcggaatttggcttgtcaaagcatccaggccactatggtctattgactaacattgaatatacatgaatgccacttcttacagccattttcatatttacaaaatgagcttactactagttgagttattaggtaaggcattcaagttccttagcttaacataaaaaggcaacagacatcttagcacaccacaggacagattttagagggatgatttcagagcactttgagatttaccctcctttagaatcccttacatggtcgatataaaagggaagcaattctgaatcctattactagcctgcactcttttgtagattacttttgggggatatattttgagaatgatgaaacg

SEQ ID NO: 588301 - DNA, 1124 bp, Homo sapiens
  misc_feature (114)..(114): n is a, c, g, or t
agcggagatacccaatcagcggccttcaggcgcagatcgtgggcggagcggtagccaggccgcgggccggccaatcagcgggcgagcggctgcctcagcgcgcgcggcgggcgnggcggggcctgtccgcgcctaggagcagtggacgctgagagcagcaaggccacggagggctatcttcaggctcatgcaggaggggaagattgggcctggtcttgaaagatggagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgacttggcatgcccagaccttacactttcctttcatgaaccctaaggttgttggatgatgtcagcttccatccttgtgtccgtttcaaacgctggggatctgagcgcatcctctccttcatccctccgattgcaaattcgcctgtggttctacacgttatggcgcacacatcagaggcttttagtgagatg

SEQ ID NO: 588302 - DNA, 185 bp, Homo sapiens
ccacttcggactgcggcgcaacgctgccgagaaagcgcgaacgaacggagcgaggtcgtgattgaggatcgcctcggccatttgcgatcggcacgagttaccggtgcagagtaccaaaacccgtttcatgcggtgtatagaaccgctgagctgggtgcccggcgcgattgtattgaagacggtac

SEQ ID NO: 588303 - DNA, 243 bp, Homo sapiens
cggtccacatctgcaagcaacacaacaccttagctgtgtccttgtaagtggcatgttgtcatcctgagttacactcgctcggggttggctggtgagaagtggggtctcaggctcagctgttcagtgatgaggcctggtaatgtgcgctggtgcacagcgcccgtacacagactgcggtaaccgttccttgtttgcctatccttctgagcaacagccctgtggttcagaggagggcctgcaacc

SEQ ID NO: 588304 - DNA, 1123 bp, Homo sapiens
  misc_feature (114)..(114): n is a, c, g, or t
agcggagatacccaatcagcggccttcaggcgcagatcgtgggcggagcggtagccaggccgcgggccggccaatcagcgggcgagcggctgcctcagcgcgcgcggcgggcgnggcggggcctgtccgcgcctaggagcagtggacgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggttcgtgaatgtgggaaagttcatatatgtaaaccgtaaagtgtctttgtagtcctgtttccattgtgtaaagcctccattaagaaacttaaaaaaaaaaatcaaaactctggtattactcacttcctctcccatctgataagattctggtttctatttattgaattggctgcatgcaaaatgacaaatggaatacttttgaacctcttgcgtgggaaagtcatcctatttgcgatgactatattataggcctttctagctctgattctacttgttggtcccaaattagaattccagatcggtttttgcccggtggttcttgaattcctaaaccatgttattctggcattgctttggagttgcctccaaaagtggatggtcttaagtttcgaaaacgcaccagttgcaacaagctaacgatgcttaatctaactctcccaggtcaagggtaagccttgaaccgggatagtctcccgctgacggggcccaaaaggacagaagggggcggatacacgctgcaaagtagatgggacctgaggtccgtagaataaggagccgctgagagagaacagactgtcggagattcaaacacgagcgtcaggcgtcacacg

SEQ ID NO: 588305 - DNA, 1126 bp, Homo sapiens
  misc_feature (114)..(114): n is a, c, g, or t
agcggagatacccaatcagcggccttcaggcgcagatcgtgggcggagcggtagccaggccgcgggccggccaatcagcgggcgagcggctgcctcagcgcgcgcggcgggcgnggcggggcctgtccgcgcctaggagcagtggacgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggactactgttctggaatttcagttctcatgcaacataccggcccctttgcacagtgaaaacgattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgacttggcatgcccagaccttacactttcctttcatgaaccctaaggttgttggatgatgtcagcttccatccttgtgtccgtttcaaacgctggggatctgagcgcatcctctccttcatccctccgattgcaaattcgcctgtggttctacacgttatggcgcacacatcagaggcttttagtgagatg

SEQ ID NO: 588306 - DNA, 916 bp, Homo sapiens
  misc_feature (489)..(489): n is a, c, g, or t
  misc_feature (539)..(539): n is a, c, g, or t
agcggttctacgcgcgtggatttgatggcgtgagtgtctcacatgaaagttctccgctcccagacatgggtcccttcggccttcctgcctcggaagccgcagaagtcaggcatcgtgggaaggttaagagcttccctcatggattcacccgtccaagcctggtccagcctcccgagcacttctcctggagactacatggtctaggcatgattcacatcgtgcgcgcgcaacagtcgagcaggcctgggatccttcggtgaccaacgtaagcgagggtggtggacgctgtgaccattgtcataggaccaccacgccatggttgagtttgatgggcatcgatggttgctacgtggaaagcacccatcgttcatgtcctccgtgcaacttcaagactgatcttttgcatgtgagcgacatcgagatgatggaatgcacagaggtcctttcgtatgacagcaacttgcgcatatagagttctcaagcacacgnaatggtccttttagcgaaggtgactgcaatgaagatgtggctaggtatgnagagcactggctaagaagctgacctggtagtagaggcacttactgacagactatgagataacttactgccaaagtcatccgtgtcattggccagacccagaatgcgcctgctttccctctgcgcctagcaggaaggtcgctctctgagtggtatcatccagcgtgacgcgtgagggccctgatgggcccgagaagcttggacttgtcggcctggcgacgagggcctgtgaagcatgcagtgtaccttgtgaaaccagagtggttcaggggcccggactcagatgatcgaaggtcccctccgggttgaccaagggccgagtgctactacatggtcccccaggtcgtttggactgcaataatcttgccagcgtaaccaa

SEQ ID NO: 588307 - DNA, 374 bp, Homo sapiens
ggtcgccattagacaacggtgacaggttcggctagctgcgcctcttgtcgctggttacgcgctcattcccgtgcagcctcaggggctacctggctattcgtatacgcacggtgtgcctatagaagatgctcatgatggttggtatagatgaatggacaacttagcctcggggcatgcacactgccacccgtgggcaagcttcacactaaggccacctttgactgaccatttggtaagacctactagctagcttgacccacagacctctggaaggagacgtgtattcaccaagtctccatagtcaggaggtcactgaccaatcctagtcaagacgcacacaccagagtctcacaaatttgatctcagctccagct

SEQ ID NO: 588308 - DNA, 1011 bp, Homo sapiens
  misc_feature (114)..(114): n is a, c, g, or t
agcggagatacccaatcagcggccttcaggcgcagatcgtgggcggagcggtagccaggccgcgggccggccaatcagcgggcgagcggctgcctcagcgcgcgcggcgggcgnggcggggcctgtccgcgcctaggagcagtggacgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcaggccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgacttggcatgcccagaccttacactttcctttcatgaaccctaaggttgttggatgatgtcagcttccatccttgtgtccgtttcaaacgctggggatctgagcgcatcctctccttcatccctccgattgcaaattcgcctgtggttctacacgttatggcgcacacatcagaggcttttagtgagatg

SEQ ID NO: 588309 - DNA, 401 bp, Homo sapiens
  misc_feature (358)..(358): n is a, c, g, or t
  misc_feature (392)..(392): n is a, c, g, or t
gacacttaacaggtagatacttggaaggggtagtctttctgttttatgaggggattacatttaaaattaattttaaaatacatgttgtggcattaccaataatgtcacccagtattgatattagaggccaacagacagttaaagtcaacaataaattttccaaagaaatgtgtacaagtttcacagttttttaaagttttacagcagaacttgctccaggttatgcttcaagaaaggatgacaaaaaacagaaaacaaactgaagtagccaaattaggaattgggaatgaaaatgatatatttgtattgtggggaaaaagacaacttttggattaaataggaaggaacattttacatncaggttacctccccagtttttggcttaggacttnggatttagg

SEQ ID NO: 588310 - DNA, 1084 bp, Homo sapiens
gcatcggccgctgtcatgtcctccggggctagcagcgaccgccctggagcgcgttggcagagcacgctcaagttggagcgctggccgtggagacggatccatggtctctcacggcagactagaaaagcgtatcagacagtacctgtatgcagaatgcctgcgaaggatgccctgactggctgagtgtccagcgtggcacaggtaaccccttccgggagacctagatcctgtgctttactctgaagactctaggagagaatgttggctgaggaatgcctttcaagcacacaagtctgcttgacatgacttggctgcaagtctcaagaaaaacaacttttccctacgctttcagagaatatttccagccctttcctggtgagcctggatcctatagccaaaattcacagatacttcctggacgtacctaccttgaggtgagcaagacactgggcgtcaacggactaggaattgtcaaactaggtaaataactgggcattgatcaaacatactggtgcaagatactctcaactaccattaatgatacaacaaaaaacctttaccacacacaacatacccacaatatgcccacttccttttcaatacacgctgagtttcacctaacgaaattaccgtaagtaccccttgaggaagttaataccaatggttatatgttcaccatatttaacactgcgcaatggttatacccattcgatacgggcgaaccgcgacaaaacaaggttacagggacgacactatgacaacacgcagcgttgaaatagactttagttaacctggataggcacaccttgggaaagatacaatatcatttgcgccagttaaaaaacagacattgtcgggtaccttgtactggtgacgatttggaaacttcagtaatcaattatcgcctttacagagttcgaagggaccaaagcaagaagtaccccaacacattgagcattgagccaagtgcgacaacgacaataagcggcttacagccattacaatccaaggatcaatcgccactagacagctctaacaaaacattggggaaaggattgtgacgtgtcatattcctaaacgcacg

SEQ ID NO: 588311 - DNA, 225 bp, Homo sapiens
ggcccccgttatagaatgtcaattggtcatgagcctgtcaggtctatgatataggcattcaaaaagagcaacgaatagatacatcttcctgtccttgatataggtaataaggagcattattatgttcctagtgtacgggagagaatgtcagaaaatcaatatgaataaattcaagtacacagaggattcacacctatttgaaaatgtaatgcgtggccagaagga

SEQ ID NO: 588312 - DNA, 385 bp, Homo sapiens
  misc_feature (20)..(20): n is a, c, g, or t
  misc_feature (206)..(209): n is a, c, g, or t
  misc_feature (211)..(212): n is a, c, g, or t
  misc_feature (218)..(218): n is a, c, g, or t
  misc_feature (223)..(223): n is a, c, g, or t
  misc_feature (228)..(228): n is a, c, g, or t
  misc_feature (233)..(233): n is a, c, g, or t
  misc_feature (235)..(235): n is a, c, g, or t
  misc_feature (249)..(249): n is a, c, g, or t
  misc_feature (254)..(254): n is a, c, g, or t
  misc_feature (258)..(258): n is a, c, g, or t
  misc_feature (269)..(269): n is a, c, g, or t
  misc_feature (271)..(271): n is a, c, g, or t
  misc_feature (284)..(284): n is a, c, g, or t
  misc_feature (288)..(288): n is a, c, g, or t
  misc_feature (290)..(290): n is a, c, g, or t
  misc_feature (295)..(296): n is a, c, g, or t
  misc_feature (302)..(302): n is a, c, g, or t
  misc_feature (310)..(310): n is a, c, g, or t
  misc_feature (314)..(314): n is a, c, g, or t
  misc_feature (323)..(323): n is a, c, g, or t
  misc_feature (327)..(327): n is a, c, g, or t
  misc_feature (336)..(336): n is a, c, g, or t
  misc_feature (351)..(351): n is a, c, g, or t
  misc_feature (366)..(366): n is a, c, g, or t
  misc_feature (368)..(368): n is a, c, g, or t
ccaaattaaaaaagaagcanaatttttcaaaaaagacaatgatttgctttcttatagtggtataaaagatttagacctagatgatttaacttgggatgaagacgaagaggaataattttgaaaatttacaaaagaagatgtatcatcgctagagaacaatttccagttaatgaattaattcgttttgtaatgactcaaaacaaggnnnncnnaatagnttttntaaanactanancaaagatacctggncgagnagcntatgtagaaancnaagaagaaaaaantcgncnagttnnagaaanaaaacttntaancagagcttntaanactaatatnaataaagaagtttancaaaaactaagtgcncnaatggagttagaatggc

SEQ ID NO: 588313 - DNA, 109 bp, Homo sapiens
gtacccgccagcgctgcaagcgcctggcaagctgggcgcgcgagggcaagaccctgctgctgcgcgtcgccgtcgatggcgggggctgctccggcttccagtatcggtt

SEQ ID NO: 588314 - DNA, 813 bp, Homo sapiens
agcgggggggcggcggcggctggagagggtcctcggcagcctctgaggagcgcggggcgcggccatgagcgagtccagcggcagtgcgctccagcccggcaggcccagccggcagcaggcggtccatccagagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagttggaagcggtatagcagcaagtcttggaagaggttcctagagaaggctcgagagatgacgacccacctggagctgtggcgggaggaccatccgcagcatagaagggaaatttggcactgggattcagtcctatttctccttcttgagattcctggtgttgctgaatttggtgatattctgatcatctttatgctggttttcctcccagtcttactcacgaaatacaagatcaccaacagcagcttcgtgctcattcctttccaaagacatggattaaccaatgtccagtctatccagtaagcaagttctggactcattacttttaccgtatatcatagacttgcttctggcactggttcctgggggaactagccctttacggactttcacg

SEQ ID NO: 588315 - DNA, 564 bp, Homo sapiens
agcgggggggcggcggcggctggagagggtcctcggcagcctctgaggagcgcggggcgcggccatgagcgagtccagcggcagtgcgctccagcccggcaggcccagccggcagcaggcggtccatccagagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaaggtttgttcactagccacctggaacctgcattgtgtatgttatggcccagaggtatgttttgtgcgtgaaatgcatttcctgaagagctcatataattaaaattttattccttagggtaagctaagcctctttgacaaacatacctgaattttcttctccactcctactgcttcacttgactagccttaa

SEQ ID NO: 588316 - DNA, 647 bp, Homo sapiens
cagacattcagaggaagacgctgtggcactcagtactactgactccaaggctgggtagcgagtgtgtcgctggccttagccagactctacatgccaccctggctgctattggatccgaggactcacgctgaggccagatgctaccactcgacaagatcggcgcctctcctgcactcacgtgctgctctgacagtggtgactaacggatgaaccctttggacaagagtgacataaatgtgacactgctcactgtacgtaaacaatgtaatgcatgtacaggctatgaccatctgccttcttaagtggctgcatgcataaaagtagacgttgtaagtgaccttaattctttaaaggagctagataaacgcatagaacagatgacagtaaatgagatgcagttagaagaacaggtacttacagtgtcatcagactgttctaaaagaattcccactgccttagaatatgcataatacctcatgcaatcacttaatcagcttctggagcaagacactcatctattgaccgccattatcagccatatgctgactgctcaccttggatggactatcgtggaaccatgattgccagaatgatgacatcgaacgtcatcatgccgaccttggatttcactgtgactgctgtttttt

SEQ ID NO: 588317 - DNA, 396 bp, Homo sapiens
ggggatgagtgtgtgtgtgtgtgtgtgtgtgtgtgtgtgtgtgtgtggagctttttctgggacaaactagaaaccttagaaaatgaaaactcctaggaatttatgcaggtgaccctagataagactcctagcaatgttggatatgaagcctaaagtggctatctcctgaaatcaggcaatacttccaataaagggatttgcaaaacaacccactcataaaatcttagacctacaatttgtcttccttatcagatgtgcatgtgtaaaaaatggatttgatgaaagggccaactgatgactggcccattgtgagacccatgcaatgaaagggagcccacaattgataaatgatactctgctatatttgctgtcgacgcggccgcgaatttagtagta

SEQ ID NO: 588318 - DNA, 235 bp, Homo sapiens
ggtgacatcgtagtgctgttccatacaaacttgaacacgtagatttcctctacttgtgcaagatgttatttataaagtcggaaacttgatttttaaagctttagctttgaccgctgcttttccatttttacatttgctattttaatcacaaattttgcccctgtttgatttggctgtctacttttggctgccattgttttaaaaccccatcttgttccttttctatatctaattt

SEQ ID NO: 588319 - DNA, 325 bp, Homo sapiens
caaggattttgggttttgttttgttttcatttttccaaaaaaaaaagaaaaaaaaatagaaaaaaaaggggtaaaaggggcgggtttgttttttgaaaaactgtcttggaaaccaatttaaaggggggttctgttttgtttttaaacgatttttaaaaaaggtttgggcctccccgggttaaggggggaacctccaggcaggaaccggcttgcccccctttgcccggtaaggggtgcccaaaaaagcattacccgccctcggggggtcgggctgtgggggtcccggcccctggggtgagtttcatgtatgaaaacataaaattga

SEQ ID NO: 588320 - DNA, 116 bp, Homo sapiens
gcacagccacagaactaatcatattttatatcttcttcgaaaccacacttatcccaaaaaaaaaaaaaaaaaaaaaaaaaaaaaaaaaaaaaaaaaaaaaaaaaaaaaaaaaaaga

SEQ ID NO: 588321 - DNA, 151 bp, Homo sapiens
tggaaaatataaataattactattttgaactggggggaacctctggtctttggttccactcacctgccttgtctctggggtcggagccccttgcttaagggatttggaagccctagttttcagcttggaagactcaagtctttagggctaa

SEQ ID NO: 588322 - DNA, 1424 bp, Homo sapiens
  misc_feature (340)..(340): n is a, c, g, or t
  misc_feature (1324)..(1324): n is a, c, g, or t
gctctgttccattgtcctatcgccgaccttggctcggtggtccctggaaggatctgaatgcgtgggttgagcacggcgtccaaaggcattggactgctgggatgaattgtacccgcgatgtggtccttgcttccttcgatctcatgactacacggctacctcgcacgaatgtttgaggtggagatggttgtctcgctcgcacatgcgattcgatgtctctcctgggagtgcatacaggaactgtacatgctcaatggtcctccttggattcaaggcatggatggtatatggtgagacatcaaggatccttgacatcgtcgtgctggatttccattaaaanattcggagtagggcgaatgagtcccggagctgcatcatgagacgcttatccccatggctggtgcatgtgcttggggatgtcgaatcaatggcagtgtggcatcaagggtagcaggggcaagcacgaaaaatttttggtcggtcatcgaatacttcattggtagcgaagcgcgaaaaggggattcacggcctttgtggtctcgttagcgagtactggaataagttataatccattccgctggtaggaggaaggggcgccacattgattagcaaaattgttgtcgtttggtccgacacccttgggcgatgggagataagcactcgtgtaaggtttgcgtggcagccgaagagagggtaaattccgcattccattgctcgagtcgtagcgtccatgggaatggccccccgacatccaactgccctggttgaggccccccgaattgcgcacccctgcaattcaaggagctggcatatgggagttaccccactttcgaataatttgactgtttcagacggagcctgaggcacacacgtaatttacggggaatgttacacttgctaaaggttgcagcatcgacttcggggtgaccaacacgttgttggtgattgtgtggacctgggttcgggtagccctcaaccggttaagggaaaggatgattgccggttgagtgatgtcaccccaagctagtgagtagtgaggggccaacacctggtgcattgcttctctcggaaacgctgcggttttctcccggtgaacatacgtattgcgaagatgggcaaatctggtcttatgggcatagttcgggacatattcccgagacgaatcattgtggtcaatccggcaatcaggtcaatggaaacgccatggagcttttctccttacgcacgactggaaaatggtgtatacacggcgcattcagcaccagtctgccctgagatagagtgagagagaagaccgcgaaacactctgagtggatcaccaacngacaaattcagcgtcgctggtgtaacaatagagggtcccacagcgggggacatttgtcagatctccttggtgtcacgtatacacaaccaactatgggttg

SEQ ID NO: 588323 - DNA, 1587 bp, Homo sapiens
gcactgaggctgtggcggcactgcgcccggcgctcgcgctcgtccgatccgtgccgcccgctccagccatgactgcgccgggtccccgtcgccgcggatcctgttgccgttgctgttgctgctgctgctaatcgtccgcctccgggtgcacgttggtgacggttgtgtatggcgttccgcggtggcactcacgcgctctttcacaccagaggtccgtgtccaggattctactgactgttgggtaccgtgtgagtgaccacatacgtgctgcgtctgacgatgactgtacagaaactttgtgctggagcgcaggaaacggtgtgcatcgctgccctatcgagagcccacaacgatgcccctagccaagcgtcgctccactacgcccacgcataggaggcacagactcgcgagcatcgccgccgcatgacaacgctctcacagcaacagatgagccgtaccaacacggacaccccccactcaggtgaccaagagggctacctagagaagccacgacacactatagaagaccacaggtacatagagcaccctaggatcctccacttacctacttaacgctccgcctcacgactccttccgatcccaggtgcacaccactcacaatacaactaccactaccatagagccactctgcaacaccatgaagacctcacccattcgccatatggcacttcgcccccatactatcaacccaaaacacgcagacccagactaagacccatagcacgacaggaaccaacgaacacatgttaccacacggcggactcatccgctccctacccctacacgccaaacccacatcacacctttcacataccaccagaccatcagcgtagccgcctagccaacttaggcccaccaccctatataaggtcaccccattacaaacgcgacccaccatcctccaaaaaaagatcggattgggccccgaccacccacaacgaccgttacaccaccccgtagcgggaaaacagccaaccaccggacacataaaccctccaacacggggacccttcaaccaccaacccagacaaccaaacgtgcacccaccataggaacatacacaagcgaccccgaactacggggccaacttcgcccaccaaccgcccaaaacgaccaacacccagccattaaaacacaaccatcaaaacattaacgcaaacagggtctaccacacccataagctaagccactgtgtttaaagccctccaaatgagacgccatacaaggaaccaccaactttggacaaagaccacacccaacaacacacgacggaaacaccaataaaacagccaaagccgccaaatgaaaagcaccaccaagtacgagcacaccagagcgaacagcggcaaacagcccatagcgaagccggatccagcacgcacaccacatataacacacaccacagaaaaccaaaagggaagcgaaaacgaacaccatataccccagctattacaccaaacaagaacacccgaggagaacgcatataacacacaatgcgcgagcagcagtaacaacactccgaaaaaaaaacggaaacagaacaaacaacaaccacagcacaagatg

SEQ ID NO: 588324 - DNA, 415 bp, Homo sapiens
gtggcggcacatgcctgcactcccagccactcaggaggctgaggcaagagaatcacctgaacccagaaggtatagatcacaccactgcactccagcctggatggcagagcaagactctgtcaaaaaaaaaaaatgtattgatatggaaagatgataaccataataaaaactttgaaaaaagactataaataaatatatacactattatcccgcttaaatacgtaaacatatgtcatatttatagcatagataaaagtctagattggaatagggtgtatgctagcagtggttatctctgggtgataaagttatttctgttgttggttttttctttgtgcttttatttgttaacttagtcttttgcattaagtatccacttttgttgttgtttttgagacagagtcttgcttctgtt

SEQ ID NO: 588325 - DNA, 184 bp, Homo sapiens
agttactcaggctagaaacttcatcagccatgaaacaggttcaagacagagagtactacaattagacttatgctttagaaaagtcagtcttttacctgagcagtattatcatagtacaatgcttgttatgaaaaaaaaaaaagggcccattgaattaaattagtttggccaggcaaaaccaaac

SEQ ID NO: 588326 - DNA, 469 bp, Homo sapiens
ctttcaagccttccccttgctcctgcttcagtccaaatatcacaaccttctgtaccatccccttccattcataatatcctcgtgcatcccttgtatgcctattacaacacttaccatatatgtgatagttatttgtataaatatggatctgcctggccaggcgaggtggctcatgcctgtaatcccagcactttgggaggccaaggtgggcagatcacgaggtcaggagatcaagaccatcctggctaacaaggtaaaaccccgtctctactaaaaactaatatatatatatatatatatctgccctaacagattgcatctcaaagtacaggttcattctatttccccacttgcagtggaaaagaacattccctccagttccagggtgcccaggatgaaaagcatagaaccacctattctgggcatactgcctatgggattgccctgctccacaagcagcagtaaaaaa

SEQ ID NO: 588327 - DNA, 670 bp, Homo sapiens
aatgtgctcctccgtgccacgccaaccccagtcctggcggcggccccagcctcagttccatgctgccaacgccagcacctggctgctgtgctcctgtgttccctgctgcgtgctccagcctcatcctcagaccctgctgtgcagcagctgtgctgcaactgctggctcctggccatgacccctgtgccttcatgctgcaatgctccatgctgcagaccccatgctgccctgctctgcctggtcctgctcttccatgtggcccttcccctggctggcctgctgtggtcatgtgcttgcacccatgtcattttgtgcctccattgttggacagctactgagatgacgcaactgaggtgtgcttgccctgatgttatctgggaccctgattggtgaacttgtctgacacaacactcatgtggagtgtcaccaatatgcttttcatgtgcctgcacaattgagtcagaacgatgaagtggcttgttgacattggaatttgctaagaactatgtattgaacttgcataagaaaagtttctccaaattgatgctcatcctggtgctggtactctactgtccatgacatcacagagcactctgtgcttgatccatgagtactacagcctagatgcccccaaaccccattcacctcactgtggacacaatctccagaa

SEQ ID NO: 588328 - DNA, 309 bp, Homo sapiens
agaaggagcctggggggaaggcaccccagtgacaaccgcagagggagggcaccaacccccaacacaaactcagggccaccaactctgggccacctccgtgtgaggaaggcaaagaaggcagtctgcccggtcactgaggctgaaacctcagagctgagctgtggcctccactcacccaccactggcccatcctccctccacggcaggggcgcctttcccagaaggctctggcgttgcttagaccacagcggaggccggtgctcaacttttagaattgctgttggaaataaataattcatatacgtaaaa

SEQ ID NO: 588329 - DNA, 222 bp, Homo sapiens
tacagccaaatgcatagtaaccagaatgagtaatttatacaagtcaatactgtgtaggacagtatgaatgaacgaattgccacatgtaatcaagtacagattagttgtatagacatactgttgagtcacagaagcctgacaccagagtgcatattatttcatttatttgaagttgaaaaacaggcaaaataaatctatgctattgaagcgtctaaaactagg

SEQ ID NO: 588330 - DNA, 173 bp, Homo sapiens
ggtcgacagaatatctcagggtgggagtcaggcagtagtcgttttggttttgttttttcttttaaagaacccaggtgatgtaatcccagcactttgggaggctgaggcaggcggatcacaaggtcagcagttcgagaccagcctggccaatatggcgaaaccccgtctctact

SEQ ID NO: 588331 - DNA, 159 bp, Homo sapiens
aagtgctctttccagatgaaaactactcttttggtttcgtttgaaagtcacacaggcaggggaaacttcgctctttcaatcattatgttcagcctatgatgaattatttgatcataagacagcaatgtcactaataagtatcacgtcgtccggggttgt

SEQ ID NO: 588332 - DNA, 714 bp, Homo sapiens
ccgagcacaccacttgggtgtattggctcacgagacgctcacactattaggcgtgcctcacatctctggggggaagcactggtagttgtataataaagtcccactacaggagcggggggagccccccccccgcatcaggattgtatacagatgcggccggcgagttgccataagttgccctcacatgatcacccacgcggctatatcatcgcgccctctaatcgttgacgtatcatcttggactaaacttcgtcgtttgccaatatacagcggttgtctttttgtccctggtagtcccatacagaaccaacgtcattctcaacctttctgcgtctcttctccaccgcatctctgttcacagcagcagaggacacatatgatgggcaggaccactccctgtatttaacgactactccgcccgcaatacacagagagagcgtgagcgagatgacacacacagctgtgatcgaccacacatagcccactcagtatatatctcacatagatgttgtctgtagacatatcacccgcggtctcccactaacttatctcagccgatactattctccactataaccgatgttccactctatcttccccttttaccgctcctttgagaccaacaaagagggcttgccccaccaccacccccgtcatcaccgccggtctccctcgttcaaaccccccttattctccccaacaatatcaaacaaa

SEQ ID NO: 588333 - DNA, 121 bp, Homo sapiens
gtaaaaaatcccaaacatataactgaactcctcacacccaatttgggccaatctttcaccctcataggagggcctaatgttaggataaggcaccatggaaaccatttttcctccccataag

SEQ ID NO: 588334 - DNA, 246 bp, Homo sapiens
cggccggagggggattctggactttggagggacactgtgggggacccaggcttttgcagattttggtttcggagggcgctcctggaaccaagcttccacggatactgaggggtgacatttcatgaagtgtggatcattgtattcagaggttgtaattgaaaaaaatatagaaactatttggtcttggtagattttttttctgacaatgtggcccgactgaatttcctcctaaagaaaaaatggcga

SEQ ID NO: 588335 - DNA, 785 bp, Homo sapiens
aagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaacatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataaagaatgcttttacactgttggtgggagtgtaaaatttagttccaacattgtagaagacagtctggtcattcctcaagggatctacaaccagaaatacatttgaccaaacaatccattatgggatgttatacccaaacaattttaaatctttccacttttaaggacacatgcgcccccttgttttttgtgggcctgttcaccataggccagaattgggcccacccaaatggcctcatgggtggccgggttaggaaaaggggctttg

SEQ ID NO: 588336 - DNA, 234 bp, Homo sapiens
gccaaacccacttccaccttactaccagacaacccttagccaaccattaccgaataaagtataggcggatagaaattgaaaccccggcgccaatagatatatgtaccccaagggaaagatgagaaaattatatacccagcatatatatatgcaagggctaacccctatatcttctgcataaatgagattaactagagatatctctgcacaggagagccacaagctatgagcccc

SEQ ID NO: 588337 - DNA, 298 bp, Homo sapiens
cgaagggtgtggtccttaatctgtcacgaacgcctatcgtattgctagagtgggtccgatgaagcacaggaggagtatgaccggcaagtgagggctggtggggacggggcacctggagcgcccatggcacgacagcgagatgcgcgccgggcttacgctcgcccctggcacgtgcaaggaatgggcgagcggagcgagacgggtcggtggcagctgggttgcctggtacatggtggatgatgtcctagaaaactgaagtaatacagggtggccgtgtataggtagagccatgaggatg

SEQ ID NO: 588338 - DNA, 445 bp, Homo sapiens
ttctcgaatcgacggttctccccatgtgatagtctgaaatatggcctcttgggaagggaaagacctgaccgtcccccagcccgacacctgtaaagggtctgtgctgaggaggattagtataagaggaaggcatgcctcttgcagttgagacaagagcaaggcaactgtctcctgtccgtccctgggcaatggaatgtctcggtataaaacccgattgtacgttccatctactgagatggggaaaaaccgcctatctcacctatcaccgcctatcaccactccccaatctcaagtacccagggacacaaacgctgcggaaggccgcagggtcctctgcctaggaaaaccagagacctttgttcacttgtttatctgctgaccttccctccactattgtcctatgaccctgccaaatccccctctgtgagaaaccgtcgaatccgag

SEQ ID NO: 588339 - DNA, 160 bp, Homo sapiens
tttgttctttcttcccttgctttttgtctacactccttaaggcaaactacttgggaggctgaggcaggagaatcacttaaacccgggaggcggaggttgcagtgagctgagatcgcgccactgcactccagcctgggcgacagagcaagaatccatctca

SEQ ID NO: 588340 - DNA, 219 bp, Homo sapiens
gagaccagcagccaatcagcagtgcgccctgagccagaggcagcccagacactattggccctatggggagcatagggctaggggagaaataggcaagcgctgattttgtgaggaaagacccattggggttgaagtttgttccccgagcacagtttccctttgcagaatgcagctcctagaagcgagatttctgccatttcggagataggacctcggagg

SEQ ID NO: 588341 - DNA, 322 bp, Homo sapiens
ccggagcataacaagagtgtctaactcatccctgatggtctgtgagaggtagactatacacaagattcaagtatactcgtaagcaacttttagatagagtaggtcctgtaaggaggagactcttgatgtcaccttcagtatcttgaaagcgggtcccctccccgcaggctcttaattctttgcaaaacttgatgctgtttcagcgtgaaacacattcagcaagactgttaaaaacaaaacgttgaggggagctgtataagaaactcgcacagtacatggccaactacattggataattgtgacttacagtggtggtcctgta

SEQ ID NO: 588342 - DNA, 559 bp, Homo sapiens
  misc_feature (216)..(216): n is a, c, g, or t
  misc_feature (264)..(264): n is a, c, g, or t
  misc_feature (315)..(315): n is a, c, g, or t
  misc_feature (329)..(329): n is a, c, g, or t
  misc_feature (377)..(377): n is a, c, g, or t
  misc_feature (476)..(476): n is a, c, g, or t
tattatactagcatttaccatctcacttctaggaatactagtagtatcgctcacacctcagtatcctccctactagtggccgtagaagggaagtgaagtactatcgcgtgtttcattataggctactctcagtaaccctcaacacccactcccgtcgttagccaaatattggtgcctattgccatactagtctttgccgcctgccgaagcagcggntgggcctagacccttactagtgctcaatcgtccgaagcgacatatggncctagagcgtacgttacataaccgtagaagccttagctccagagtggctanagaacttagagtcngtccgcaaccaagttatagttagcttaacccagcttggaacaagtganctttttcccagagaaaaagatcgagcaagtaaagtttttgaaaatcgaagcgagcgaagccaacgcgcgacgaggcccctagagtttaattaagcccantcattccgctcgtaactatttttttgtaacccaaaatcgaagcaaactaaacccttaatttttagggcttggttttcgcccta

SEQ ID NO: 588343 - DNA, 329 bp, Homo sapiens
cattattttttggattgacttttataaaaattttcaaacattcaaaagtagagtgaaaagtataacacaccatcctatacccagtttataattgtttagtttcttccttataattcagcgtattacttctagtactggaaattgagttcctcagttaggttttgcgattttagtgacgttatctcgttcatttgaatacctctatgataagtactagacaagttctagtttttttgtaattgcaaaaaagactgagaaaatctcctaacaattacatggaaatactttgtatacaagtgtttggtttagttagttatttgtagatgacc

SEQ ID NO: 588344 - DNA, 394 bp, Homo sapiens
  misc_feature (5)..(5): n is a, c, g, or t
  misc_feature (89)..(89): n is a, c, g, or t
  misc_feature (290)..(290): n is a, c, g, or t
tgaanaaaatacggtgaaattagacaatatttcaaacatgtacaaacacaatattttattgtatttttgagacagggtctcactctgtnaccccaggcttggaggcagtggcacaatcacagtcaccgcaacctcggctgcctgagctcaagtgattctcccacctcagcctcccaagtagctgggaccaacagatgcgcctccacatccagctaattttttttagctattatttgtagagacagggttttgccatgttgctcaggctggtctggaactcctgggctcanaggaatgccctgcctgggcctcccaaagtgctgagattacaagtgtgagcactgcacctggccccaatattttattatagctatagacctttctagttattgct

SEQ ID NO: 588345 - DNA, 144 bp, Homo sapiens
  misc_feature (38)..(38): n is a, c, g, or t
  misc_feature (56)..(56): n is a, c, g, or t
  misc_feature (65)..(65): n is a, c, g, or t
attcgaacagcaatacccccattccgctacgacccaantcatcacctcctataaanaacctttcncccactcaccctagcattacttatatgatatgtctccatacccattacaatctccagcattccccctcaaacctaaaaa

SEQ ID NO: 588346 - DNA, 215 bp, Homo sapiens
ccagcccaatgacattgcttcacgccactgctttggctgcagtctcgaccaatggcgctctctgattggagctactggttaataatggggctgacgtcaactaccagagcaaagaagggaaaagtcctctgcacattgctgcaatccatggccgtattcgacacgctcccagatcctacatccagaactggcagcgagacttgattgtgccgaca

SEQ ID NO: 588347 - DNA, 380 bp, Homo sapiens
gggttcaatccttggattcagcctctcaagtagcttggactaacaggcatatacgcactacacattggctaaatattttgtgtatttttgttgaagatggggtttcaccatgttggtccaggctggtcttaaaattcctgggctcaagcgatatgcctgcctctgcctcccaaaagtgctgggattacaggcgtgagccattgcacccagcctaatgtcttcttttggttataagatccaacagaagattccacatctgaagatctttgggttttttaaaatctgtcaccaacatattacccaccctttaaaaattttgccaaaggtataaatttgaaaaatatatccacatcgatctcattcaagtcattgatacaact

SEQ ID NO: 588348 - DNA, 115 bp, Homo sapiens
ccctgggggcttattgctggtttttaaaggggtttttaacttacatgtaacatgtttaggacatgttttttttttttaatttgggggtctttcccactgattaaccagtagttta

SEQ ID NO: 588349 - DNA, 1024 bp, Homo sapiens
cggcttagcttccagagcaaggccttccgtcgagttggttgttgggttgtttgatcgctggtggccggcgcggtctgcggtgcgggctgagtacacgcggcagcaatggcgagctttgtgagcgagctgcggtagtgcggctcgagaggacagaactttaggcgaggcccgtgggcggacaacgtgagacaatactgggctaaccgtaaacgctgtggttcacgcacgaagatcagcaaagaggagtttgaccttgtaagctcatagacttcgtcacacaggataatgtccattctcacaatgatttcctcctggccagttctcacgcgttgtcaggattgttggtttcgtacaccaggatggtgctggactctttgccttggccagggggttccgcagcaaaagctggaaaacccaatgggaaatgaaaaacgctttcttcgtggttcgtcagaagatttgatcatagattccagcctcatagaatcctctctcaggagcccagcaattctgtggcaataggatccccaagatgatgacgagttgaaacttagttcccacacaatgatgccttcccactcgaggccagcttgaagggagaatgatagtgactgcttatgagcatgggctggacaatgtcaccgaggaggcctgttccagcgtgtcgtctagtgctgtggagaaatcaccttaaagatataacctgacgtcagtgtgtcacgaaggaaagcttatcgggcacgagatggccattttaaagtatgccttggcaggtaacgtgacccgcagcatacctgaggaatagcgtagggagcttagaacaaactttacttgaagaggcttccaggttttaactaggtccctgttggctgggcagaatccaggttttaaccaccacgtggatgattgctgaagcaggcaaggtgcactcctgctgggttgtccggagaacccttacctgagtctttggcgccggtgacaatgtgcatactgagaaggcttgcggtgccagggattaggcttg

SEQ ID NO: 588350 - DNA, 297 bp, Homo sapiens
ccagagccgataggtgtgcagcaggtgccccactatgtggtgcctatggccacagcagatcttcccctgaaggtgccatcagacatgggcagctctgtaccctccgtgctctccatcttatatgtatactaatctcaggaaaaatgtgatagcatatggttagcctaggcagtgagtaaatacctcagatgtcctcctgcagcatgtgtctatattttgtggttattttctatcttcaccatgttctcgaatgtttatatctcaataaacctcttagctcttcaccggccatggtac

SEQ ID NO: 588351 - DNA, 926 bp, Homo sapiens
ggttgtctcctggctggtcctggctgagtggtgctcactcggatgcggggtcccagtgcacggacagcacacagacctgcccccgcctcttgagctggacagtgccggcatcggggactcccggccccctccttccacccggaatgtggccagcagcctgtgactgggatggacaactgagacatgggcactggagtccatggtcagtcacctggctgggagcgtgccctgacgcctggaacctgctgaaggagtgcctgccctggaccaatgggcacccaaggggagacccgacgggcgggatgtggggcttgcccccagacagctggcgtcaccggcgcctcagcagctgatgcttgagtccagcagctttgtggactcggacgaggatggcagcacgagcaggctcagacagctccacggagcagagcacctcatccagactcatccggaagcacaaactgccggggaggaagcagcgccttcggcaggctggaccgggcctcctccttcagcagcaataaccgatccagcatgtccctcaacatcagtcactgtcacgctcaacatggaaagacaatcactttctggccatcagcatcgtggggcagagccaacgaccgtggacgatggcgggcatctacagtaggggctcccatcaatgaaggggcggggggctgtggcgctgcgtgacaggcagcattcaagcccgggtcgacatggttgctgcaggtgacatgacgtgaacttttgagaacattaagcgatggaagatgccgtgcgggtgcttgcaggagatcgatccacgacggcgcatcacatcatgttgcacgtgctgggacaaaggcccgagatctcacactgccactggtgaccggtgcggcataccgcgctgttttcaccgcgctgaaggcctccgaagacga

SEQ ID NO: 588352 - DNA, 228 bp, Homo sapiens
  misc_feature (40)..(40): n is a, c, g, or t
aggatcatcacggcaccctgctgatcctatctaaagcagnattttctcagttgctccagagtggtttttttttccctcccagtccttggttgtcttgctgcagggtactctgacacttttcctcaactgtggcaataagtgaaaggagagagaacaaaagcatctgaatcacaatttaggcaaaaagctgacagccacacaggctgttaatgtagggactctcttctg

SEQ ID NO: 588353 - DNA, 372 bp, Homo sapiens
ctgtattctctaatccacattctaatcccagatccactgaagcatatatactccacacctcagtgtcaacctgtcaacattctcccccagactgtcagtccttttttttcttttatgagactgagtctgactctgtggcccaggctggagtgcagtggcgtgatctcggctcactgtaacctctgcctagggggtacacgcgattagcctgctcagcctcctgagtagctgggattacaggcatgggccacctatttcagctatattaatatttctttggtactattcagaaaacccgggttttggccatgtggcccaagagaggactcaaacacggggcctcaagcgcacggggctaaggggtacccgcac

SEQ ID NO: 588354 - DNA, 823 bp, Homo sapiens
taggcccattggagtatttggtttcaattagggaaatagtgggtataaggattaggatggtggtgaagtttagtacggatgcaatggtccaatgatggtaaaagggtagcttagggttgtcctccgattcaggttaaaatgaggaggtctggggctaggagtcaataaagtgatgggcttagtgggcgaaatattatgcttggtggttgggatatatggaggagtggggataatggcgtaggatgaggatggatagtaaatagggcaaggaggcctcctaattgtagggacggactcggagaattgtgtagcgaataggaaatatcatcggctagaaatgctgggagaagggggtgtcccacaggcggctggggaccagggcgctaatcagtggcccggggaatccgccaacagggaggttcgggccgcacaacaatcggggctaaacggggtcctcaacagaacaccatgttgacacaaagaactatccccccaaagggccgccacatagaatgagaacaaaacgagcttgcacaagggtaacctcccaccgccaaagtcgagcgcgatatccacaacagtccgatacggttcccccaatctgaggtacaaaatcagaaagagaaaagacagataacggggagcgaacatatcgaccggacaacacaaaatagaaaggaacgaaagaggcgaggagtgaaacaaaacaacgcaagccacacacagaaacgaaaaaagtgagcgaaccaacaaccagtcgaaacacacccgaccattgggcccctagagcacacacacaggcacaaaacctaacgacgttagc

SEQ ID NO: 588355 - DNA, 101 bp, Homo sapiens
tggggcccccctcccccccctttttttttaggggcccgggggggggggggtaaaattttttcccccgtccctttaaaaaaggtcctttggtccccctttga

SEQ ID NO: 588356 - DNA, 608 bp, Homo sapiens
  misc_feature (9)..(9): n is a, c, g, or t
  misc_feature (21)..(21): n is a, c, g, or t
  misc_feature (368)..(368): n is a, c, g, or t
  misc_feature (405)..(405): n is a, c, g, or t
  misc_feature (490)..(490): n is a, c, g, or t
  misc_feature (505)..(505): n is a, c, g, or t
  misc_feature (535)..(535): n is a, c, g, or t
  misc_feature (552)..(552): n is a, c, g, or t
  misc_feature (564)..(564): n is a, c, g, or t
  misc_feature (601)..(601): n is a, c, g, or t
ctaacgccngtaagttattgnacatcacacagattaagcaggcttcaggctggaaagcagtttgctctgctgggaacttcctcgggatgtctgggtctccttctgtggtgtctctcccctgggactgccgccagcccgcagcctctcgacgaccccaggtatcaaagctcagccatttgttctccccaggggctgagggctcgggctttggtgaagcagagggtccccgtgttgatgccaacggaccccaccccctccaaagtgaagttggaagcaggtgaagctcatggaaggctgaaggcaggcgggctggagtgaaggggggtgaccacccccacgtgtgggacaacagggggcagtcaagatgncgcaccaccacccctcccttccaagctccaggcatgnttccttctccatcaaccttgggacctctctgagtgggctctcaagggaaaatttattttctcttgttgaaactaccagatctganatccacccccccagnaccatggccaaggggggctggggaagccangggggtccaggacaagnaagaagaaaccncttggaaaatggtaagttctccagatggccaatcttngttttcc

SEQ ID NO: 588357 - DNA, 441 bp, Homo sapiens
cacaagaaatggtgtgttgtcgcgtagaggaagagcagacgacacttcaacatgattttttacaatatttctatgctcagcttgatgtgggacccgcttaacttcccaagtctgcttcaaatgccaaatgatcatagaatggtccacattgagttttccagcaacttctttatatggttgtaagaggatcagcttctgtgattgatctcccaactggtcgttgtcaacttctgatggccggtcatagcactcctcatcttcaaggctctcgtctcctttgtaaaacttctatgaaccaccactgcactgtacgtttcattagcagctccttggccaaatgcgttgttgatgttgcgagttgtctccagtgctttacaatccattttgaccttgaataagaaaattgctcgaatatgctttttgtctaacatcattttcact

SEQ ID NO: 588358 - DNA, 1598 bp, Homo sapiens
  misc_feature (88)..(88): n is a, c, g, or t
  misc_feature (140)..(140): n is a, c, g, or t
gagcatgtgcggtgtgtcccgtgagtctgtctctatgctgtccacagtgttctgcgtacggatagccagtatccaggaggacatcctntatcactaggccatcacgatccgcacgcatctcgaatgtcgctcgtccgctnagcccccaatccgggacctatcgtatctcgcgaccacttctcccttggtatctggagaccattgctcagacgatcgtatgagtaggataagttaccttgcgttgcacaacgtcaattgactgaagctctccaggaatatcagttcaagaagttgatttccacacgattgtcgagaggggcggcacggttgatcaggcccttggatacaatatgttgtacactgacgagtgtcctcccttactagactaaggcatgctctcgaggtgacttgtgctactttttccggatcgccggcgtaactgcacctgtagggactttcctggtgtaaagcggcgattggagagcgaatttttcctatatccgtggaaattactagggccaagagtggaagctaaataccgccgcaaggagggggcatcaccttaatatccgattctgggtctagctaccaatattgctcatatgggccacggcacctttgaagcccaggagcccagtttcgaacacactaactataaccccagtcgagaacttttcgcacaaagcacattggccccaagagacgttcgccttaacatgtgcacgtattggggtggcgatacgagatatacgtctggccacaaattgcacgcgttacccacaatgggagaaaagtgcattagaacgaggatgtgtagctggggatgggggaattgaaatatattaaaaagcgctttggataacccagatttagacctccgcgtatcataaccgcgggcacttccttttaccactttggcacccaatgggtgtgctttccctttagaccccccacgagacgttgtcatggcccgcccggactcggggaccattgcgtcgcgatccctattcgccacgagacgagtaaggtttacggaactccctaccctataccaagttgcattctgcgcacagcgtgggaccgtccatgccacggcacgacaccgcaaacatcactcggggacggaaagccctaacacatgagaggaggcccaacacacacgtactccaacaaacgcggtcttcgggaggacgcgcgccccacgagttagcggccaagtgctcgcactgggtggcaggacacgagcaaccactaactatctgtcgggcacagaggtagcagtccaccgtttcctccaacgggaccatcgcacgctatactacgcacgtccacgtttcagtagaagaccacccaggcagaagcatcatcctgagcaacaggcacgggcccccttatgtgcccacctctaattcaccgtatcggtcagctactacttggacgcataaagccgctctttaacaccgttacacgcgcgcacacactatagcgaacgactcattttcctgaaacgatatgtttctctaagcgacagcgcgcttttgtaggccaacagtggggacaactacacggggtttataggagagtgacacgagaaagca

SEQ ID NO: 588359 - DNA, 373 bp, Homo sapiens
cgccgagccgatagctggaacttatgaggaaatgaggaaacgagcttcagataatttaaataacttcccaagactaagttttatagttgagggggggtgctagaatggaatccctgaagagtggctcaaaggcctttctctttaccatggcctgtgctgccttgctatactgatgccatgaagttagtccatcctgaggtctaaccccttttgatggtgtggaactcacatggggaaggcggacatttgcccacctgggccttcaactccttcacttggagctggcctctccccatcatgccagcttccctgtgtgtgaatgggtgtgtgtgtgtgtgaatggggtgtgtgaagtgtgtatggtcggtctttg

SEQ ID NO: 588360 - DNA, 94 bp, Homo sapiens
tcttctcccctgacattaatagtgaatgtattcttatttttcagtggcttaatctattttcatgtcttggaaagtgaagatacatttctctctt

SEQ ID NO: 588361 - DNA, 1307 bp, Homo sapiens
  misc_feature (372)..(372): n is a, c, g, or t
  misc_feature (933)..(933): n is a, c, g, or t
tcttggtacaaaattttattaaagggtctttagaagagcaacatccagaactccagaaatacagctgccaaggagacccggttagtgcgtggtggggacgtggctgtggggcatgtggcaggcggctctctgtggctttcccaccctttcgtgttcgtgagagtggggggtgggtgggcagatatcctcattcttggggtttccacaatgtgcctcacgtgtggctcgaggcagggcgcttcttatgagggccaatctctttcaccagtgtgtgggtctcccgagggccacgcatgtgattctttcacctttgaagtgccacagacaacaccctgtgtgtctgtggagacaacagcgtgtgggcgccacagncgaggtgttcacacggtagtataagttataaacgagggtgtcctcgcggcgtgagtgaactcactcgaggccattcacaacaaacttctcagtgggatttatagccccttctgtgtgtccctgcggagtttctccacagaaaaaccaaaaaccttcgagagccttgtgtggccccacttctctccagtggatgtgaaacgcggagacaaacacaaatagcgagggccctctcgcggcaacagcaagagcccctccttagggagtttgggtacagcgcaggagaacttcgtggccgtggggccaagtggcgacaacagaaacctctataggtggcgcacctgttttacagctataaaagctcttaacagtggcgctctctgtggaagagcccaaaccttcttctggaatctacgagcagtcgagttcccggaaatccgacgggccctttctccaccaaggaacatccgtgggtccgtgggggggtaacagataatggatctcgtaggccggggtgtgggggtaactccgccaccctcaaattcacaagagtaagcattcttncagccaggtccccgagttaagaactccattccagtcacgtttgaaaatccctacggggaaaatctctcttctgggatatggccgcaattcaaagaaattcgcaaatgtgtgacccccacgggacaacgtggagggccccgaaaatgtttacaagcgcgtgaaaaacagggggccttctgggccaaattgtagcgcaacaaaggggggtgtagccacacgagggaggactaaaagagccaccaggcatgtaacagtaacgaatatccacacgacggggtgttgaaaaaggaggacgagaaggtatactgacacacgggacgtgtgtaatagcaacctgcggaccgacaacatcttttctctcgattcaagcgggc

SEQ ID NO: 588362 - DNA, 657 bp, Homo sapiens
gaccagttaagagaacacctatcacagcatattcttgttgtgcatggccaaaagcgaacaacaatgcaagcaatgtctgacactttcttgacatcgtgagacgatggggaccgtacgaaccacgcaaaacgaaccatataagtacgtgggccaacaagtcagtcctagtaattttcccatacagttggataagcctaggctataacctactacacggtgcacaacaaatgcaaaaatggggaaaggttacgaaattacgttggacaggcatagacaaaacagggaataaccctagaacacttggtgccatccacacgagaagacaaacaccaataccccaaattatcacgaaacacaacacaatatgggcacaggccagttttaataatccttaggcaattggtttataacacgtgggcaccagttgcgcaagccaagccaaaacaagccccaacagctttgtcaattgagaaaaaaaacaccataccattggtggaacaacttccagttcgccaaaagtgggttatcccaatcttggcaaatcgtgccaaattgtggcgggcgcttatataaattagagtgtccttgggcaccaaatgtttccaaaaccatcttggacaacacttccaaaatggtcccccaatgggcttatacttg

SEQ ID NO: 588363 - DNA, 888 bp, Homo sapiens
gtgttgcagagggaatagcaaagaacaaagcccatgactcctgagcaaagcaaaaactatttttcatttattttaaacctacaataataactcatttctcaaaagggtcataggcagcaagcaataattgcaaaatcatggcagcaaagtggaacatcaacaaggtttgactaattggactatacccttgccctattcttaacttattcactggtttgcatatttaattgctctctaagaggatattgactgtctctatgccagtgaattctgcaactaggtagtatgagcatctacttgaagaactgtggaattttcagtaggaacatagaaaaatttttgaaggcaaagaaattctgagaatcaaaataacaattctattcacttgaattctatttcattgtgagcttaaggaccacaataacagcttttcaaaaaatgctataattttctctaatttttctaaattgggccctttatttctacattgtcctattctccatatatatcagttgatttctaaaagttgtggtcctgggaaccaggcaaccatcagcattcacaagagaaggcctggttagaaattggcaaattcttaaagctccatccccagggctacttgaaatcagaaaattctggggcatcggaccaaaaatctatgctttgtaccatcccttccggggacaattgtggactggcggctttccacagtctttcagaaatcacctgggtccctaacctagtgtcctgttatttggtaacaacacacggtgtacaataatgctctgctatttcactgtaacattgacattcgggtacatcattttctcgtctcgaagtctagtcttaaactaccctatgtgagcaaaatttacaacctgagggaac

SEQ ID NO: 588364 - DNA, 876 bp, Homo sapiens
acctccgcctcccaggttcaagcgattctcctgcctcagcctcctgcgtagctgggattacaggtgcccaccaccacaccctgctaattttgtacttttagtagagatggggtttcgccatgtggccaggctggtcttgaactgctgacctcaggtgatccacccgcctcggctcccaaagtgctggtattacagtcatgagccacctcacccagcctgtttttgagacggagtttcacttttgtcgcccaggctggagtgcaatggcgctatctcagctcactgcaaccccaactcccaggttcaagcgattctcctgcctcagcctcccgagtagctgggattacaggcatgtgccaacacccctggctaatttgtatttttagtggagacggggtttctccatgtggtcaggctggtcttaaactcccgactcaagtgatctgccgctcggctcccaaagtgctgggattacaggcgtgagccattgacctgtcctgcagtgtgtctttaaaatagttagggggtgcagaaaacgatgcagggagccattattctcctttagcaaggtagtctctttacaattgtgtggtttaaaatattccattgggaacccgtatcttctcaactgacctggaacagagctgatggggtggggggcccgcttgggctttggagatatctggagccatatctatctcgtacggggtatagacctgatttctcttgatctagcaattcgaacaggtgtcggtgctcgcggaggcgtgctggccagggggggggggtcccgaacggccgttgattacgacggtttggccctggacctatatggggcccgtggagcgccagccacgcggggtccggcccacgcgc

SEQ ID NO: 588365 - DNA, 120 bp, Homo sapiens
  misc_feature (70)..(70): n is a, c, g, or t
gtcaagcagacaagagaggttggtgagaggctcccagcttgtgtgcgtaagcggacacctggcccactcncgcccactgggaattagggagcagcagcaggtaattccttctggactcag

SEQ ID NO: 588366 - DNA, 385 bp, Homo sapiens
gtgcaagttgtcaaatctctctaaacttcagtttctgaggattcaatgatataatacatgtaaaactactggtacactgtttggtatgtaacaggtgctgaagatcctcatggctcagttctcttggtgactcagttctctttcttctttctccgcttcctcttcctcttccttctcctccttctcctccttctttcctcttatttttaaccactatgggaggtgtgaaatggggaataacaaaagtaacatctactgcaaagtttaaaattatcataaattttagcaggctcttatcataattattgctgtgtatagaactggctgtttagctaaaacagtgtagtacttttagctctttttttctgttgttttataactacca

SEQ ID NO: 588367 - DNA, 142 bp, Homo sapiens
aggctcccttgggagagaaggccagagaattccctcttactttacatttcttatgcttagcaaattaacaactattttgtaagcaatctgtgaaatccagtgtggctcttttcttttttttagatggagtcttgctctgtca

SEQ ID NO: 588368 - DNA, 321 bp, Homo sapiens
cggactcccccacatccactgagtcgactcttgattttagtaatttgagtcttttatttttgatcagtctagttaaaagtttgggaattttttcatgaaagtaaaatttttcctgcaatcccagcactttgggaggccgaggcaggcggatcacaaggtcaggagttcgagaccagcccgaccaacatggtgaatccccgtctccaccaaaaatacaaaaattagccaggcgcggtgatgcgtgcctgtaatcccagccactcaggacgctgaggcaggagaatcgcttgaaccggggagatggaggttgtggtgagccga

SEQ ID NO: 588369 - DNA, 503 bp, Homo sapiens
  misc_feature (50)..(51): n is a, c, g, or t
agccattcccggcatgaacaatatcacggtgattttgcgtaatcctgagnntctggcgctggatgccatagagcgtttgcaacgctggtgggaagagaaccaagcctttgaaaccgaattctcgctttattgaaattccggtggtttacggtggtgcaggcggaccggatttggcggtggtcgcggcgcattgcgggttgagcgaaaaacaggttgttgaattgcactcctccgtggaatacgtggtctggtttttaggttttcaaccgggcttcccgtatctcgggagtttgccggaacaactacatcacccatctgtgctgaaccgcgcttactcgttccggcaggttctgtcgggatcggcgggccgcagactggtgtttatccgctggcaacgccgggtggctggcagttgattggtcatacctcactcagcctgtttgatccggcgcgtgacgaacccatcttattacgtccgggagacagcgtgcgctttgtaccgc

SEQ ID NO: 588370 - DNA, 295 bp, Homo sapiens
  misc_feature (29)..(29): n is a, c, g, or t
  misc_feature (32)..(32): n is a, c, g, or t
  misc_feature (34)..(35): n is a, c, g, or t
  misc_feature (293)..(293): n is a, c, g, or t
gaattgggcacgagcggcacgagctcctngtntnntatgcaaattttgatttcttttttgatttcttctgtgatttgttggttattcagcagcgtgttgttcagcctccatatgttggaatttttaatagtttttctcctgtaattgagatctaatcttactgcattgtggtcagaaaaaatgcttggaatgatttctatttttttgaatttaccaaggctagctttatggcccaggatgtgatctatcctggagaaggttccatgtgcgcttgagaaaaaggtgaaattcantg

SEQ ID NO: 588371 - DNA, 110 bp, Homo sapiens
gcttgtgctgagagatcaggacgggcactggagctgtcttgtccttggtgtgattatctggatggttcccagaggtgtgtccatggggtaggaggatgggctcgcccacg

SEQ ID NO: 588372 - DNA, 617 bp, Homo sapiens
  misc_feature (427)..(427): n is a, c, g, or t
  misc_feature (579)..(580): n is a, c, g, or t
gggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgatttctggatatgacaggtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattangagggatggggcaggggactgttaggatgcattataaactgaaaagcctttttaaaattttatgtattaatatatgcattcacttgaaaaactaaaaaaaaacaataatttggaaaaacccatgaaggtaactaacggaaaggaaaaactannaaaatgaaaagtatttgcctctggaaagaacaactgg

SEQ ID NO: 588373 - DNA, 119 bp, Homo sapiens
tctaaggatccgagctgggaggagctgagattatatggtaacactataaatgtaatgtagtgtaatgacttgtctggagagggagaaggaactgagtcagacgtccagagaaaaggagg

SEQ ID NO: 588374 - DNA, 1469 bp, Homo sapiens
  misc_feature (711)..(711): n is a, c, g, or t
atgcttgttcactctataagatatagcgaaggggtgtattaatgtatatgaccctgtgctgtttggacattatgctaaatagcgcaatttttctgttgtagaggcttctatattgtgcctgcacactaggtgcatctatacccaagatctcatacacccttgtacaaagacttggtcaggcggtaaacacttgttacgataaatgtcgggttcatggctgtcatgagttaatccacgaattttctgctcctttaagttatttcattaacctggggattcgctatgacaccaaatatccatgaaaggttcccagagatttgcatacacgggatatggcaatgaagcgtgcccgggtaccctcgggatcacaccacaatagatctctttaaagaggcctttgtgtatgccacgaagaaattgatgcccaagattcatttgtgggttccgttaacagccacaacatttggttgacctcatgttgggcaagtatcgacttggagagtgtatgctggatcattgagggaagttcttctgtaaaaccctagcgtctagacattgcccgtgaatacactggagatgaacgaagtttcaagcggtgggaatgaatgcccgtttttccgcgctattactagagcatccgtggcgctcgggaacccgcttagtgcgccatgagccatggctaaggacagtaaacagtgcgttcagcatganacgcgtatgcacttagggatgggtctacctcaaatgtcgtcagtccccctaagttatatatacgcatgtgcttcatgtatgttgctcgcttgcgcgaacgtttcatcactctctcgctgtgcactgtcaatgaactgctctttggctactatggtgatcgcagatgtcatcaacgtaatatgttcagcaaggaccggtatgcattacccattgtcaacaatgtaatgacaactctggattcttaatttatacgttttcgtaaatgcttgcctaccctatggtgtctttgacgtcgactagatcgttgaccgtgtaagtattgcaaaaactactagttcgtgagaacattaccgtataccgattgctgcaccttcggggttaatgataatctgaaaaccgtgtcttatgggtcacttatactatatatgccatctgactcaaaagtgtaactatataggccaggcgtcggtgactcacaccctgtaatcccagcactttagggacggctagagaactgggcagaatcacctcgaggtcaggagttcgagaccagccttggccaacatggtgaaactccgttctctacataaaatattcttaaaaaattagccaggcatgattatgggtgcctgtagtcccaactactcaggaggctgaggggggagaattgcttgaacctgggaggcggaggtttaagtgagccgagatcgtgccatgcactactaaagctggggacagagtaacgccataacaccact

SEQ ID NO: 588375 - DNA, 120 bp, Homo sapiens
tcccgtgaacaaggcctacccctcacagtgaagtgggatcaacaagaacagaaacccgcgtgctcaggactccactactcttcttggacagcgggtggtggcaccaagctgatgacttca

SEQ ID NO: 588376 - DNA, 558 bp, Homo sapiens
  misc_feature (442)..(442): n is a, c, g, or t
  misc_feature (520)..(520): n is a, c, g, or t
tggtggtgtatttcttggtgcttttcgtgaagatgagtggatggtaaattttgggatttatatctggggttctcggtcgtccatgggtctggggtgtctgctttaatgccagtatggatactggaaaggttccctggtccccctcacagggtgtgtgaggggggtgtggctcccttcttcagggcccggcggttcaaacctttagggaaacatacagatgggcaggttaggggtctctgacaccaggggcagcatctaggggtgacggtttacagctcctgaagccccagggcgttggtgtcaaggtgtgctctttaagtttggcttggacgttctcgagggtgtcacggggctcgacctcaggggtgagggtctggccagggagtgtcttcacgaagattggcatcccacctctgagacggagcaccaggtgcagggtggnactctttcgggatgtggtagtcagacggggtgcgcccatcttccagcggttttccagcaaagatcagactgtgctggncaggagggatgcttccttatcttggatctgtgtcttga

SEQ ID NO: 588377 - DNA, 236 bp, Homo sapiens
taaccctgatgaatatctacaatatatatgttacagaaaaaaaacatgtacagtatgctctacataggggtggagggagactccctttacatgattatactgtctggtcccatttgatttctccaccttatttatgctttccctcttcaaaaaaaattaggccaggcacaggggctcatgttggtaatcccagcacttgtggaggggatctctctaaagttcgaccgtgcaggctt

SEQ ID NO: 588378 - DNA, 145 bp, Homo sapiens
accaacagaaaagtactgacccttcttacaaggtcaaagctcccccagacatagaacaaaatgagaaggcaacttcagccatattttttttcagggtacttgcagcaaagtctgtaattaaccacgttttcccggctggcgttga

SEQ ID NO: 588379 - DNA, 808 bp, Homo sapiens
  misc_feature (573)..(573): n is a, c, g, or t
  misc_feature (689)..(689): n is a, c, g, or t
agcggtgtttgagatgaaggtcaaagaataagttcacacacacactgaaggactctgaagctgagctccagcggcgccatgagcaaatgacacaagaatttggaagcacagctacacaagaattggcaggaaaaactgtcgtcagttcgatggatgaggaaagcaatctgggaagctcaacaacgtatttgagaacaacagaactcttcaagaaccttggggaaagaacaagaagaaagggaagatcttttagatcgtctctattgatccaccgagttaacagtattgagttgccaatatgccagcttggacatcagatgttgggttggatccgttctgaccaattttgcgaccaggtttgtatcccataatgataggattataactagctagtgactagagagaattattgtgtttatttctaggttcattgagtggggccaattatagatgcctttgaatttggtcctaaggagtagtccgtggtacctatatgaaacgtaaggaggctcgtataggtagccttcccttagcatattttcctattatgaatattctaaaccatggatatcntctcagagatgtgaactgctaagtagaaactagtttccacgtgtcggtcacgagagtcagtgctcctggggtggtgcggactgagtttacaggaattattccgaaattaaagaggnagctctcggcaagaatttccgatggcaggtttgcacattggccagtaatgatgtatgcagaactgtgccttctctatgcataattcacaatacaaaggttccatgcagcgcagcatatc

SEQ ID NO: 588380 - DNA, 309 bp, Homo sapiens
  misc_feature (287)..(287): n is a, c, g, or t
ggagagtcttgaagactcaggttagaggtgaactagttattaaagtaaaggcaatttctaccaaggtcagtttcttcacaggaaaaatccaacacatttagaaaaccaaaacctttcaaatgattttcctaaattaattagcatgtaggtcatactagcattcccataaaagggggcaaggcagtagaaaaggcggcatatcattttattgctttataccacaatagctaatgcaataaaaatgtttatttaataaaacaaaaatccttgatcctcctgggcattgncaaaccattaggtactatattt

SEQ ID NO: 588381 - DNA, 117 bp, Homo sapiens
atttggctgtacgagcaccctaacactttcgacacagtagattacaccgagggaagagtttcgggatgaacacgggaaaagtacataaatctaagcaaacagacaaagccctcctcc

SEQ ID NO: 588382 - DNA, 534 bp, Homo sapiens
cagtttatctaaagacctaatttcacaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaaggggacaccctcctaatgatgattctctcagaggaatgattatctccacgtctattctcagagcatttaaactgaacaagatgttacttgtttattaatggctgtctccacgacactattcctgatcggtgacaacagctttctctgctattcaactctcctctattgaattggatgctgttgaacgtgaacatagagtattaatacctttcacgctgtaccgccttctgtatcaatctatcctgaactcgaacggcatcgaacggtctaatataaatgcatatttgctatggcgcaaaaacacacacacaaaagaaaaagaagtgcgggc

SEQ ID NO: 588383 - DNA, 163 bp, Homo sapiens
cctagaatgttcctccatcccagattagagaagtaatctcatggctggccaaactcaagtaccaattcaactttttacccagaaacatttgctctggctagcagtcttttggataggtttttaactaccgtacaggctcatccaaaatactcgagttgtattg

SEQ ID NO: 588384 - DNA, 122 bp, Homo sapiens
agcgatcccattctttggtcaggcagatcacctgagatcaggacgtatgagacgcctgggcgacatggaacaaacccggtctctactaaaaatacaaaaattagccgggcgtggtggtgggc

SEQ ID NO: 588385 - DNA, 226 bp, Homo sapiens
ccccgggttcaggcgattctcctacctcagcctcctgagtaactaggactacaggcgtgagcaacacaccctgctaatttttgtactttttagtagagatgggtgccgagaccagctccgtgtgcggagccagctcggttgtggagatcctaacccagcgttgctagaggaattaaagacacacacacagaaatataatgtgtggagtgggaaatcaggggactag

SEQ ID NO: 588386 - DNA, 149 bp, Homo sapiens
tcggtctacttgttctggtctacttgtctctcggctctaccttgtctctcggctctaccgtgtctatttggaacgaccaccttttattagggtttggatgagtcgtcggcatcggacgcctctaaaccgagtgattgttacatctcgca

SEQ ID NO: 588387 - DNA, 1301 bp, Homo sapiens
tgtggttcggcgcgttctgcggcctggttgttgagatcgctctcctgcgagttggtttgtccgtgaagtgtgttttctcctccccccgagtgtgtgtttctctgggggccccgccacagtggtgggagaatgtggtgtgcttgcgcgcgaaacatgtgcgggaaagttcttgcccacttccttggggcccctttttggggggtggacccccgagcgtcgggcccaggagtgggttccccgcggctccttacgtcgtaaaaatcgtggaaggccgttgttgaccaacttgctacgaggacggtgttaaaaggagggaggaattgtaaatttctttgccaactggataagttattttttacccggagttctctagaacccccgccctccgtagagtcctgagagttcttcaatcccgtgccggaagaccatccccagagtgcccgccctgggtgcacccagagatttggtgaaatgaggcgcactgcaaggggcgcctgccaagaaaggggaattttttgggccacccccccgtcacaagggagaccctttcggaggccctctctttggggctctgggctttccccccccttgtttctgtgggacgggccctcttcccgccttttgttggaattctttttattgtggcccccccccgcaagaatatggtgtgagacccgcggctccacacgaagaattattgaagccttggccctatatggggaaaaaacccctgttcacacccccacatgggcccagcgttgtttaggcgtggagccactgtcttaaccacgccccccttgagccacgaaaggttttctaacccacgtgaggacacggcctccatggcccttcgcttcacgtccacgtggcacctaatcccccacgtctttcccggccacgcttgctcggtttttcccccacccgagagtggtggttctaagaattctattccacgaggtataccgcaggagaagacccaaactccggcacctcgggtttgctcccctcgagttataagtggcctctcacgcccatgagccacttctctcccctccctcggtgagaagtgtgaactttcgacattagtttcgcacctcttcctcgttggagaaggtaagaggccccctcgctccttgtattaagccccgaggccttagagtggccaacccagagcccttctgaagccccctctctgcctcgttcctcccccagcagtacccgggtggcccggggtggtgagggccagttttgcaccccagcccaacacattaccattaaaacccaactctcgtgtcccgcca

SEQ ID NO: 588388 - DNA, 833 bp, Homo sapiens
  misc_feature (388)..(388): n is a, c, g, or t
gtcgcgtacaaaggggcgttctctcctctccgtggtcgcgccatgtatatccggccccgcgttttatttaatcttgaggcgtgtcccatttccgcccccccgcggtgtttgttgcgcccccgccgttgtatcaaggtgcacgttcgttgcctgtcgaccacgcctgggttatcggtggcactgtgcctccgcgcgtttgatacaattctgcgacacgctcggggcgtttatctctctgggcaactaaattatgtagcccctgtggccacacccgctatgtcgaaacctatcacgggggagatgctgctccccataaagtgggcgggagaacttctcgtgggtcagacggctcctcttttcaagagaaagtacgatggttttctacttncatatgggggcaaggtgtacgcaccacgggggtatatggttccgtatgttaatgtgcgcgggtgagcctaggtacaagcacaagtgcgtgcgcgtgtgcaatatagagtgcacccgcttgccacccacaaaacatgcgggtgctttcataaaggtgaccctgcacttggtttgcccacagagaggcgcgtgcatgttatcatagcacccgcgcgagtctcgctcgtcagcacagattatattttcccattcgcgagtcctcgtgatccacagtagctcgtctttttcttcattcttgcaccttctgctatcatgacatctgtcagtcaccccctcaaaacactgcttctggccgccaaccggctctctccgaagaccccgcccaccacgtgccaactctatgctcgtccctcattacaaatcgaaccccctctgcccccattgca

SEQ ID NO: 588389 - DNA, 171 bp, Homo sapiens
ttacaggaataagagtacagaatccaaggcttcaactttctgttcagctgttgttcactagttccctactatcttgtgcgagataggtacaacctctcctagacaaacaggatatgtgataattgtaatctcttactaactgaatatagtgttgggtactacgctttggca

SEQ ID NO: 588390 - DNA, 199 bp, Homo sapiens
ggtgttcttatgacttggagaatttctagtgctttccatgcactagactaatttagttctttatgacagtgctattttattctgattttaaagatgaaaaaacaaacacacacagagttaactagtacagcatgaactgagtggcacatatcagacggggcagagccaggaatcaagacctcagtcagctacggttgga

SEQ ID NO: 588391 - DNA, 803 bp, Homo sapiens
gttgcagcggcttcggttaggccgccaacattggcgggacttcgagcaacagagggccaccttttggaaatgagccaagggtgatgagttgaaattgtcacccgagccatttcacggattccagttcgccttgacttagccacccagaaggcggggcaaggtcactgctgtccaccagccgacatcatgaaactttgggatgggttgttcctccgtcgctgtgaggaagttgcttgactgtaccccaatccgatttgagccatgatcatagaccaactgctcatgcaactggtgccagaatccttacccagtttgatgtgcttgtgatgccccatctctatgggaaccattattgaccatctggctgctggcctggttgggggagctggtgtggtcctggtgagagctatagtgccagaatacgccgtctgttgagacgggtgccccggcacccctttgccccggcagtgggcagggatatagcccatccccggccatgctgctgtcggcttcccacatgctgcggcatcttaatcttgagtatcactcccgcatgatcgcagatgcggtgaagaaggtgatccaagttggccaggtgcggactcgagacatgggcggctacagcaccaccaccgactttatcacagtctgtcatcggtcacctgcagactaaaggttcgaacctctgacatgggtggctatgctacttgccctgacttcactgaggctgtcattgctgccttgccccccccataggccctgtccatacccctgtaaggtgttccataaaggacatgaaccca

SEQ ID NO: 588392 - DNA, 297 bp, Homo sapiens
ggtccccctggggatttttacccccccctgggggggtttttccacccccccctggttttttttccccccgtatttttggggggaattttgtggcccccggggggggggggtgggggggtgggtgttttttgaccccccggcccccagggggaggcccccccctgcccccgattccccttttccccccccaaaaacaaaaaccccccccggggttttggggggggggtggggccaaaacccccctgtcccccccagggccctttttttttcccaaaaaattgggggtcccctttttta

SEQ ID NO: 588393 - DNA, 289 bp, Homo sapiens
cgctgggtatcgtcaggaatgtaagaagcccttctgaccggctgcccagtctggtaagtgaggagcggcttttcccggccgccatcctgtctaggaagggaggagtgtctttgcccggccgcccatcgtctgagatggggggagcgcctttgccccgccgccccgtctgggatgtgaggaacgcctttgccaggccgagacctcgtctgggaactgaggagcgtttttgcccgactgccaccccatctgggaggtgaggagcgtctctgcccggccgccccgtctgaga

SEQ ID NO: 588394 - DNA, 156 bp, Homo sapiens
gtggacctgacactcatgtaggagaccggccatgccttacaagtgcatgcagctcactgatctcatcctcaaagtttccgcacagtgcccaccagaagtatgtccgacaagcctggcagaaggcagtacatcaagtactcatttactgtccagggc

SEQ ID NO: 588395 - DNA, 101 bp, Homo sapiens
taaaggtaattctgaaatgacgtcagttaccatactgattccaagaatagattttattgtatttattcattcaacaaatatttattgagtatctactatgt

SEQ ID NO: 588396 - DNA, 231 bp, Homo sapiens
  misc_feature (2)..(2): n is a, c, g, or t
  misc_feature (8)..(8): n is a, c, g, or t
anacatgncgaacgactgatcagcctagtgatacgtaactgtatcctctgacatgttggtgtagtaagtggtttccaagccaccagcttccttgggtgggctcactttggtcccatctgtatacctaccactcgcagtgggccttcaggatatagcagttgttgcagaaccatgtatgtgacgtgtcccagctgcagctataactgacatggatcagtccgttcgcatgtt

SEQ ID NO: 588397 - DNA, 839 bp, Homo sapiens
ggccctgtccacagtgggctctgccatcagcggaggaagctggagacatgaggaactctgcgaccttcaagtcgttggaggagcgagtgggaccataaagtctaaggtgtgggtgacagagagaacggagtgacaacctcccttcctcagcggggagtggtgacaagccgcctgtcggatcccggacctttctaagcctgtggttgcttcacccgctgcatgagtccatcacgctaggaaccagacctctagacatcgacagccgcagctctgttcagacggtagtccgagccagctcgaggtcggatgagcgagagccggtcctgtaggacagtcctgcccatccacgcggagatgtggctgccgcgtttgatgaatttgaagaacacaggcttgtgcacagatgttttacactcacgttgtagatgaaacagatcactgtgctgtccttcctaggggtgcaggaagtggacagggcggagggttgaaagaatattgagccaagcccaggctccctttgggaatcatgtagcccatcagaatgtgaaggatgaagagttctaagcatagaaattaaggtgggcattttctgacttcttcctcctcctccttccctgtactcacagaaggaatgcaatcacccagacaagttcctacctgttacgcaattttttatctcaaaaatgcgaacgagaaaactgtgcattttctgagaccccagaaggaaactgaccctcaaggtggctgatgttaggcggatctagttttacggagccaaattcttattttgtaatgcaggggcttttcaaaaagttaaattaggcaagcagttagcctat

SEQ ID NO: 588398 - DNA, 149 bp, Homo sapiens
  misc_feature (66)..(66): n is a, c, g, or t
  misc_feature (112)..(112): n is a, c, g, or t
  misc_feature (119)..(119): n is a, c, g, or t
cagaagtttgaatgaagcaagggaaggcatgtagggacaggaaaggaaacaatggaaggaaagctnattttttgaaaaggacagttgaagccagcctcttttcccccaggcntgatttntttttttttttttttttttttttttttttt

SEQ ID NO: 588399 - DNA, 391 bp, Homo sapiens
acatatgtggcacggacaccaaaagggtcagactagctgggcatggtggcttacacctgtaatcccagcactttaggaggctgaggcagggggatcacttgatgccaggagtttgagaccagcataggcacatagcaagaccccatctctacaaaaaataaattagccggatgtggtagtgcacacctgtagtcccagctgctttggaggcagaggcaggaggactgcttgagcccaggagtttaaggctgcagcgagctatagtcacgccactgcatttccagcctggataaacagagcaagcatcagccagaagaaacaccttcctcaggactcccagggactggtcctcggtggggatgtgcccatcaggtccatccagggcaccatt

SEQ ID NO: 588400 - DNA, 831 bp, Homo sapiens
cattccatttcataaaagcttaatctagcaagaatggtgagccctagtagaagttagaaagaaatgttgaagtgtgtatgtgtgtgtgtgtgtgtgtgtgtgtgtgggcatcagaatcaccttggacactttaaaaaacaatgcccttgggtgggcgcggtggctcacgcctgtaatcccagcactttgggaggccgaggcgggcggatcacgaggtcaggagatcgagaccatcctggactaatgcgaagaaaccccgtctctaataaaaatacaaaaaaatgagccaggcgagggagtgggctcctgtagtcccagctacaggggaggctgaggtagaagcgcatgaacccgggatgcggagcgtgcagagagctgagatcgtgacagtgcactgcagactgagcgacagagcaagatccagcgcaaaaaacaaaaaaaaaaaaacacaaacaaaacaaaccaacacacaggcacaaagagaataaaaaacaaaagaacgcaaaggcgacaccaaacagcaagaaaaagagaataaaggacaaaagaaaacggagcagaaaaaagaaagaacacacagacaagaaacacacgggaaaaaagaagagagaaaacaagagagacaggacaaaaggcacaaagagaaacaagaaagaaaaaaaccaacaggtaacaaaagaaacaaaaaaaaaaaaaaaaacgaaaaaaagaaaaacaaaaccaaaacaaggcaggaagcgagagaaagagagaaacaaagaaaacaaagaaacaaaaaaaaaacgagagagacaagaaagaagacagaagaaaaaagagaagcggagcaga

SEQ ID NO: 588401 - DNA, 201 bp, Homo sapiens
  misc_feature (4)..(4): n is a, c, g, or t
  misc_feature (178)..(178): n is a, c, g, or t
catntgatattgtttgggatttgtgcccccaccaaatctcgtgttgaattgtaatcgccagtgttggagggaggggctggtgggaggtgcttggatcacgggggtggacttcccccttgctgttgttgtgatagtgagtgagtctcaggagatctgtttgtttaaacaatgtgtagcnaccttccccttctgtcgtcttct

SEQ ID NO: 588402 - DNA, 390 bp, Homo sapiens
  misc_feature (47)..(47): n is a, c, g, or t
  misc_feature (66)..(66): n is a, c, g, or t
gccaggaaacggagaagggtaaaattgaatgaggaattaagcaactnggtgacatccaaataaaantgaggagccaggaactggtatgttaacatactaggtcagaaatcacggctgggagcggtggctcatgcttgtatcccaacagcgaggccaaagcgggcggatcactgaggttaggagttcaagaacagcctggccaacatggcgaaaccccatctgtactaaaaatacaaaaagttagccgggcatggttgcgggtgcctgtaatcccagctactcaggaggctgagacatgagaatcacttgaacccgggtggcagaggttggcagtgagccgggatcacgccactgtacttcagcttgggcgacacagcgagactctgtcgc

SEQ ID NO: 588403 - DNA, 233 bp, Homo sapiens
  misc_feature (196)..(197): n is a, c, g, or t
ctctatgagggctgtgtgtactcccaacaaaaagatgccttcagggagagaactgaaggtattttctgtaagcaacctgcagcctgtggagttgaatgcagaggagacataatatactaacattaggcttcatcataatcacattccttattctaaaagagttcagaagaaatcatggtggacggtgtattgcccnnccctagacacattttccctctcaaatcttttataaa

SEQ ID NO: 588404 - DNA, 1037 bp, Homo sapiens
agcgaggctgaggcaggagaatcgcttgacctgggaggtgcaggttgtggtgagccgaggttggcgccactgcactccagcctgaggaacagagagagactccgtctcacacaaaaaaaaaaaaaacgcttagttggggttgcagaggcattgtactgggtgtctcctcagctactggggaaagctgaggggggaggactctctttccacccagaaagtttggaaaccagcctggggcaacgttagttgagacctccattttaaaaacataatttaaagattacaatgaagagaatacctccatggttcaaccgtttatgtccttctgggatgtactgataatgcggggaactttcaagggcggtagtagtaactcattgtgaacgcttgtgtgtgcccatttacggttttaacccttgtgctggggcggacactggtaccctctttagaaagcattgccccatttattttggaaacggggaccgtattaacacctacgctgacattattcacaggcggcggaacacacttttgctgtgtaacccattttactatttactgacgctgtgaagggttactctgtgtcgaacattaccggaaaaagatcgtaggttggtgctggatatagtggaattctagatcaagaacgatcttttttccatgtcctgggcagtaattttcaccaaagttacgtgggcaacgggcaacatttgtagaagggtgtgggacaatctaaaaccttacgccaggttttcttgtaagggatctgtgatttcgacttttaaatgtgcaagactgggtttgaccccccggtgaatccccgggtgatggttcctttccaaaaagaatacgtccttaacggggagtgatggtaataacattgaactttgggattccacggacaggggtccagttagggtagggtctcaaaatatattggggtaaatgggggggaaccattagaataggatacggtaaagaaattacgggagagaatttgtcaaataatgtcaagggaattaaaaaattgtttaata

SEQ ID NO: 588405 - DNA, 364 bp, Homo sapiens
ctattacgtaagacacaacagctctataaactttgattttcctaaagatcttgatgagtcgtctttaactttttattatgaaaaccttcatatattggccaggtgcagtggctcatgcctgtaatcccagcgctttgggaggccaaggcaggcggatcacctgatatcaggagttggagaccagtctggtcaacatggcaaaaccccatctctactaaaaatacaaaaattagctgggcatggtggcgcacacctgtaatcccggctactcgggagtgtgaggcaggagaatcgcttgaacccaggaggcagaggttgcagtgagtcaagatcatgccacagcactccagcctgggtgacagag

SEQ ID NO: 588406 - DNA, 773 bp, Homo sapiens
gaatctggcgttttgtgtgtgtcagttcagtctaccgtattatatggatatatgtcttatcttgaaaaatattttaaattcacttgtttttttttcccccccagtatggctgacaaaattacacactggtacctagtatgaatctgaagtagaacagaattttatgtgtgagaatgtggatgaattatcatgcttttttttcctccccctccccctttctccttccatgcatgcagtaggtatggagcatccacttggttgccagttattttctggatgctggggaaaaatttcctgctattctggagcttatattctggtgagcgtaggcagttaataaatagaaagtaaataaataaaataaatagtacgtcaacatgatgataagtattcatggagaaaaagcaagagagttaaagacgggagtgtgggggagagaggttgcagttgcaaatggtatagccaggaacaggaaatgtataaccttggtagttcctgtcatggagtcacacacaaagagtcctttctagggacttacctacgggagcagcatgtaaatgcctgttttacgtcacgtggactaataactccaggaagaatgtcctgttcactggtcttggaatccttttcaatattttgatgtacctctttaagaagtgagggtccgtatcacctgttaacttgtctcctttcaagtaatcattcctttatcctaaggtcttatggtggttaaaacattaattttcaggggtccaaacatttttctgggttcc

SEQ ID NO: 588407 - DNA, 330 bp, Homo sapiens
gagacagagtcttgcgctgttggccaggctggagtgcagtggtgtgatcttggctcactgcaagctctgcctcctgggttcacacgattctcctgtctcagcctcccgagtagttgggactacaggcacccgccaccacgcccggctaattttttgtgtttttagtagagacgggatttcactgtgttagccaggatggtctgaatttcctgacctcatgatccacccgccttggcctcccaaaatgctgggattacaggcgtgagccgtggcgcccagcctagcacatttttcttttttgaaatggagtctcccttctgtcgtcttctc

SEQ ID NO: 588408 - DNA, 308 bp, Homo sapiens
ccgctgtacagttgcggacgtgagctggttggacgaggggagctggtgggcaggtttgatcccagggctgggaacggaggtgtagctggcagagtgggcaggtgaggacccatctgccgggcaggtgagtccttccctccccaggcctcgttatcccagccttctgaaaaagggaggttacggggatcgagggctggcggggagaagcagacaccctcccagcagaggggcaggatgggggcaggaggaagtagcaaagttgacatcttctcggggggagccgagacttgcccaactggtacggcggg

SEQ ID NO: 588409 - DNA, 461 bp, Homo sapiens
aactgtggtttatccatactaggaaatactacttagcaataaaaacgaacaaactgggtacaggcaccacgacctggatgaatcaccagggaattaggctgagtgaaaaaaaaaattgcaaaatgttgtctactaaatgattccacttatataacactcctggaatgccaaaactatagagatgaaaattaataattgctgtgttaatgaagaagtggaaatgggagggaagtggctgtggctacaaaagggcaaaatgagggatattatagtgatgaaagtgttctttattttaattatatcaatgtcaatatccagactgtgataatttactgtagtttacaagatgttatccttgggggaaactgggtaaaatgtacatgagatatctctgtaacatttcttaaaagtgtctgtgaatcaacaatgatatcaaaataaaaagtataatttaatacagc

SEQ ID NO: 588410 - DNA, 146 bp, Homo sapiens
attttccaacttttccttttatgataaattgatattattattattcttattattttgagacagagtctcactctgttgcccaggctggagtgacaatggtgtggtctcggtcaccgcaacttccgcctcccgggttgcagtgagcc

SEQ ID NO: 588411 - DNA, 1165 bp, Homo sapiens
  misc_feature (527)..(527): n is a, c, g, or t
taaaaggtgcttcttttataatgaaacaaatccaaaaaattgtacagtcaggctcaatttgtgcagtttcacaagcttggaggaaacagacagaacgacagcgtttcaggacagctcagagcttaacccaaaacgaggcttggactttgccgccagggggattactctctggatggcactggggccggggccaccgggctgggcacaggcgcagaaggccacgggctttctctttcacctcgtgccccaggctgtgccgtggcaagttcgtggtgctccacattttctcagtgaattatcacctttcttccctttcagaattctaagaaagtctccggaagccttgctttcaaaaggagttccctctcttcgtgcagccacaaagtgactcccaaaggtcttctcccctgtgccaccactatacaactgtgtgtgcacctgtgctgtgcacttgtggccccaagaaagcttgtagatttacctatctcaggtttgtctcccccaaagagaatttatttacagaggcncaatttgtgttactttcctctcaacgaggtgtgtccctagatgggcgatctcatatccaaaacacctatatagtgacaaaactttggtgatctccaccacacaccctgtggaagggcccggaaaaaaatctcggggagcgcatattctcccatgcagatgatgaggaggttcaaaatctcccttttgaaacggcgtggtgagaatcgatgggaccttttggcgcgcccagaaagagacgccgaaggaaaagagacgatgagcccgccacggaaacccagaacaaccggcctacacaagcgggggtacggagacccccagaggagagggccatgatagtgagaaaaacctcacaacacacgcaaaaaaaaagccgcggatccttcacgcgagagtgccacctgcatcctaccccgtgggtcaccagaacttccccccagatatatgtaagtgatcatttagccacgcggtatgcctcaaggccccattgcaaagtttacacacgtgcgccctattggtagctcaagttataactagcgcgcctcacttggagacattcccccaatatatatatatgcgcccgaaatatatacgggaaagagtttataccaaaatatgggacacatatttttgcaaaaac

SEQ ID NO: 588412 - DNA, 315 bp, Homo sapiens
ctcattgcgtgacgctggtgtggctgcatagcgggggtcttcgagaggctcttcgtgtggctcatcgactggctcgtggatgtggactcctggcgtggcacgtcgagaggcccatggtgtggcacgtcgcggggctcctagtgggcgcatggggtggcacgttgggcggctcttcgtgtggctcctcgggtggctcatggtggggctcttcgggtggcgcatggtggggcccattgtgtggctcttggggtgctccttggtctcctgtgagtctgccgtctttggagtgtgtacttgaggcatttcctccacgcg

SEQ ID NO: 588413 - DNA, 174 bp, Homo sapiens
gaggatctgtgctttggagtgaggaggaggacgtatgagcccaggagctgagacagctgggaacatagagaatcgtctcaacaaaaaaaaaattttagccaggtgtgctgtgagctgtagtcccagctacaaggtgggaggatggcttaggcctgggtgattgaggatgcaatg

SEQ ID NO: 588414 - DNA, 781 bp, Homo sapiens
  misc_feature (480)..(480): n is a, c, g, or t
cctaggcgtggactgcaatggcgcgtacttggctcactcgcaacctctgcctcccaggttcaaggaattctcctgcctcagcctcccgagtagctgggattacaggcgcctgccaccacgcctggctaatttttgtattttaagtagagatggggttcaccatgttggccaggctggtctcgaactcctgacctcaggtgatccactcacctcggtctcccaaagtgctgtttattacaggtgtgagccaccgtgtgcggcctcagggaattgaacaggttggatttggagacagtgagttaaaacagaaataagaaggtggcagacaaagactatcagactgaaatgtgttggatattgatatccccccaggacctcccactgtggccatggaggctcgagactcatatctgttttattcctcttccccccccccccccccccccctccccgatcttacccccccccccactacgcaanattgtacccttcgctccccccctctcctcctactgtcccgtgctctgttcttcctctctcctgctcgtttactccctcttatctcctctccttcgttcttttcctcttgccctctcccccaccctccttgacgcccttctcctctcacccccgccccgacatctactccccacaccttcctcacccccacgcccatcctcctcctccccccccccccctcccccgcctccctccttcccccccccccgtttggcttcccccccctcacaccactctcttatttctcatctcactctaacaa

SEQ ID NO: 588415 - DNA, 138 bp, Homo sapiens
cagtgttctacaatgaagcagtaagaagaaaagagactcctgatagttcaggatgcttcatgcagagggcggcattatatacctagtggtctattctgatggtcagttttattcccctcctgagatccgaagcaggat

SEQ ID NO: 588416 - DNA, 391 bp, Homo sapiens
cggaatcttcggagacaaaatcaatatacaaaatatggtagcatttttatacaccaacgacatccaagctgagagcaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctatgcctatcaaactaccaataacattcttcacagaatcagaaaaaaaagcatgaaaatttatttgaaaccaaaaaagttccgttgaagccgt

SEQ ID NO: 588417 - DNA, 397 bp, Homo sapiens
gtaagagatgggcaaccaattcggtgatgagatcggtgtcctgcagtattgttagctggttaggcgtacggcagtactattggttgaatgagtaggcgtgatggttttgataataactagtatggtggataaggggtgtaggtgtgccttgtggtacgaagtgggctagggcatttttaatcttagagcgaaagcctataatcactgcgcccgcttccatcaaggggcatggccatggctaggtttcatcagcatagtagggtggttggtgtacatgcagtgcaggcaggcagtccgcaggcggttcagttgtggccaataaaaatgcattaggctcctagtatacgagctccggttcgtcctttagtgtcgtgtatggttatcatttgttaagagg

SEQ ID NO: 588418 - DNA, 283 bp, Homo sapiens
gctgtcggatagcgggtgaacctcaagcccaacctgtcctggtcccatgacgtcagcggctacggccccacggcattttcaacgaaggcgccaagcgatcagcgtcggcgtggacgcggactaccgcaacacctacaccgcgagcctgagctacaccgactttttttggcggtgactacaacaccctcaccgaccgcgactttatcgccctcagcttcggcgtgaacttctgacttggtttaaggaaggacaacaacctatgcgtaagctatttgcagtgatg

SEQ ID NO: 588419 - DNA, 264 bp, Homo sapiens
tcacgctttatacttctcaacgctttatactctcaacgctttatacttccgtatggaattcaagtataatattaagtatgcatggagaagtataaagcgtggggaagtataaagcgttgagggggatgcagcgtagagggggtggcgggctagtagagtggcagggatggatggagaggaatggagggtggagcacaacgacgtgtaggggatattgatgaggtcacaatcatgcaagtataggagcagtataagggtgttaca

SEQ ID NO: 588420 - DNA, 559 bp, Homo sapiens
gtggttcaatgccagaattctttcatacttatgacaagaaagtttaccaagcaagagaatgggacaacaatcagagagctttaacggatgagtggactcagctggatatgtcctactaggaacttgggcacttaacggaaagcttcataaaagccatctggagtcggactaggatctgaattgcacgcggcttgaatttcgatctatctccatgtacaactctggaacagtctttaacatttaaccgccgcgacaccccccacaacacggggcgcatatctcaccaccctcaaacccctttttacacacaacgcaagaccacaagcagcattgtacctttccccactggggcaacctcggcggcaccgccaacggcggccaccacggccaatcaccgcacaccggcaaccacctatcaccacgtggcgcggccacaccattccacccatccccccgaggacaacggtcgcacaacggcctaatagaccacctaaacgaacattgtggggcaacaacactagtgctccccaatacccgccacacctttactctcgggcct

SEQ ID NO: 588421 - DNA, 215 bp, Homo sapiens
gcaattctcctacttcagcctcccaagtagctggggattacaggcatgtgctaatttggtggtttttaatagagatggagggttttcccatgttggtcagggctggtctcaaactcctgtaccttgagtggatcggctcggccttctaaagtgctggaattacaggcatgagcaccatgcctggccaggacatgtgttcttagggcatgctatgc

SEQ ID NO: 588422 - DNA, 762 bp, Homo sapiens
catggtggctcaagcttgtaatcctatcattttgggaggccaaggcaggtggatcacctgaggtcaggagtttgagaccagcctggccaacacggtgaaacccctctttactaaaaatacaaaaattagctaggcatggtggtgggcacctgaaattccagctactcaggaagatgaggcaggagaattgcttgaacccaggaggtggaggttatagtgagccaagatcacacgccactgcactccagcactccagcctgggcgacagagcaagaccctgtctcaaaaaacaaaaagaaacagaataaatattttaggctttgccagccatacagtctctgttacaaccagtcaactctaccaatgcaacacttaagctgccatagacaatatgcaaatgaaataaatgtggctgtattccaacaaatatttataaaaacaaaggaggtccagattttgacccgtagactgtggtttgctgacccttaatttaggtctaatttccaacgtacagacaacacgagggacagaaaaccatgttaaatactatagagatgtacattagaaaattcacatgtgaaaaaccattcagacaaatgaactacctcctacaaaaaataactcgtcatggtacactaaagaaatcatgcagtaaaaaattcagacatgtcagccaattgcaatgtgtggaccttaacagcaaactgaaggtgacagacgaacagtcagtgaatctgacagacggatccacttgcactataa

SEQ ID NO: 588423 - DNA, 1037 bp, Homo sapiens
cgcctgaacgcaggcacatatcttcctattctacgaccctagataggcttcccttccccttacgtcatcgcagcgtaagtttacacatcactaacatccctaggctcatctaagactattctatcgtactcaccgctcatctgcccagagaagctatcaaatctcgctgatgccagacaacgttaagtatgagctagctttacagcaatagcattttataggtaaacgataccgtctttcacggtactccgaattatggactcccttaagagcccagtgtcgaagacccccatcagctggcgtcagatagtacttgccgtcagtactctctgaagagctaggcggctataggtagtagataccgccgtcacaactgcattactcaatgcccctgacataaaagcacatagcctaccccttccttgtactatccctatgaggcatagattgatagacgaagctccatcatgccttacgacaaacgagagctagaaatcgcctcattgcatacatcttcaatcagccacattagccctcgtagtaacagccatttctcatccaaatcccctgaagcttcatcggcgcagtcattctcataatcgcgaacggacttacatcctcattactattctgcctagcaaactcaaactacgaacgcaatcacagtcgcatcataatcctctctcaaggacttcaaactctactcccactaatagctttttgatgactttctagcaaagcctcgattaaccttcgccttacaccccatattaacttatggggagaactctctgtgctagataacacgttcttcctgattcaaatatcactctcctatttacggatcagatagtagttacagcactataatcctctacatttttaccaaaacgacaagtggctcatcacccaccaatttacacgtaaaacctattcacagagaaaacgccctatgttatatacacattcccatatactttaatctaaccggatataacggttcccccaaaaacaacaatcaaaaagtttcacatgca

SEQ ID NO: 588424 - DNA, 919 bp, Homo sapiens
gtactgggcggggtctggggagcgcagcaggccatggaagccgtctctgctcaacaagggccaagatgcccatcctgggtgggtacctggaagtcccctccaggcaggtgactgaggcccgtgaagtgtggccatgtgacgtcggtataccgccacatcgagtgtgcccactgtgtcccagaatgagaatgagcgtgggggtgccccattcagggagaacgctcagtgggagcaggttgggtgaaagcgtgaaggagcttcttcatcgtcaggcaagctgtggtgcatcgttacccatgagaaggccctggtgacagggagcctgccaagaaagaacactcagctgaccttgaaggctggacactacctggaccttctactcttatacagtggccgagtggtttaaaagcctggagaagggaattttccccatttggatttgcgttcgggcgcaatgtgtggtctccccagtgacacccaaacatttctggaacactgttggcgggccatggaagcacgctgtgtgaatgaagcgcttgctgaaagctatgtgaatcttccaatttcaaccatctccagcgtggggatgctctaagacaaacctgcttgaatgtatacaggtctgcggttaccccatgttgtgttgcacccatatttcactcagggggacgttatccagtcttggcgtccaagagctcggggtgaccgctaagccgcttggttcctgagaggcctgggcaagcccgggcctttctccgggagtccgggccagggttcggccagcataattcagccgttgtcggcccgcggctgtgggccccttgcccgacgttggacctggttgtgctggcgggtcccctcacacgggggggtgggccccgccccagggggcgccatttcctttgggggcgcgcggtga

SEQ ID NO: 588425 - DNA, 858 bp, Homo sapiens
cccgtcgccggcagcgcaggacactggcgccgagtggtggggcgcgggcgtgtggcgtccgggtgtcgcgggtgcgcgcaggccgtgatgtgtgcgcttttgagagtcgcgggcggaacggagcccggccgtccgccctggcggcagtgagcctatcgatccgtcgccatcaccgtcttctctgcccgacggcctaccttcttccaacgtggatgtacgcgcaggaggccgtcaaggaagggctctgaccgcggttggtgttcgacggaacgagacgattgttgttcttggttgtcgagaacgacagtcagtgcgctcaaactgcaggatgaaagaacagatgcggaagatctgtgctttggcatgacaacgtctgcatggccttttgcatggcctcacctgacgatgcaaggatagtcatcaagctagtggccctgggttggacgtgccatagccacctggctgactgtcggagtgaccccggtccactgttgcgagtacattcacccgctacatctgccaagtcttgaatgcaacgttatacgcagagcaatgggcgcagcgccagttttggcatctctgccctcatcgtgggtatctgactttgatggcactcctaggctctatcagactgacccctcggtgcacataccatgcctggaaggccaatgccatagagccggggtgccaagtcacgtgcgttgagttccttggatgaagaactatacgtgacgaagccattgaacacagatgattctgacccattaaacgctggtgatcaaggcactcctgcgaaattggttcagtcaggtggccaaaacattgaacttgctgatcatgagggaaaacaatccctca

SEQ ID NO: 588426 - DNA, 824 bp, Homo sapiens
aattccatactcggcattgaaccatactaacttgtaggcaatacgaattagatctccacgaaagtttgatactgcctccacgtatcttagtgctctagcaagcgtaataatccatgtgattggcatggtacagcttatgaagcctagggtctgattaaccattctgatcgcattctacgccggcttcattaattcacactgttccaagttgacacttaagtatgcccgagaatccgtaagttacatggtaggcactgagcctagtggaggtcaaatcagtctggtgctcctcatcaccagatcttgaacgtgacctgtcactacaacacattataagccttagcattacaagacgataaaatcgaatcaacatacatccaagtgtttatttagaatgagaagcgcagtgataacatatggtatactatagatatcacacgtggtgcattgtatttggccaagatatatatcattaatatatgttagacctctaaagtctgttcaagtagaactgatctagtgtataatatacctggttagtctggttgtatgtatatgttaatataattaaaactaataaataacacatttctattgtagttgagaatgacgaattcatggggtcaggttcgtatgctccccttaatagaaggactgacgtcctaaattaattatattggagtataacctatatttcattggtagaggactaggtggaatgttattctgtaaggaaagataatgtataactaaagaaaaatatactttttggctattattaagggaagttggtttaaatggagaaaacccgttgttattgattg

SEQ ID NO: 588427 - DNA, 121 bp, Homo sapiens
cggctaatgagaggtatttgggtcatgggggtggatcccacatgaattctggcttgcgcactgttagggtccttctcatggatcttcatatgtctgtgcatgttcccacttgcgatatagt

SEQ ID NO: 588428 - DNA, 134 bp, Homo sapiens
ttcttaaaagaaaaaatgaaatgggaataaatattatgttctaggattcctgaaaatctaggataggtgagcttctctgaattcagtatatcataaatgaagatgttttgccccctgccatatcattcccaaag

SEQ ID NO: 588429 - DNA, 172 bp, Homo sapiens
ccccggctcccctgtgtggcgcattgtgtggctccttgtgcggctcttcgtgtggctcgttgcgtggcgcgtgggggtcgcgtaactaggtagcatgccagagtctcgttcgttatcggaattaaccagacaaatcgctccaccaagcgccacgcaacgagccacacgaaga

SEQ ID NO: 588430 - DNA, 411 bp, Homo sapiens
ttcaacttgtttccgttttttaaaaatatatataaataaaacagttacccaaatcctaactccaaggaatttcagtagttctccagcactttcatcttgcaactctgcatcatattgtaaaaaagaaaatgaattaatgctgtgtaagggaaaatttgtccttcaaaggaaaactatacattgtctacacataagcagaattatgatactatggaagctattttacatctctgtaagctgtagataactgatagtgatgcaaaataattattgcctgtagaaattctgctaagagtcaattgactttcctcccttctgtggagaagctaggattctcttttgaacctattaaacatctacttagttccctcattaattaaagagttaaataaaagctttaacaactatctt

SEQ ID NO: 588431 - DNA, 613 bp, Homo sapiens
ttatattctggcaagacagaaactgatcagatgcatgcgtatgaaaggatggtgcaggcagtcgcaggccgggagcagggctgagaggctgcaggatcacagtggacagcgtggcccaccctagggaaggcactgactgattggaggtatgcaggctaaccaagcgggaggctgcatgtcagaaggagggaggagagctccaggacaatcacaggtgatcatgatgggctgggcgcgtgccggcgtatgcagatacccactaagcacttaacttgcattattttatcatcttcaaaatcccttgccggagggagctgttatagtccccatttttcagaagagaaaacagagacaaaaagcagttgagaccacagagccatgacatgcagtacaaggccgtcggctttccagggtcccctgttaaccacagcctagcgtgcccatccaaggccggcccatggtggccagcttgcacagcaggttggatggcagggccagtcatggggaaggagggcactaacagagaaggtctaagctgagacaccagtgaaagatcctagggcaacaggcaacactgccgcgtgggaattcttctgtgctatgtactaagaat

SEQ ID NO: 588432 - DNA, 387 bp, Homo sapiens
ttataggactcattctgaccagtttctggtggcattcaaaaaagtgggaaaaaagccccccacttttggaaatgggtcagtcattgcccttgaattactaaattctggatatgaatttgatgaaggctccatcatctttaataaattcaggtctgtcatctcctataagacagaagaaaagcccatcttttcccttaaaaccgttgcaagtgctggtaaggagttttttctatgacacaaattttttggcataaagaatggaaagatttgtacactaaggcagacagtgtcaaaatatctggtggtagctaaagcaaatgatttggggctgtttcttttttaaatggaatcttacagcctgggcaaaagagcaagactccgtctcca

SEQ ID NO: 588433 - DNA, 887 bp, Homo sapiens
ggtcgtttatatgtctatattattcggctatatagatatcgccggccgcatacagtttattgcattctattttctggtggtgaaaaaaatgtaacatacatttatttagcacgacattgtgaaatacacaaaacatgttactgagaaagcaggaattttctattcctagcccgtttctgaggacgaaatcatgaaccgctcccaatgtgattaattatttattatcaatagtcgggcaccaagccgaagatttttttattttttcctctcaatttaggcagttaatcaccattttctttcatgtccttcacaacattcaattcttccatcagctcccctttatcatacgaaagtagggtaatttaagctcttctaatcatacttatttcgttgcccgacattttatatacgacaattatcgaatgttccatattacaaaacattctattgcgtatttttcaaaaggtgtataagtgaatcctattgattttatccgtctgcgatatttattaaatatccttgttaatccctcatgtaagcttctgttaacccctttctgtaatgcggaaaatctagttaatgtctgtctcttttcctgtatacgtataggacgttctttttttaatataatgatatatttagaagtgtcaaactagaatgcttatatcgttcgtcctatatttactttttctaccttattcggttaattcttcagtagctgaatagctttaatccccatgttgcctaatttgagtatcgatccccctccccctgatattcgccgtccagattaaacgtgtaagcgtgtaactaaaactcttattacatggcaggagatattttatcacattatatcacttctgtttcacgctgtacatttacgttta

SEQ ID NO: 588434 - DNA, 174 bp, Homo sapiens
cagctcataacgcttagcctagccacacccccacgctaacatctattgattaacctttatctactataacgaaagtttaactaagctattctaaccccagggtttggttcaatttcgtgcctagccaccgcggtcacacgatttacccacgtcaatagaatccatcggttcaat

SEQ ID NO: 588435 - DNA, 552 bp, Homo sapiens
tagaggatccccacaggtggatgcagtgggaggcagagctacatgagctcatcctcaggttctgtgtcaacgtcccgggccaacaagacctccgacaggctagtgctagatgagcttactcatcatcccgctcggtgctcaccctgtggccaaatacttggggtcagtcgacagtaaatacagtagttccttccaggattctggttggagagatctgttcagtcgctcggagaccaccagtgtcagagctaactggccgtggcagggagggtgatgcagtacgtcaacggggcagcactacgacacaccagcttcgcgtggcctgaagccatgctgactggccggcgtatgatacctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggacacccctccctcctccccatctatg

SEQ ID NO: 588436 - DNA, 169 bp, Homo sapiens
ccatctgctacgggaggctgaggcaggagaatagctggaactcgggaggcggagactgcagtgagccgagattgcaccagtgcactccagcctaggtgacagagcaagagtccatcttaaaaaatgaaaaagaatcaaattagtaatcgtggtcaacacagccctgtgt

SEQ ID NO: 588437 - DNA, 120 bp, Homo sapiens
cataccaccctgagcgcgccctcgagtgccgccggagtggggaaactattaaatgtgattctatatttaatcaaatacctaactgggaaaataataaagattgagtaatggggagacact

SEQ ID NO: 588438 - DNA, 805 bp, Homo sapiens
gtacctgacggagggcgaccagaatcgagagagtacagtggtcataattccagataagagaatcgtgaccctgaatcgataaagtggtgtccagttcccgacaccgggccgcagagcgggcttctcaggcatcggatggagcatatggtgcgaggctcccggaagacgccagaggagccactgaggtacaaccagaagcgcccggcaaccgtgccactgcaggtgagctgggacctgggaggcggatgaggaaaactcagagacccaggaagaagacgatcacttgcgagacatcaaggaagatggcaccaatgcgaaggccgggagggctgcagttcgctgtcactggcgaatagagactgtgcgtgccgcctccggctgcctatgctgcgcgagatgagtagtggatggcggggccttaacattcgcacggtctgtgtccctccagggatacccaccaagactcacacgtgccaagcaactcgatggcaacatgccagacgacacgggtcgtcagccacagggccatgggggcaaccgcctcaaacccagtagcgcgctagaaaggtgagccccacaagagtcccaggcagcgaactcatggagtgcgaagcactcgcagcgggccacgacacacagcatccagggctactgcaaagagagcggacactgactgaaactgactgcccgcccgaatcgacgaccacgggccgcctgcaggcacacaccgaccgacgagcacgaggaacgcctccgcgccacaaggtcccacagggcgaccccgcgccctcggcccgcgcaactc

SEQ ID NO: 588439 - DNA, 821 bp, Homo sapiens
gtcagcctcccacgtagctgggaccataggcgcacaccatcatacccggctaaccttttgatttttgtagagacggggtctcactttgttgcaccgggctggtcttgaactcctggactcaagcagtcctcctgccttgacctcctaaagtccttgaattacaggtgtgagccacggtgcctggcttcaattaatttgtgtctgttgatttgtatcttgcaacttaactgaatttaatttatttatttatttatttattttgagatagagtcttgttctgtcacacaggctggagttaagtggcacaatctcagctcactatgaccttcgcttcttgtgttcaagctattctcctgcctcagcctcccgagtagctgggattacaggcacctgccacaatgcctggcttaatttttatatttttagtagagacggggtttcaccacattggccaggctgatctggaacgcctcacctcaggtgagccgcccgctcatactcccgaagtgctgggacttaccgatgtgagccacaaagtccaactgaattcatttgtcagtccaatggttcgggactccttagggttcctaattattagaatattttcgttaacacctccggttacttagcttctatttggctccagtccctgcggtggagtacagaggggcccttctgggtggctgcgaacttacttcacgtgatacactgggggcataaaggcgagcccatttaacaaattcccagttaaccgcgcactagagggccccctgattcgagacagccgttcgtaaaaccggcgagccgaccccgcacgacta

SEQ ID NO: 588440 - DNA, 298 bp, Homo sapiens
ggtcatgtatactcttagacccactctgttaaaatatatattctatgtatgcgtatatgggattggaatgtcattattgtaacctaaaaagtgctttgaaatattgatggggggaggtttattggggcaccagatgtatttcagcccaatggcccctcccaaaaagaaattggttagtaaaagcttcgttatacatttgactaagaaatcacccagctttaaagctgcttttaacaatgaagattgaacagagttcagcaattttgattaaattaagacttgggggtgaaactttcca

SEQ ID NO: 588441 - DNA, 1189 bp, Homo sapiens
agcgcggccgcccaggaccctgcagcagagacagatcgcctgcagtcaatggagaccacggaaggggtgagacaaggaagaggatgtctgagctggagaaggccaatggtggccctcatcgacgttttccaccaatattctgcgaagggagggagacacagcatcaagctgaagaaatccggcatactcaaggagctcatcaacaatgagctttcccatttcttagaggaaatcaaagagcagcgaggtctgtgcgacaaagtcatggaaacacctggacacaatggagacgtgcgaagtgtgacttccacggaattccatggcctcttagtgagccacttggttactactcgcctgccaccgagattctcttgacacactgacggtgaagactctcacacacacgcacgccaaaaccctttccctgctacaccaggacgacgcgtccatgtcatcccagaagacgaggaccagccatagggcctctgactgagccctcagctcaggacgcatgatctctcacagcccgctagtacacgtagcctcccatctcaggcaagcctctgcatctcggccttctgctcgcatcgcaccaactctgcagcaacaccgtcctcttcccacacacgcgcctgcttccaaccgcgcctgccctccacttctttctgcctactactctcaggcctgtgtgtggatacaggcctgcaccttgggcccgccagggaactccttgctttgaaccaggctagaccttcacggcacgaccaggctcctccagctcgcacttggccgtcgtgccacccgcggccaagccccgcccaccgcgccccgactggttaagaaccccacttaaacccccgggagcggaaacccgcctgcccctacccggaaacgttaccccccggaggggcaaccccttaaaaaaccttgcccaacctaaccctccaacacacgaaaccacaaccaccccagcgggataccgcccagaccagaaaggtcgcgccccgcgcccagcgactcccggggcgcacaccggcggcgcaagaacagtcaacaaaagcgaggagcccccgcgccgacgcgtggcgcaccccccaatcacagcgggggcaaacaccggcgctggcggacaccaaccggcaaacgtggggctcccgggcgaaaccggtgtcgcgggcaccaaccaacg

SEQ ID NO: 588442 - DNA, 122 bp, Homo sapiens
gactctagcggatccccctgctccgcccctctctgtgacctcaggcactagctttcggctctggagacagccccagagcagggtgttgggatactgcaggatgtagtagatgctattagcgc

SEQ ID NO: 588443 - DNA, 244 bp, Homo sapiens
aacgtctcacggatctcccacctcagcactcaaggctaattatggtattattatatatatatttttttggtagagaggtagagttggggtttgccatgttgtccagactcgtctggaactcctgggctcaaggaatctaccagccttgacctcccaaagtgctgggattacaggcgtgagccagcgtgcccagcctcagacttcttcttcattcttcttcttcttcttttttttttttttggaa

SEQ ID NO: 588444 - DNA, 1020 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (10)..(10): n is a, c, g, or t
  misc_feature (34)..(34): n is a, c, g, or t
  misc_feature (184)..(184): n is a, c, g, or t
  misc_feature (194)..(194): n is a, c, g, or t
  misc_feature (365)..(365): n is a, c, g, or t
  misc_feature (553)..(553): n is a, c, g, or t
  misc_feature (611)..(611): n is a, c, g, or t
  misc_feature (1020)..(1020): n is a, c, g, or t
tttngngncnaccctggaatcgggctaaaaaagnaaggagaaatattaataatatatgatagtatttatattcaatataagaataattggaaaaaagaggatatatctctaatagacagctgtaacttaaggggcacagccggaggggagccaggcggataaggtggaaaagaaagtagggaanggttaagganctgtgcgagtcgtcgtccgaaggcaaacaaagaaagatgggaggaacaagcgagcactcacccacaaccgagagggaaacaagacaaacaacatcacgacactatatgagccatattatccacaacaggtgaagagcgcatcagccagatcaagagataccagtgaaacanatcaaatttaaaatgataaagtaagaaggtttagaataggtgctggtgcaagtggatatgggtgagtagaagacagttaatacttaaactaatcacactgcgaccattatctactacatcaagccgtcaaacaccatgagaacgcaatacatcagaccgctataccctaacgcagatgactgagcagncgaacgctcacattactattagcgtaccctcaccgctttctcacgtcgcaacgtcctncgacccagcgccgaagcgctcacccggcctcaccacacgacacccaccgacgccctatcatcggccgccttctcgctgttacagtactctttaacatctgtacatattcttatatgtttattattgagaatcataacaactcaagagcataatcacatcacaacatttaatacaacaacttaaataatcagtatcgttatctatttatcttgtgtctaacttcatcacattcacagacaagaagagagacaatagcagagagatagtgaagaaagtgaagaggttaataatatgtatattgagttatagaagtggagatgtgtgataatatgtattatgaagatgtagatggaggagtataatagtaggagattaacacttattaacgaccgcacagccagcatgagan

SEQ ID NO: 588445 - DNA, 194 bp, Homo sapiens
gtcatcgtctcggtggagctgatcctgtccacgatgatcggcgccgaaatgcgccttgaagcgctgggcgatctcggcctggcagcgcctcgcccggccgaggagcacatgcgcaggctgacctgctcgcgtgcgggcagcagcggcgaggccagcatgcccgcaaagcccgtgggcgcgccgaagaacaccgg

SEQ ID NO: 588446 - DNA, 633 bp, Homo sapiens
gctgatgctgggtgactctagaggaccccagcaaagctctaccaggagctgttcagagaaccggcagagctcacgtgttacgaagctgcgccagcggaggaggagcgaacagctgcagacagctggacgagagatgggaggcaagcagaaactggagcgccacattttcactctcaaacatccagctctccgactcgaaagaaagaaagctgcagggactttgccagcaccgtggaagctctggaagaggggaagaagagggtccagaaggagatcgaagaaactcacccagtagtacgagggagaagggggccgcgtatgataaaatggaaaagaccaagaacaggcttcaagcaggagctggacgacctggttgttgatttggacaaccagcggcaactcgtgtccaaacctggaaaagaagcagaggaaatttgatcagttgttagccgaggagaaaaaacatctcttccaaaatacgcggatgagagggacagagctgaggcagaagccagggagaaggaaaccaaggccctgtccctggctcgggcccttggagaggcttggaagccaaagaggaacttgagcggacaacaaaatgctcaaagcgaaatggaagacctggtcggtcca

SEQ ID NO: 588447 - DNA, 288 bp, Homo sapiens
ccgcgtcgacgcgatccggctgaggcatgagagcatgacaagccggttgaggcagggaagcctggcgagctggttgaggcaggatagcctgtagaagttcccggacccgacgtcattactctgacacaaaacaaataaacactccctgaagcttcccttaggtgaggtgttattctgtaacaagtgctctgagagtcgggaagcaaggtcagggagtgagtgttttaataaataaaagaaacaatgaacacgaaacacaaacatttacattacattttacgtcgacgc

SEQ ID NO: 588448 - DNA, 826 bp, Homo sapiens
  misc_feature (249)..(249): n is a, c, g, or t
atcggcgagagctgcttctcgccactcgccagaactcagtcccgccacagaagcgcatgagagagagactgggatgagcatcagactctgacccagtaccacagctggtctatgagatgccctagtgctgcggggggtggtgggcccaagcttatgggcccccctcagccctggggccacctgacgtccacatcgatgctagcaccgatgatccttgccatatcacaagtgactcaagggcatggtgancgagcgattagtcgagacagattggaccatgggctggtgccagcaccgcaccggtgatggagagaaccgttctaaggtagagtttctcttcccgtcgtccgcatgggaagtggaagtcggatggatgagacggagagccgtcaatgcgcgttatgaatgacattacgaagcatgcgatattcccgtggcacgggcagtaaacctgagcgtggaaatttcgccccaggcgggaatttgtgcgtatctctttgggcagcaaccacatagcatggcacggacgtaggtattccggatcgtaacaggtaactcgacccagagatggcaggttggcggacagccgtcctggctgcggtagggcccagggcgcggcccctgggaagaaaccgagctgagggtctgcctgtccctcatggagactggctggtatgataatctctgatcctggacagtagacggaacgctgatgccaatggtcgagatgctggagtgcaggccgtgattgagactggaaggaggcagcggacaatgatcttcgcatcctggagcaggaggacgaggaggatcaggcacgaaacag

SEQ ID NO: 588449 - DNA, 906 bp, Homo sapiens
gggcatctggcggtgtgagtgtgggtggcagcggggcgggtggccagcagccgccgccacagcagcctcgcatggcccgctcacccacaaagaacctgctgaagcacaagagcctctctctatctatgcattcactgaacctcatcccagccaatccggccccccagtcccagctctcccccaatgccaaggagtttgtgtacaacggtggtggctcacccagcctcttcttcgatggggtggaaggcccgagcaccagcaccacggcccccttcggcagcggtggagccagcacttgcaacagcagcagctttgatgtgtcccaggtgttcggaggcggtgctaacagcctgttcttggagaaatcgccctttgtggaaggcctcagctacaacctgaataccatgcagtatcccaaccagcccttccagcctgtcgtgctggccaactgaccgtcttcccatctgccaggccaggagcacacacgaccacaggcaagtgaaaagaaaggccaaacgcaagagggaaagaaaactgtacagaaagattccagtcttctcattctcccagctaggaaaaggattcgcccaggcacagagtaggaggggctcccaaagcaacaagtgttggactcagccctgactattctgcctgctctgatttcctttggtggttggattttgtaattatttttttacatgtagtttctatatgacaactttattagtggttcccgtgctaagagtggcccgatgtgattgtggtcccgtcctgcgcggccttgggcacgggtgtgacagcccgggaaggaagtaaagggagcggacaggacacgaagaatgcgaaaacaacagaggagaaagagaacaaaaaaagagaacgccaaaagagagaaacagaagcaag

SEQ ID NO: 588450 - DNA, 344 bp, Homo sapiens
tcccaagatgtaggattacaggcatgagccactgtgcggggcccagagctaatctttaaacttttttttacagatggggtttctccacgttgctcaggctggtctccaactcccgacctccggtgatctgcccagctgccgcctcccaaagtgttgcttgcgattacaggcttgagccaccgctcaccctggctttttttttttttttccagaacaaattctcgctctgtcgcccaggctggattgcagtggccgcgatctcggctcactggcagcctttacctccggggtcccagcgatcctcctgcctcagcctcctgggtactgggggggaaacttggcga

SEQ ID NO: 588451 - DNA, 263 bp, Homo sapiens
ccggtaccggtgagcctcctcaggcgaactgatggacattgcccgagacggctacgtctaccgggacaaagcatgggttaatgccggaaaaatcgcagaggaggttgcaaaatcaatcacctggaatgcacaaatatacgaagcatggacttacggtttcgccagcaaaattcattcgatttgcgcaaccatgacgtgctttgacgctgaaatcctgcttatcgcatcaggatttcaaaatcaggatctaagtgaactcagcc

SEQ ID NO: 588452 - DNA, 571 bp, Homo sapiens
gcctggccaacataatgaaaccccacctctactacaagtacaaaaattagccatgtgcttggtgtgctgggctgcctatatgtcccatgctactcatgtgagtgctgatgacatgtgatgaatctgcttgaaccctgtggacggctggagtgtttgcatgtgatgccaatgatcactgctcctaatactctagtacttgtgtgttgacatgatgctgatgacttcttgctctccacgagacagacaaccagatgcatgaagcacacacttgaacatgagtttggccactactatgtgtctaacataaccacgcagtataccgctcaagtgctactacttgcttgctcgtagctaagccaaacgcttcgtacactagctacaaacttggaagtacgcagtggtggttagacagcttttggacaatagtgctaaagagaacgggggggtaactggacaaaaacgataagtaacttaacgtaaggttggccaaagagcgaagttttaaagttcgagataggatggaaagagcaagtggggacagttggggtgcgaattggtttgttggtaattg

SEQ ID NO: 588453 - DNA, 194 bp, Homo sapiens
tactccagagtttcaatggaagatctttatattaaagcatgagcatccttgtgaaggaacgtaagttctcttttgttggcatccactcatcaagttgctatccaaaactacgtcataacagaaggcaccagaaattacaggaacttctggagctctgaccaaattgacgtagttttggataacacgttcgcgag

SEQ ID NO: 588454 - DNA, 281 bp, Homo sapiens
ggcatgcctgagtgatctaaggaccccggctagcggatttggaacgggtgatatgctggatgatcatgagataaggagaggtgatcgtggtgagaagtgcgtcgtatagtcatctactcggtgtagttatccatacccgtctaggggttcagttggcggcgatagcgcggataccagcctcaaactgggaatctcggtctgacgtggaagcatcccaagaaatggcaaaaagacaaaaaaaaacccaaaaaacagagagcgttcacttaatgccgctagcg

SEQ ID NO: 588455 - DNA, 232 bp, Homo sapiens
  misc_feature (43)..(43): n is a, c, g, or t
ccggtttcccgggcccttacctttcctgatgcccctgacatcnatcattcttggggagacaccacgcctgtatgtggtgtggggcgtggatcaagtgtacctgtgaaatccatatatatgaaatgtcctgcgggatacagttttagctgactttttttttactctgaactcttatttgaattgttttttgggcaaatatttctgctcccccagagattgtcctatccaaata

SEQ ID NO: 588456 - DNA, 309 bp, Homo sapiens
tagaggatccccccgcgcgcccttagcccttaaccctgcctactgcttcttaaacttaacttcaggctgggaatggtggctcatgtctgtaatccctgaactttgtgaggccaaagaaggaggactgcttgagcccagtagttcagaccagcctgggcaacacagtgagacctcatgtctacaaaaaaaggaaaaaaagaaaactgctgggcatggtggtgcacacctgcagtcccaagctacacgggagcctgaggtgggaagtcaaggctgcagtgagctgtgatcacgccactgcactccagtctg

SEQ ID NO: 588457 - DNA, 957 bp, Homo sapiens
tgtcatgggtgctgacatgtgttgtctgctatcttgctacgtggtccttgtagcccaggagcttgtgcctgccatgagttgagatcatgtcactgctctcctgcgtgctggacatgtagtcggaagctccgattctccgagaacaaatattcgcgtaactatcgatcatagaaacaatttggtggtttccccatgtcctgtgctgtccggatggactgagcgtactctgaaggtgctagagcggcccagaccagtgttcgccacagtcttgcttgttgggtttatacaatgtgaaccgtcttttgcacgatgcattcactttgtatcgagagtgtcagtctgaactaataagataattggccggttgactaatattgtaggactggtaaaaacgattaactccttcttaccctgttgagtagtacaacacgcggtggtcaaacttgtggcagtgtggttaatccgacagttcaaggctgataacgacgtactgccggccttttgtgggctgcttactgaatgcgtcgccgagatcggccccgggataccatccaaaacagtccgtcattggaataccgtttgtgaggactctttccatgagatagctaatgtaaggcccgtaatgatggttcgctgctatccggggggaataagccgtccttttagagaactggagcatgctaaggtgggtgcggtggtcactgtaacattacccttctaaatgatgtaaatcattccctactccatgaatttcatggggctgaggttgctcacttagcacgcatgggggtgtctctgcacatggcatctagcagtacctttgtaaagccaggagtacacgcgctgggccggagacatctgcgcggtaaaagttttcaacatacaaattgacctgcaggccgatccacctttcgggaacaccgggaccggtaaattcctgtaaacgggtatcccagt

SEQ ID NO: 588458 - DNA, 962 bp, Homo sapiens
  misc_feature (168)..(168): n is a, c, g, or t
  misc_feature (170)..(170): n is a, c, g, or t
  misc_feature (200)..(200): n is a, c, g, or t
  misc_feature (209)..(209): n is a, c, g, or t
  misc_feature (250)..(251): n is a, c, g, or t
  misc_feature (271)..(272): n is a, c, g, or t
  misc_feature (285)..(285): n is a, c, g, or t
  misc_feature (287)..(287): n is a, c, g, or t
  misc_feature (316)..(316): n is a, c, g, or t
  misc_feature (333)..(333): n is a, c, g, or t
  misc_feature (340)..(340): n is a, c, g, or t
  misc_feature (343)..(343): n is a, c, g, or t
  misc_feature (351)..(351): n is a, c, g, or t
  misc_feature (371)..(371): n is a, c, g, or t
  misc_feature (376)..(379): n is a, c, g, or t
  misc_feature (385)..(385): n is a, c, g, or t
  misc_feature (387)..(388): n is a, c, g, or t
  misc_feature (401)..(401): n is a, c, g, or t
  misc_feature (403)..(403): n is a, c, g, or t
  misc_feature (415)..(415): n is a, c, g, or t
  misc_feature (428)..(428): n is a, c, g, or t
  misc_feature (439)..(439): n is a, c, g, or t
  misc_feature (441)..(442): n is a, c, g, or t
  misc_feature (446)..(446): n is a, c, g, or t
  misc_feature (461)..(461): n is a, c, g, or t
  misc_feature (465)..(465): n is a, c, g, or t
  misc_feature (545)..(545): n is a, c, g, or t
  misc_feature (547)..(547): n is a, c, g, or t
  misc_feature (616)..(616): n is a, c, g, or t
  misc_feature (728)..(728): n is a, c, g, or t
  misc_feature (870)..(870): n is a, c, g, or t
  misc_feature (950)..(950): n is a, c, g, or t
ttagattacagtatcaattcacaacatttcataaagccactgtacaaatagaggattgaatcactgtgtaagaaagatctaagaacagttaaatcatgatacaagtccatagtttatatggtttagagctttaagagccttaatctaacacgtttacccttcccatantnagactactactgacattcatgttcagttgnccacgagtntgtacaaatcattctaggtaaagacaaacactttcagaatnntttaacagaaaatatttttnntcaactttaaaancncacttagatgtggatgcctttggctaggnaaatagaaatgcaagtnttcagangcntctttganaaggaaacaatggggtagancgccnnnntgtaananncaaaaggcttgananatctaccaagtntatcactgaagtnctattaattangnnatanatactgtatgatgtnggcntttgttgaatacattttacaccagttgggatatagctttttcccccccgtaatgctgctttatcacaactgttttttacnanatcagcaactggatttttgatagaagacataggagattttttcaacatgcaaacatttgctaaatacanggtgtaccatcaatgtgtgattaataagttactttttaaaataatgtgctagcttagatattctactataaaccatttcattgagtacctattatgtaaccaatattttatnatatacactgaatctgaggcaacccaaaatgaacaatggaaagaaaactagtaaatctgaaatgtacttcacattctacttaatctaatttaaaatataaattcattgtgcacccataagaaagatggtccacctgtgggtntttttaaaattctaacaggagatatcatttaaaatattgcttttcacatggcaaaagggaagaattgaacatatatttanttttaaaaaatt

SEQ ID NO: 588459 - DNA, 801 bp, Homo sapiens
atacagtgacaggcacacctgttgcctgtaccacctcttcctggaatacggaggacgaagttcgttatggactgatccctgaggaatggcttccagttactttatcctaaaactggtgtaacaggaccctatgtactcggaactgggcttatcgttgtacgctttatccaaagaagatatatgtgattagcgcacgagaccgttcacggccctagtcagatactatggtgtaatggtctatggaattaaagagaagtatggtcccttcgtggcacgactttgctgagtaaactcaagtgagcaaaaatcttgcccaactatgaagaggcgaagcaggcttccatccatgacatccagaatgcaattgatacggagaagtcacaacaggcactgtggttcacgcaatgcgccgattaccttgttgatgtgcatacggagatacacattgctaggtggctttggaagtatacttaccgggaacgactgtatacgacgtactataacggacacgtaagagaatcgcctggactatcatagtatctgtgcagaacatgatgcgtcgaaagggaacgaagaacagcgatgataaattggtggtgggaagcacgtggtgcaaagcatctccacaggagcaggaaaaggagacaattgccaaggtgcattggggaactaaagctgcttggcaaagaaggctcgagccacagcagtatgtaaatgtgtctatcccagtggagacggtcagaacagttgctgacaaatgggaatagtctatttgcaagtcttctgtgtcgggtctaatga

SEQ ID NO: 588460 - DNA, 209 bp, Homo sapiens
cgaagccctgctaaccttacgcagcgatcgtatagatccagtgtccgtgccttgcatagactgccctgtccctagtctactctatcttgcctggggcctagttcactcaacatgcactgatgacattcgtaagagacaccatgtaagacaagatgaggactcactacaacgactagatggcatgatgcctggcacattctgtggacctc

SEQ ID NO: 588461 - DNA, 714 bp, Homo sapiens
acatgtgtgaggatgtcagcgcctgtgttgcctgcgggactcaaggtctggccttggctcaatgtgaacatgcacgtccatggatggcgacctcgtccgcgggtttgcattctgggtgtggacgagctgggggttcggtccgagccctgtgtggtgatggctccctggagctgctagcctggtgcccatgcccacaccctgctgcctggctggcacatggcgatgtgcacccttgtgaccgtggaccaatggtgctgcactggtgtgaggagctgctccgcgggtgcatcgaagccttcggtgagtggctctgggagtggcacacggagcctgagcctagccccgagtctgagccctgggtccctgcctcccaggcacatgtccagggcacagccctgacccggacccaaacactgctcctgcagagtgcagtctctttaaacgaaagcctcctccgcaacgcatgggcagagagatgcacgcccttcagacatgatgacggtttacccttctctaggccttccccagacagggctgtgcgaatgggaggggcggtgtcccggaattctgaacacgtatgagtgggagcatttatcgtgtcatcccaggtggaaatccgtgagtgaacttcgctattatccggacatgggacgctgatacccggactaaatggaggggcggattatctgggtgaaagggtgtgccccattaccc

SEQ ID NO: 588462 - DNA, 211 bp, Homo sapiens
  misc_feature (42)..(42): n is a, c, g, or t
gcccggaggcaggcagcaccccattctcatcacccaaccacntcattctgcattttgcggtccaccgtgcaagtttcatcattcttcatcctcacccaggcttcaggcacatcacatctaccccatcattgtcaacttcacgtcactgccggcaaacaaaagcacaccattaggcatcacatcaggtcatgggagggcatcctctcagcag

SEQ ID NO: 588463 - DNA, 455 bp, Homo sapiens
  misc_feature (15)..(15): n is a, c, g, or t
  misc_feature (45)..(45): n is a, c, g, or t
  misc_feature (75)..(75): n is a, c, g, or t
  misc_feature (141)..(141): n is a, c, g, or t
ccccccctgctcccnccccccaccaacactgggccaggatcctanccctcccaaacctttgcccagtcctaatantataaaatgatagctcggtgcctattttggttttgcatttcccatggtgaacaatgaagtttgaanagtttttgttcaaaagtccctttgggagttcgagaccagactgggcccacccaggagttcaagaccagcccgggcaattcagtgagatgttcatctctacaaaaaataagaaagataaaaaattagcccaggcatgtttgtgtgtgcctgtggtcccagctcctcaggaggctgaggtgggaggatggcttgaccccgggaggtggaggctgcagtgagttgtgatcgtgtcagtgcacggctagcctgggcaacagagtgagaccccgtttctaaaataaaaataaaaaacaaaagagaaaagtcaaaaaaaa

SEQ ID NO: 588464 - DNA, 113 bp, Homo sapiens
cacgaggagaaccccaactccagtctggtctgtgatatgtcctcactgtttcaggagcttaactctggacaccggccccctcagatcccgtggatgttgctgcacctggtgtg

SEQ ID NO: 588465 - DNA, 549 bp, Homo sapiens
gcacgagcggcacgagaaagtctccaagaaatatgggattatgcaaaacagacaaagaattataggttttcctgagggagaggaaaaaacaaaaaatttggaaaacctatttgagggaataattgaggaaaacttccctgtccttgctaaaaatttagacatccaaataaaagaagctcaaagaagtcctggaagactcattacaaaaaggacgtcaccaaagaacatagtcatcagattatctaaagtcaatgtgaaggaaataattctaagaacagcgagacaaaagcatcaggtaacctattaaggaaaacctagcagactaacagcagacttctcagcagaaaccttacaaaccagaagagattggggtcattttttagtcttcttaaacagaataactgtcaggcaagaattttgtatccagcaaaactaagtttcataaatgaaggagaaataacgtctttctcagacaagcaaatgctgagggaatttgtcaatactagaccagtgttacaagaaatgctaaaaggagtgctaaatcttgaa

SEQ ID NO: 588466 - DNA, 1150 bp, Homo sapiens
ggaatggagctggtgtcgggcgcaacttgctggcgtctgccgcagatgcgggtaccgctgcagcttggttttctcgggagagagcaggttagcagtgcatcgtggggaacggtgaagatgcttccctaccggatgaccctgtccaagcctggtccacctcacagccttcctgggatacaaggctggcattgactcacatcgctgcggtcaatgtcggacaggcctgggatccaaggtgaacaagaagagagtgtaggtggaaggctgtgaccacttgtatgaagacagccaaccaatggtagggttgtggcgcattgtgcggctacgtgggacaactccgcgtccgaggatctccgtgaacctttcaatgaacatgtcttttgcctagagacaacatcaggtgaatagaactgcaacggacgggcagtatatcgtactacagcaacattggcactaaacatcgtaaccgtaacgacagagcccatttaaccaagttacttgcaacgaacatggcacaggcatgacgagactggccaagaacgccacgactgcgcagacaggaactacaacgccaacgacatgaaacacaaagatcacttgtcgcagagagttcacaattcgccgggtagcatccactttaggcccccaaccaacacgcccaacgaaagtaggcatgcaccgttggacgtttcccattccttggacgcctctaggcaaaaggcaaaccgggccccccaaccaccgttgaactgcggcaggaacttcccgactggactaggaacaccagtggaatgcagtagccaaccttggttgcggtcacccggaacggaaacaagcacgtcggggcacagcttagaggaggcccccccccgagctcggacacgtacacggacggcccttctatggatacgcccaaatgaccaaagcagtccattcacacccgttgagaatttcacacaccctcaacacagtctgtatcacctgggcgtatccaaccacgaaaattgcaacggaactttgacattccggcaacagcataccaattacacgtgcgacgccattgtacccccgcacatgtggacaaaaactagagtcgccataacccaacacaatcgacggtaccaaccacaaaagtaaccaggttcctggg

SEQ ID NO: 588467 - DNA, 117 bp, Homo sapiens
catgctattgctcattgacagctcacctgagtcaccttccaagttgtaccatgggctcctggctctggagggtgggcaagcttctccacattccgcccaatctgtaccggatgttgt

SEQ ID NO: 588468 - DNA, 192 bp, Homo sapiens
  misc_feature (63)..(63): n is a, c, g, or t
  misc_feature (107)..(107): n is a, c, g, or t
  misc_feature (174)..(174): n is a, c, g, or t
ggctcagcagactcctgtaggtatgctgctgtatcctcagttgactcattcctcagttcacangatgttggacaatttctacaattttgacttcatcatttgctgtntctcaggaccagatgacaccaagcccaatctgaaatgttcatccggcaaatgtggttctgaaatggntgactttcgacgactagc

SEQ ID NO: 588469 - DNA, 82 bp, Homo sapiens
caaagaccccaatgaaaaatttttagtcccttttttgcatagcctaaagataaaataggaataaaagttttatatttatgga

SEQ ID NO: 588470 - DNA, 298 bp, Homo sapiens
  misc_feature (206)..(206): n is a, c, g, or t
ccccccgggccccccccccccgggggggtttttccccccccccccatttttgggggggcattttttgggggggggggggtttttcccccccccagggggggcccctggggtttttttgggttttccagggccaaggggcccccctttttttttaaaaaagggggggggggccccctccccccccaaggggagggggggggtttttncccctttttggccccccttggggaaggttttgcccaaaaaggttgggcccccccccccccctttccctttttttaagggcgggtttgcggga

SEQ ID NO: 588471 - DNA, 139 bp, Homo sapiens
cacgtgagggcttgctgatgtgctggtggttgcacctccaacacggatgctccacaggcattcatggccacaccccgtactcgtggccagcagttcctctattgcctctatattttgtggtacgcccgtgactccccgt

SEQ ID NO: 588472 - DNA, 332 bp, Homo sapiens
gctgtgtttcattccatccttttatttgagtctagtgtgttcgagtagatatcgatgggtcttgactctttattcaatttgccagtctgtgtcttttaatgggagcatatagtccatttacatttaaagttaatatgttatgtgtgaatctgatcctgtcattatgatgtaagctgggtgattgtgctcgttagttgaatgcagtttcttcctagcctcgatggtctttaccaatttggcatgattttgcgggggctggttacgggttgttcctttccatgtgtagtgcttccttcaggatcaatcaggttccagcccaaccgtggactagt

SEQ ID NO: 588473 - DNA, 449 bp, Homo sapiens
  misc_feature (339)..(339): n is a, c, g, or t
  misc_feature (341)..(341): n is a, c, g, or t
  misc_feature (428)..(428): n is a, c, g, or t
  misc_feature (439)..(439): n is a, c, g, or t
ttagaagttaggatgaatacatgttacactgttaacttttagcaaattttacttttgttgaaaactttgtgtttgggattttaattatccttcgcaattaataagacatcatttagtccaaattaacttagaattggtatagatgattccttcctggttctgtaagtactttaaggcttggctgagtacaaacagctcacacatttgagcagaccaattattaggcaattttcctaacttcatttctacaagagtttgtttccctattagttactgggatacccatagtgtcttcttccctcagtcacccgggggaaaccatctatcatcctgccctgnangggagttcctcctagggtctgggtcagacctctgtatggggcatttaatttaaggttttggatctcctgtttaggaggacctgctgngtttagggggntttttccgtg

SEQ ID NO: 588474 - DNA, 375 bp, Homo sapiens
acactaatcgcaagaggtctgcttcgcctgtgtagactggaaagaataccgtcttgctcacgatgtgtggctcctattgtgtacatagatgataagacgaactttacaaactactatacaggatcgtggctattttgaagagtgatcacccatttggaagcagcactgggacttgagcgagctccacattggaatgtttacttgaattagctattctatactctaaatttaagcctcagaaaatgatggagcacctggagctgttctggtctaaagtgaatattcccaaggtgctaagagctgcagaacaagctcatctttgggccgaactggtgtttatgtatgacacgtatgaagaatatgataatgtgatag

SEQ ID NO: 588475 - DNA, 107 bp, Homo sapiens
caaaatttttcaaaaaccccccccccccccgggaggaaacaaaaaaggattttttttggggggggcgcccccgaaaatccaaaaaaaaaaaaatttcagccccttga

SEQ ID NO: 588476 - DNA, 2174 bp, Homo sapiens
  misc_feature (1818)..(1818): n is a, c, g, or t
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccttaaaaaaaaaaaatatcttaaatgaaataaagggtggatgtaaaggntatatttctttccccggaaaaaaaaaaaaaaaaaaagaaatcccttgtgggccggggccaagggccaaaacccagggtctgccccccattgaaaccttccgcccggtttccccaaaaaatgtcaaatttttttatagggaaaaggtggaaccctttggttattttaaggggaaaaccggggaaacctaggacccttcccaaatttctattgggcccaatgggggggccccccccgggtttggggaccccggggaaaagggggttattttttttaccgggccttttgccccaatttttgcttgggtgggggttaaaaacaaaactggcttaaaaagccttcagggctttttctctgt

SEQ ID NO: 588477 - DNA, 2274 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgactggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588478 - DNA, 372 bp, Homo sapiens
ggaccaggcgctcaccacctagtgacatagagagataactctcgccatgaccggcttgtgttaagctggctcagtgctcccaacgattgggatcggagcgcgaaccaagctggaatcatggaacttgaccatactctgaaatactctatcttgcagattgagccaacacctcgccgaggcaagccacatgttaattgtggtacctgatactagttactgtgatgagaattttaaactggttcaggattgtcatggaccatatctcggcctaatggacacgggaagagcaagagtaactccaacatgtgcagaaattgctatgatccaatcgtcatcaggcgcgaccactttagaatgccagttcattggcgc

SEQ ID NO: 588479 - DNA, 1526 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggctgtcctggccggagccatgttgacttgattttaccggatttaagacacagatgacttcttttacgttcaattcctgatagttagaaaaaaaagaggaggcgctctaaatcccgaggaccgtagcctacgatttgaaagggcaagagaaatagaacagaggacaagaaggacagaacgattgaaccattggggatgacacaaaagagaatagaagtaaggaaatgatagaacaaggaaacagacttacgatagcc

SEQ ID NO: 588480 - DNA, 103 bp, Homo sapiens
gctcagcgtcagctcagcatctcatgtgcctggcatgtcattagctgctctgacacacacaataccccacggtttattatataaatccaagcctgaagagttg

SEQ ID NO: 588481 - DNA, 137 bp, Homo sapiens
agtaggccagagacaggaacttatatacagtagtcctgatagttcactggcccatataatagaattctgtatgaaggctatgtagctagcttagtaagccttgaatctactcacaatactaaggtactatatagacc

SEQ ID NO: 588482 - DNA, 1409 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagctcccccgtttcttctcccccagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcat

SEQ ID NO: 588483 - DNA, 892 bp, Homo sapiens
  misc_feature (6)..(6): n is a, c, g, or t
ccgccncgccgcgaagaataccacgagcgacgaagacagacaggagaccagaacagcccggctaggacccggtcgggccccccgtttcgtgtcctggataatggacccttcaagggggcagattcttccgggaccaaaccgtggttagccacccgcctttgtgtaccgcgccaaacgggtcctacacggccacaaaggtaatcttgtggtccaggcgcacgcccagtaacccagctggcgattccaagggccgcagaaccaagaattgcgtcttgaaaccgttgtaagcgcccgcgggggtatagccgtctcctgccgcccccgggcagccttgggcctaccgaagcggcacccccggcggcggacacttgcgaaagaagcagccttgttcctccaaaacgaggaaaacaggctccacgcaatatcggacaaacacccggccttttacaacacatggcgtggcacccccgcgcccacccggggccactgtacacccccctcatgccaaaacagggcgtctaggggcaaacccacactgggacctacatgggccaaacgagaacccaagaggggggatcagagaacggaccaggtgaaaaaaactccccacgtacgcgagtgggtcataaatctcccatctcgtagtcacggaacactggagaacgcacgggcgagtgaggcaacactcccttacagggcaccaaacttgcggagcgatgcccgcaaggagcccctccccccgataagggtccccgaggacgaccgaccctcaggagggacgggcgcaacaacgattttcttacaacgcggccgcagcgcaaaaaaacagttgccgggaaaaaccgggcgaaaacaatatgggccccaattagtctttacaccaacaaaaaca

SEQ ID NO: 588484 - DNA, 330 bp, Homo sapiens
tacctacctcatcatacctactcactatcagggtcttaaaattctttttactactaaaagagtactggccaggcacggtggctcacaactgtaatcccaacattttgggaggccgaggtgagaggatggcttgagcacaggagttcgagaccagccaggccaacacagtgagaccccatctctacaaaaaatttgttaaaaaaatagccaggcatggtggtgcacacatgtagtaccaactactcaggaagctgaggcaggagaaccacttgagtcagggcagtcaaagctgcagtgagtcatgatcacaggtaggtatgatgaaggacg

SEQ ID NO: 588485 - DNA, 2208 bp, Homo sapiens
aaaattgctagcgatcagtgctcgttgtatttcgtcacaggagaagtggtcgagaatagctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588486 - DNA, 104 bp, Homo sapiens
gcagggcctcaccgcttcgttctccgtccctcccgcgcctcgctcgactagccaagtgaggcggagggactcggacctttccctgcatttcgtttcggccagtg

SEQ ID NO: 588487 - DNA, 2319 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588488 - DNA, 303 bp, Homo sapiens
atgggctatactatgaacactaagtacaccaatattctcttagagaccctggtttcaattattttgggtataccttaggtcctccttatctggtgggggggatccaggactccccatggatggtgtgaaaccagggagagtatccaaccccggataggggtgttttttcctatattatgtttattccatggtaaaggtactttataaacttaggcagacgtaagagattaacaaaaaaataaaaataaaactataacaattatatggtaataaattatatttgatggtggtgaggctgctacg

SEQ ID NO: 588489 - DNA, 2286 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588490 - DNA, 2067 bp, Homo sapiens
cggacgcgtgggtcgacccacgcgtcggtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588491 - DNA, 2246 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttgggtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588492 - DNA, 2019 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588493 - DNA, 248 bp, Homo sapiens
gcagtccttattagcctaggcttgacatacttaaatagaacatttaaactaaaggcttactccctaatcttgggtggcttcctttaaaaaaaaaaaaaaagtatcttcattctagaaatttatttgggataaatccgataacatatatgtcctcaatctcttggggctcttccataacttacttccttttggtctgagcaatgtgaatggaagtctctttagtaccacttctaccatagatggttacg

SEQ ID NO: 588494 - DNA, 1139 bp, Homo sapiens
  misc_feature (1)..(1): n is a, c, g, or t
  misc_feature (219)..(219): n is a, c, g, or t
  misc_feature (586)..(586): n is a, c, g, or t
  misc_feature (816)..(816): n is a, c, g, or t
  misc_feature (897)..(897): n is a, c, g, or t
  misc_feature (1012)..(1012): n is a, c, g, or t
nagcagctcccatttttgatgggacaccacctgggaagacgcggccactcaagggccggggcaatagcaaccatatttaatttcataagagccggagagggaaagcaagcttgatactatgtcagcaatcttcaatcatagacacgtgccaatagaagacagtatatagttgatctcatctacgagaccaggtgtaaaaagcaagagagacaagagtgngagacgcgagcttttgctcttaatggggagagtaagaagaaattagcattcgttcatgatgacgttgtgcacatatactataagttgagcgcgaggtgtacaatatacagagataggtaatgaagcagatagtcataatagtaaaacttgtacacaccttatcaagaaggatactattaacccatactatgtctgtctagatgtacagggtacgtgagcaggggaggggagagcggagggagtgagcggcggaagggatgagagcagaggagctgaaagagaaagaatcgagggcgggatacgggggacaggtaggcacacaacaaagacgcgaccatatccgaagctgcctaccgtatataggctnattcgatatctctcacctgaagtagctcaaacacatcattagtagtacacagttcgtcaattgagaatgggatggttgtgaagtcaatgttgtagatgacggaggctagtggtagtgtataggcgcataatgaggtgcgaagaagtaaagacggtatacatacacatataagagaagaaacatcaaacacatatattatgatatcaagacgctgtgagtcagatcagccnagctcgcacgagcagtgtcggacgtgtgtataggtcgcaatgggtcgtcacactatatgtctactcacaccgaccgagaangacaactgatcgactctataccctacctcgaacttatcagagccatagatgtgtcgggcgacacggcggcgcgcgcgcgacacgatgctatagagcgcgatggatctaaataagnacatgcatgtaacctctgcgggtcgatcaaggggttagtgttagcggaagagtggagagaaggacgggtcagatgttaaggcaagtgtgtgcaagaaagacaccaggcgatataagtgcagtaggat

SEQ ID NO: 588495 - DNA, 691 bp, Homo sapiens
gcctcgtgccggagtttcaggctcactggtgcgtgtacaccctgcctggcccaggtcctcttccaaggccttctggtagagttctctgactaacctgctgtccccaggaaaggctgtcccaagccaagcctggaagtccccattggccatggtatccattttgaggggttaatggtcttccctcaggaggtgacactgccacctggagctgggtgcattctgcctggtgccctgctgaccccaactgcctttcccctctggaaggcagcgaacatctgagctcagggacgagccctgcttggggtcagacagacatgctgtcttcatccaggctgcacccaggccagatagaccagcaaaatctctgcccgcgactcctcgctgtctaccctggctcaggcgtctgccaggccactcgcaggagccaccgagaaggccctttcctccctgccgggggtacccccaaaataacctgttggatgccaagcagacaggacactgcgtgtggatgccaggccgcaggtcggaggctggaccgggggagccctgttaccgtgagctttgctcagtctggcccaaacaaacccctttgggacctaccggacataactttacgaatccggttgtgagaaatccatcaggggatccttggtgaagtcccggagctggcagtttctaaaatttcatcata

SEQ ID NO: 588496 - DNA, 180 bp, Homo sapiens
tgactcaccgagcttagtgactaggctggagtgaactggccgttcacagcagcctcaagagatcctgggctcaagagatccacttgcctcagctcctcgggtggttgggaccacaagtgtgtaccacacacccagctaattatctttttgtagagacacggtctcccatttgtatctcag

SEQ ID NO: 588497 - DNA, 444 bp, Homo sapiens
  misc_feature (3)..(3): n is a, c, g, or t
  misc_feature (26)..(26): n is a, c, g, or t
  misc_feature (39)..(39): n is a, c, g, or t
  misc_feature (49)..(49): n is a, c, g, or t
  misc_feature (76)..(76): n is a, c, g, or t
  misc_feature (126)..(126): n is a, c, g, or t
cantaaaaaaacttggccttgcaagncaatacagcccancgaatggcanaacctggaaactcaaaccctaggcaanctggccccttgaagttccatggtcttattgcccttataacaagcctaaanccccggaaagtatttattgaaaattatatactactttttctttttttttttttttgagatgaagtcttgcactatcacccgggctggggtgcggtggcatgatcctcagctcactgcagccctgggagttcgagaacagccttggcaaaagggtaaaaccctctctctacaaaaaaatacaaaaaattagcttggcatgtggcaagcacctgtatttccagctactccggaggccaaggctgcggtgagctgtgatcatgtgaatgcactgcagcctgagtcacagggtgagactctggcttaagaaaataaaaaaaa

SEQ ID NO: 588498 - DNA, 276 bp, Homo sapiens
ataataaagacagattgcttcttcgcttctcaaaaaaaaaaaaaaaaaaaaaagaaaaaaaaaaaagaaaaaaaaaaaaaaaaaaaaaaaaaaaaaaaaaaaaaaaaaaaaaaaaaaaaaaaaaaaaaaaaaaaaaaaaaaaaaagggccgcctgggcccaggcgactcaagacccgggaaagctaaggcaggcggccgaaattggggccaactgggccaaatcgcccaaaaggggggcggataacaattaacgggccggggtttaaaaaaggggg

SEQ ID NO: 588499 - DNA, 305 bp, Homo sapiens
  misc_feature (246)..(246): n is a, c, g, or t
tattatataacttttgttagaagtactcaaaacaaactgtaaagtagtttcagggtctactaccctgaccctgggtgggtggttaggaatcaacctttaatccatttacaatttgctaaaagtaaaaaagataagctgggtatggcaacatacgcctgtagtcacagctattcaggaggctgaggcaggaggattgcttgagcccaggagttcaaggatatagcgtgctatgatcatacttatgancagccactggactccagaatgggcaacataggaaagactccatcttcaaacaacaaaag

SEQ ID NO: 588500 - DNA, 280 bp, Homo sapiens
ttcagcatgtagttaccacgaaatacaatgatcatagtttgccataccagatagcatcgtctctgtacctgacagacgatacttcatggttactcttgcttcattatctgcggcacatgagatatacgctggacgaccaacgaatactgatggtgctacgctccaaatacagttttcataatcaatggggagtcctgtcttgggactaatcggctttggcatttgattaccgtgcatgatttggccccaattggcagctagattttcacgaaggccgatt

SEQ ID NO: 588501 - DNA, 389 bp, Homo sapiens
ttctcggcgtgtctagaggatccctgcggcgaaaaaccgtattcggtttcaaacaagtgaagaaacgctgcatctggctaggaactatctgtcgatatggctttgctgctgatggggtgtgctgggaggcagtccagagcagggcgggtgcggggtgggggcgtccgctggctgggtgctccaggggtgctcggaggagcagcttctgtttctagcccctgtgaacgtgtccacacctcacagctaaggcagtgggagaccttgaattggaccccagaggactgtctgcctgtcctgcctcacaaatgaagatgaaatttgtttctttttgaaagtgatatttattacgataattttttttaataattaaggggggtcttgcggccgag

SEQ ID NO: 588502 - DNA, 227 bp, Homo sapiens
gtggattcaaggctcctgtccccagaccatttcccaattcctggcaaaagccaaagatccaggttaagagagaccctctgtatcccaggtccttccagaactgactctaagtcttcagccagggctcttagatgcaaggtttggccttaggggattaacctttcttaagggccttggcttaactaatatctagcattctggccaggcctataactgctttgcttctg

SEQ ID NO: 588503 - DNA, 447 bp, Homo sapiens
  misc_feature (7)..(7): n is a, c, g, or t
  misc_feature (10)..(10): n is a, c, g, or t
  misc_feature (17)..(17): n is a, c, g, or t
  misc_feature (21)..(21): n is a, c, g, or t
  misc_feature (349)..(349): n is a, c, g, or t
  misc_feature (352)..(352): n is a, c, g, or t
  misc_feature (386)..(386): n is a, c, g, or t
  misc_feature (421)..(421): n is a, c, g, or t
  misc_feature (433)..(433): n is a, c, g, or t
ttttcgngtngccaccngtgngcgtacgatctgggcgctgacgttcgtcagaaagttgacctgagtaccttcagcgatgaagaagttatgcgtctggctgaaaacctgcgcaaaggtatgccaatcgcaacgccggtgttcgacggtgcgaaagaagcagaaattaaagagctgctgaaacttggcgacctgccgacttccggtcagatccgcctgtacgatggtcgcactggtgaacagttcgagcgtccggtaaccgttggttacatgtacatgctgaaactgaaccacctggtcgacgacaagatgcacgcgcgttccaccggttcttacagcctggttactcagnagncgctgggtgggtaaggcacaagttcggggtcagngtttcggggagatggaagtgtgggcgcttggaagnatacggggcagnatacaaccctgcag

SEQ ID NO: 588504 - DNA, 226 bp, Homo sapiens
ctagttcctagaagtttcaatagcgctaataggtaatgatggtaatctgaaacctgtggctcaaaggaactgcagattgtgttggaaatttggctagcttcttctgaaaccctgcatccttgtcctttcctctatacacaagagtttgtttcttggtgttctatcctctcattgctctatgtctgtctttatgtcattaccatgctattgaaacttctaaaactag

SEQ ID NO: 588505 - DNA, 326 bp, Homo sapiens
agtgagtgcagctccaggataccaatcatgatgataacgggcaaacagtcccttaccataacaccttataaatccaagtctcttgaggaccagagaagcactgctagctttctcttgattcaacaaagataccacagaatcagcagggtgagaaacatttgcatcaaaagcactccagctaatgtgacctgctagaaatgttacaaccagctgctctggctttgaacattcactggggggcttaggaaccactaatttgtacagtgcttcaacagtacgttcaaagcaggcaaacttcatcatggtgtatggtatctagtactcat

SEQ ID NO: 588506 - DNA, 968 bp, Homo sapiens
tatttggccgccacaaatggtataacaaaatctcccccctgcaacgcaattgtaaagttccccagtgtccattgtatacttacaaatggggaacaaaactctcacaacgttttgtgaaacgcccctatttcaacaatatggttttcccgggaccaatagttattactagggttcacatccctggccaaaaatactcacactcaaccaccagttgtagcactcccccccctcttcatgttgttcaacccccaaaattctcctgtttcaccccaattgcccccttcaaatattgtagccacttattgatgtgcgccaccccccctctagttcttctgagtaactgttaaggtaccccctcgtgtcccctcctctccttctaagaaagatccccccccgcctcggggagcgatcccctccagggctaataccacattcctgtagccgtatgctctccccccccaccggagtttgttcttctcaaaacagaatagatgcccacctctagtttcccccgcccctcgtcaaagacttaaaaataatagcgtgacacactcaattaaggaggctctctcttatattaaaaaccagactcctacttctttgtaaataccacacactctcttgtaaaatggtgaaacctgtcaaagtcgtgccaaaatagttaactaacctagtgttatatcttcatgatacagaatgtcacaaagaaaagacaattctattgggttatacattttataaacaggtttggcattatcagctgtgaataaaagcacccagttaggtcccccccaacgtttaccaccttttatctaagtagtcccccgtgttgttaaacactatatacaatctagccatacatataaaaacatcaggtcacaacaactgtgaacacactttgttaaggaccaaaaacttttttttttgtccccgggcaaaaaaaaggggctttctttacaaacacaaca

SEQ ID NO: 588507 - DNA, 99 bp, Homo sapiens
gcttaaacagtgcagtcaaagtacaataataaagaagatcatgtccatgtcaacattattataaccctacattttgtgcataaagtgtaagtgtacaag

SEQ ID NO: 588508 - DNA, 423 bp, Homo sapiens
  misc_feature (46)..(46): n is a, c, g, or t
  misc_feature (102)..(102): n is a, c, g, or t
  misc_feature (117)..(117): n is a, c, g, or t
  misc_feature (157)..(157): n is a, c, g, or t
  misc_feature (193)..(193): n is a, c, g, or t
  misc_feature (327)..(328): n is a, c, g, or t
  misc_feature (415)..(415): n is a, c, g, or t
ttttggtgttttagttgttagagggttatggctgtgtgtgtttgtntgtttttttttgtgtttgtttagtggtgtgtggtctaactagtataataattcggncctcgagtgtgtctnagtacctggggggatacggggtggttctgtctgtcctagnccttctctttggaacactcctcttccaccacactgntctgggtctgggagcctcccaccgcgctgctgaagtcaattccttaagggagaatctgggcggtcgcagccgcgcaactggggatggacagggagtggggaccccagggcccccaatctggaagggccccctcnnagccattgtgggaacaataaatactgtgtgacggtggcagggagtggggggttcggccactgggtggggggcaagggggagctggcngggctagg

SEQ ID NO: 588509 - DNA, 349 bp, Homo sapiens
ccgattaatgcatgtagtatgcaataagcacatcatggagaatggggtatccactcccccaagcatttatcctttcaattacaaacaacccaattacactgtttaagttatttttaaatgtgcaattaagttattatttactatagtcaccatgtggtgctatcagatagtaggtcttattcattctttctgttttttgtacccattaaccatccccacctccctgccagcttacactaggcgcttcctatacatctgcaaactatccgttcttactctttgggtgtgcctgtagtttgaaatagcacagtcatggagaatggggtatcactcccccaagcatttatcg

SEQ ID NO: 588510 - DNA, 249 bp, Homo sapiens
acaagttagcttgagaaaacagatgctctagacacttaaggccaatggagcggagggcaggaagacgtagcagcagcttggcaaagcgtccctgctgctcagggtacttctgtgtgcagtaggtctccagcgatgcatacactttctcccgcaggacctccacctcactagggtaggagaggcccttggcatctggattaaacagaatgatagccctcaggcagccaagctctgtcttgtccatcctca

SEQ ID NO: 588511 - DNA, 440 bp, Homo sapiens
aaacccgaatgtttctgtagcttccttttccctgccccagaattgtttggtttttatcaaagaagcccctctgtccctccagccctgcccaattgtttcccatggtggaagggttcctgttatatggtccgggccccccccccgttttttttaaagtgttcaagggtccccccggtttttcccccctaggggggggggccaatggggggtgcatgggcttcctgggtttcccccccccgtttggcccaaaggttatgtttttggggtttggcccccccgtcccccctttttggggtttagggggatttgggccccccccccctccccccgtggttgcttttttttttcccgttttggccctaaagttttcccccctctgttaatttgtttttaaattttacccctgaatttgctttttttttttaaaaagtttttgggga

SEQ ID NO: 588512 - DNA, 426 bp, Homo sapiens
caatagacagaactcaaagtcatccctctgctcacctgagacaaatgtgtatctgattgctgcttctgccctattgtttatgcaaaaatgcagatccactgagccagactaaggcatcagtgtgactattcctttactccccactccatgtaaattgtgtattcagtgaaaggctgatcaaagaccccaaaaaatgcagccttttgtctcttatctacctatgacctggaagcccccacttcgagttgtcccgcctttccagactgaaccagtgtacaccttacacgtattgattgatgtctcatgtctccccaaaatgtataaaaccaagctgtgcaccgaccacctttagcatgtgttgtcagaacctcctgaggctgtatcatgtcatgagtgtgtgctcaaccttggcaaaataaactttct

SEQ ID NO: 588513 - DNA, 127 bp, Homo sapiens
aagggaaggggcaggggtttaatttttgggccccccccaaggggggaaaatgggaaaaattttttttaaagggaaaaggtaaagggggggttttaaaaaaaaaaaaaaaaaatttttttccggggga

SEQ ID NO: 588514 - DNA, 686 bp, Homo sapiens
gctccccggtccttgtggcataagataatgtttccctggttttcttggttaagcaagtatctcccggagactttggcagccaacgctgacaaagttgggatgtgcccctccagttgttcgaggcaagtttcctccagatcaaggctttctttattggtcttcacatctcgttaggatgacttcgtagccatcacggagctgatgcatctcgtgggtgctggtttccaagtctgcgatgctgacccgagctgcccacatgccggcagcgcgtggaggcagcagtgggtatggacctcttccagaaggcccatgaggtcactctgaagtccaagtccttatcacgtgcagactccggcataaagcagaatgtgatgccatgggtgctgcccatgatccggtgaggtgagaatcttcacccttgcgccgtcctcagcagtccggaaagctttttcatttataatggcccatgggatccaggcccataaagcaggaatggcttgcttaagacttggccaagtcccagagcacgtcgcctcagtaagccaccatccccggcctgtcttcctcagccgcctgaaagccccaatgagaatgatgcccacttaggcgttgtgtcctttaatcccagcatttccttttgattttggataataaccctgggctcagcctgagcctctgcttctaaa

SEQ ID NO: 588515 - DNA, 301 bp, Homo sapiens
tgctagcgggtctcttaccgtatcatgttgagaccacggtataaaacctacaagagtagaagtatatggtttacacaagtgatcccttcctaagagatgtactagaggatgagcttcattaagtcaagagatgactgggcagactttggcaaaaggtctgatggttactgtttatgtatttaacgaaatatataagactaaaacaacaatagggcaagtgtgggcataattatatgtaaatgttatattctaatcaaactagaaataatgcaattttttaaaatgcagagaagggggagag

SEQ ID NO: 588516 - DNA, 818 bp, Homo sapiens
tctaggtggtgctggtggtcaatcggccgaggcgggcggcgggcccctggtgtcctcaggcggctgtggcggcgtttggcggcggttgggccgaggcaggcggcctcactggccgaggtggctggacgcgtagcaggtggatgggagggagggagcctgcagggcgcacgcaacccatccctgccatgaaggccccccgcatcctgtgctggaaacatggcggacgcagtcatctccgtgcctctgtggtaaacgagcctgcgtgtgggacctgaggtgcccacgcaccatagtaggcatgcgcaccacgggagctcatcgaggcagagccaatgcgcgtgtatgaccaggttggcacccaggatgtatgaggacgttgtcctacgagagcacgctcaatggcgctggccgatgtggagtgtcacctacacagttcagaggaatatccttgacttacccccagcatgtttccccctccaatggacatccggacagccagcacagatggccgacaagaagctctctgagttcgacgtggagatgagcatgagggaggacgtgtaccagaggatcgtgtggctccagtgagaaagttcagaaggactcacttgaggcccgaggacatgcgcggtacctggagctggctaatcaagctgggccggagaaatgggcttcacatcccccagagagactcaggaacacatcaaacgcatcaagaagaagctgagccttctgtgcctcgattcacaagaacctgagaggcactgaacttctgcccttagctccagagctagagggtcccgaggaatatggactca

SEQ ID NO: 588517 - DNA, 266 bp, Homo sapiens
  misc_feature (207)..(207): n is a, c, g, or t
cagcctcttaaagccagcataggggaatggctttcatgctgggggagaggacacgatgagagatgcacctcccaatggacaccaacttgtggctcagcatggctcaaggtagcagatcagaattctcgtgcacgcctaccactcgactgcagttcttcctgccagtacccatgcactttgggacactactgagttctatagctccanactatggcaggcctcttgcagctatcatcctggaactttgtaactctgacgtccacgag

SEQ ID NO: 588518 - DNA, 188 bp, Homo sapiens
aggagttgggaagatgctgccctctgggaaccttagtgtgtgagcagggaagttggaaaggcaagactttctttctcatttgcagaatgcgggcactagtcacagctgatttgtagagtttcttggaggaactaatgaagtagttggtgcatgttaatggtacataaaaaggccgagcaaaggttaag

SEQ ID NO: 588519 - DNA, 243 bp, Homo sapiens
attccattcgctgatgtttccgttcaattccattcgatgatgattccattcgattccattcattgaggattccatttgattccattcaatgatgattccattctattccattcaatgattgcattcaattccattcaatgattatcccattagagtaaactcaacgattccattcaataccattcgatgatgattccttttgagtccattcaatgatttcattcaagtccatttgatgactcc

SEQ ID NO: 588520 - DNA, 295 bp, Homo sapiens
catctgcaggtccagtagtcattgaagtaaataatgggatagtagtcaccgctcacgggtcaaacttcacatatttgatccagtgaagggggcacactgcccttcacccacggcgtgtggtcgtccacaatgttaatggtaatataggggtgccaatgggagatcacctccacaggcccatagtcctcagccctcttgatcatttctgggtccgcttctgtctctcctgtttgcaggtccttggttttctgaaatcgtctgcgcttgtatttcgttgatcatccgggacatgtgg

SEQ ID NO: 588521 - DNA, 2108 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588522 - DNA, 225 bp, Homo sapiens
aaaaaattaaaagttggggggggatgccgcttttaaccgattttttccgccgattttttccaatggttttgatgaagggaaacgggccctggaccaatcctttttggggtcgggggggccagtttttaggcccccctggttttatgttgggtaaaggaaagttgaaatccatcctcctttttatttgggatgggaaaaggtcttaattaatttatttgttttcca

SEQ ID NO: 588523 - DNA, 2315 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588524 - DNA, 287 bp, Homo sapiens
tgctgagcacagagcagacccgtcgtcaaaaaaaaaagaaagggtactacttctgctccttctgaggactaggaatcaacataaataaaatgtagcaaaagtagtcacaaactataactattattattgctttttttttttttttttcttgaaaaattttcgcccttgtgccccaggtggaaacccaagggcccactcccggctccccaaacccctccgcccccggggttcaaccactttctcctgtgcctcaccccccctgtgttaagctaggattccgggctttt

SEQ ID NO: 588525 - DNA, 2011 bp, Homo sapiens
gttaagtagggaaacccagacacaaaagagttcatactgtggttgccatttatgtaatgttcaagtataggcaaaaccaagctgggttgctatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588526 - DNA, 601 bp, Homo sapiens
  misc_feature (1)..(1): n is a, c, g, or t
ngctgcaaattatcacatagtgtttctattgacaaatagtgctgagtactatacgaattcttatgtctaaaggtgattttggtaaggtttttgtcacacttaaagtgtatgaaaggtgatttcttcatgcagcttaagcacgttttaaaagggggattaaggtcaggctgtatatatacacagccacatgatgtataggaaaccatgctgtggtaatcagacttagaatgtgtcaaagtatgattgttaccagtgtccaggagtaatgttctatttttgcgcaaggatgtcaaataagtctcagtccagtacagaagtcatattcctgttctgttaataaagtaactgggtcattgatgttcaggtctttgtgtgcagatatgctcagtcaaatgatctatgaaatcattgatggtgttcaagaatgttgatggcagttagttttgtaggaccttgattgtagtttggagacattaagcattcaaaacgtaaggctgtagactcttgagacattcaggtattatcaaccaccgacactagacttatgtaggattgtcctacattctccctcgtgtaggtaggatataatgatagatcttgt

SEQ ID NO: 588527 - DNA, 1914 bp, Homo sapiens
agcaactgccattacaggcgtgagctactgcgcctggcccaatgttaaccagttttaagtgtacagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588528 - DNA, 2324 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588529 - DNA, 230 bp, Homo sapiens
  misc_feature (209)..(209): n is a, c, g, or t
  misc_feature (228)..(228): n is a, c, g, or t
tattacgagttttcattcttttgagcaaaaaagtcgaactttttctgttgaacaaaatattcacaacaagggcagttgtgatacgaatagaacaaaaaaaaaaaaaaaacacttaaacttgttaggactccgatgagtttggggacttcgggatcaaccccagcaccagcagctaccaaccaccattccatctctcacttggaacagcnttagttagtcctgtggggncc

SEQ ID NO: 588530 - DNA, 2037 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588531 - DNA, 868 bp, Homo sapiens
gagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgacccgcattggaaatatacattcagtaggtctgatccaacttcgtatgcagggtacattgaaagacgcgttaagaagtctctaaaacatatactttagaagaagccagaagaacctcaaagtctgtcctgatggagcactttggtgaacagaagggtccagtttatgttgcatgtcagtttcctatttcattacttcaagcatgcgagtggtatgaactgatcctgattttggtattctcaaggaaaccttgtatgctggtgacaatgaaccgaatacttggataaagcctgaaaggaggggcacggctagatgggtcccacgcactgaaggatatccccaatgtaggagttaatctcataaggatgacgactccgactttcccatattggcacaaaaccgctgtgggtttcacacgcccggttgcgcagaagaaggctcctaa

SEQ ID NO: 588532 - DNA, 880 bp, Homo sapiens
cagcagatttgtccgcctctggttcccataggttgaaggccccctccccagatgctgcttaattactcttgaggttccggaccccattagcgcctggcttttcagaaccctgttttggccacctccccaaggtggattcgaagttgagggattggttctgaaccccaattctctttagaccagttccttcgatttttccacctttcgtataggatcctcgtggctttccccttgtggaaaggatggccacaagacagctggtaatcgttctctcccctgccagttctttaccccgaatgtaaccttgcagggttaagcccccttccccgggggcccctccgtgtggctcccgggtggcctctgctccgtcagagtcttgcccttgtgtctttatctgctttgccttgcctagtgccccgtcctgcttcgtggcccgggcatctggcacgggctgggaggaccgcctcttcccgcgttcctctggaagcatcccctctgggcctcctctctggcccgttgtgccgggcgcttctcccggcctcgtggctgtggtcctggacacggtctccccacccctggtggggtcccttgtttcggggggtggagtcctctagctccctggccccctcttccttctccctttgttttctctggtttttgtcccgcgtatcttcctgtagcttcttgagaaaagaggtgctccggagatataacttgagcttgggttggtttgtactgtgagagtgggatcattttcccgtaagatttttgacggccttgcttatcttctagagctaaagttgttaccctgaagtttaacccttctgactcggtttctttgggacccgcctgagccacttagtggaacccgtctttacca

SEQ ID NO: 588533 - DNA, 1060 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctgtccctgggcccaggagccaatgtgaacttttttttttaccgggattataaaagaacaacaagatgaccttatttcttaactgtttcaaataaatgattaaagtattttcat

SEQ ID NO: 588534 - DNA, 889 bp, Homo sapiens
tggatattttacaaaagcaaatgaactgtgacaatccacaactcccacagatgtgaattcagaaatgcatctgaaactccggtatgcctgacaatctattctttaagtttcattaacaaagtggtcatccaatcctttcacttacaattccttgcaggaatgtattgtctagcaggctagtctagtagtcgattcaagcagagggttccaagtatctgtttctatctctcgttctactgtattaggtgaggaactgccactatttcttgtcagccaacagatacttgctctgagcacacgccaaatttacatcacaacagcataaacagaaaccctaactaacattacacatcctctgtggcactttgacttccctgaccataatcgattttcattaagctttcacaattagacaacaataacagcatgagattcgaccaggattattcgaccaccttgaaacgaaagaacaagccctactatagctacatgtttcactttgagagttattctagtactggtttaccttatcacgtttcctggcaaattttcacaatccactctatcaacggcgtgccctcactttctacaatcttgctgaacactacacatgtgtcattaatgaccctcacttaaacacatgaaccacaactccaatctccttgcacacaccagtcgacacacgctattacattcattggaacacgcttaaaattctatcccattcaacttgacccacactgaaatttcataattaagtatcgacgcacccattaatcaatggtacacgtgagaccattacctgccatcacgaaattcttgacatatcagaatcgagcacacctcacatgggttgacccaatggactctacaaaccgcgctcgtacct

SEQ ID NO: 588535 - DNA, 1679 bp, Homo sapiens
gcaccatcaccgagatgtacgggaacacgcgctcagtggtctcatcattggggtaggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588536 - DNA, 986 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgggggcctgtccctgggcccaggagccaatgtgaacttttttttttaccgggattataaaagaacaacaagatgaccttatttcttaactgtttcaaataaatgattaaagtattttcat

SEQ ID NO: 588537 - DNA, 1857 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgattggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588538 - DNA, 742 bp, Homo sapiens
ggtgaaaatggtatttcattgtagctatttaggattatctaagttatgagtgaagatgagcatctttacatgtgtttaaaagccatttgtatgttcttttctgtgatctttttcggtagaatcctttgctcatttttctattggattattcatctttttcttattcatagtggtaagagctctttatatattgaggaaatcggctcgtcgtacaccgtgggtgttataaatattcattccactttgtcctttaatttctcttctcctcggagaaagtctcatcctggttgcccagcctgggcgtgcagtgggcccgatctgggccaggttcaagcgatcctggtgcctcatcctcccgaggaactggggattacaggcgcgtatcaccacactcagctaatctttggcatttcttcacgtagcagacagggtttggccatgtgggccaggctggtcttgaactccttgatctcgggtgatccaccttgcctcgacctcccaaagtgctgggattacagccaagagccacctcaccgtggccatggtcctttaaatttggaccttggcatttcacactacagtttcaaaacatattggaactcactaatatgcaactttcacgcctcggaattgtggcatgacttctaaaagcactcttcaccaatcctgggcatctctttcaacccattctcccaggctccccctctagtactgtaaggtctgtaacgcgctcaaatctact

SEQ ID NO: 588539 - DNA, 149 bp, Homo sapiens
tacatgatacgaccgagtgaacccacgatatcggtccctagccgttaattctactatcaacattactaactaagtggctcctttttcctcttgcttatagactcacttccttcctcatcttcttcttcttcctctatgaccgaatatcg

SEQ ID NO: 588540 - DNA, 280 bp, Homo sapiens
gtcacgcccacaatgctggggactgtcagagaggtagaagagagtagcaagggtagaaagtctaggccagagggctaggcgcggtggctcacacctgtaatcccggcactttgggaggccaaggcgggcagatcacgaggccaggagatcgagaccatcttggctagcacggtgaaaccccgcctctactaaaaatacaaaaaaattagctggacatgatggcagacgcccatagtcccagctactcaggaggctgaggcaggagaatggcgtgaaccca

SEQ ID NO: 588541 - DNA, 1585 bp, Homo sapiens
  misc_feature (628)..(628): n is a, c, g, or t
  misc_feature (1585)..(1585): n is a, c, g, or t
ggccgcctggatgcgacgcagagggtccaccttctacaccccggaaaaacccctcaaggcgatagcccctgaccccactgccgtgctctctcggagaaggaggagaactatgcttgtatcaggcatctatccatcatgatcactcacgctgccaaggcggagcatggcaacgtccctagcggctcagatgccgtcctctctcctctccatgcggcgggcacatgaagcttccttgtgatgttgtcgtgctgaggaggttcagggatggggcgtgtcgacagtggacgtgacgcgaacaggtgctcctcgtgcccccccacaatagcgaacaactttttgactggcagcaatcgttttgaagacacctccaaaaccaaggacacttcacatatagctcggcttcgaggtcatacgacataggccttcgaggggcaaaggctcactagtattgggcagttggctcctttgcgaaacttccatgtagacttttgcgtcgagtgggagttaccacgaagttatcaaactttggaaaaatgccctaccgggcaccaagggatttcttcaattttacttgcaattgcggttccacccagtcaagtcaatttcgtctctcgccttgcggcgaaanacttatgagaccaaaggaggggtcagataggaagtgttcgcttacaaaaaagcttgcgtttgggagaagagctagaaggagcgtgacccgaactatgaggaaccccaacggtggcaccctatattaattcgatccccaccacggggctccaaccaatggggtttccccaggtcgtgtgaaaggcgttttggatgggggcgaccggatcacggctgtgcgggcggggactttccacccaaaggaggcaagacctccaaagtcccttctagaattgtgtaaatatagcgacctttgcgagcaccggtgcggtttttgctccacattaaatcccttttgggttgtgtgatggaaccaatcttcgaacttccaaaagggtatagatcacaaacgctcgttacccattacagacgccgacgctaacggggggctctttagaaaggtgagctctcaaaggggagcgcaatcccaacttccgttgcacaggacaggcgctctacattagaccgccttgaaagaattgaaccaagtggttcacttaaatcctcttggtatcctttcaccctaacgttaaactgaaaccggggaacaggggttgggcggtttgcgagccaacccctgtggagagacaggattttaaaacagaacattaagtgttgccttcccccaaagtttccccaagcgttaggccaaggacgacaccccgcgcagagttccccccttgaaagtaacctggaacgggggggtatctaacagaggtagcctttgtagaaaattgggacctcttacaagtgctccctggtgtccacaaagccccgttgcgccattttaccccacacggtggtatggactcgcaagcatactctgggtacgtgtgaactcggtacaatagcagtcttgctggtggagaactcacaacggtcttttcaattctcccgctcttcctttggaataattcgn

SEQ ID NO: 588542 - DNA, 290 bp, Homo sapiens
gaacaaagccgggtgtcagacactttggctgtcatgaagactggctttactttgagggcaactgagaaaccactggaggattttgagcaaaggagtatgtgatctgattattgttacatagaatcacactggctgtctatattgagactagatgaaagagaatttggggcacgagcaaagcaaaactggagactagttaggaggctatgcagttaccagatgagaatcatggtggcctgtctcaaggtggtagcagccaaagcggtggaggcattcagattctggctgta

SEQ ID NO: 588543 - DNA, 765 bp, Homo sapiens
tatgtccaaattgcattttttgttcttaaagttgtcgggttggttttagttaaacaaactggctctcatttttctattaaagcaattcaacaagaaattggggcttgtggcaaacccaaaaatttggttccaagctcctcacaaaatttcctaatgaaaattaaagctcgagaacttttgccttaaaaaatcatagggggacattttttccaggcgggcttttttccatcacattccccgtccttttcctttaaactgccggtgtttgcaaagggaaggcaaattaattttattttcatgagcttattataattttgatggaaaaactgaaatctttttaaaatcacattgtcaaactaaaatggctttttctccattactcgcttactcccttccaataaaacacttgattccaagtaaactgaaagtgggacaatttccaaatactcagatggaggacgttcatcgaaggcattcctaaatggttgccaaattttgacaaaccgagcacaggcagtggttttaaaatacttggcaaggtgaaaaacaatgattcccattagctacagttatcattattgagcctgggaaaactctggctaatatttttccataaacattttcccatcccaaatgattaacaccccccagcggtttgcttaaagagacctttccacaaccggtttctaatgatccaattttttttgaaccttaaaacttgcaacggacttaaaaccactttggatttcttcgaggttgattgat

SEQ ID NO: 588544 - DNA, 198 bp, Homo sapiens
tatgaggctagcgcaggagaattgctagaacccttgaggtggaggttgcagtgagccaagatcgtgccactgcactccagcctggcgacagagtaagactccatgtcaaaaaaaaaggcaaaaaaaaacccaaccaatacaaaaacccccaaaaaaacaaattattcaagcttgacccacatagccatgctcatcagg

SEQ ID NO: 588545 - DNA, 920 bp, Homo sapiens
  misc_feature (156)..(156): n is a, c, g, or t
gtgtgtctttccctcctcgtggacttgtgtgccacgttgtacacttgtctgcctctacgcagtagtctccttccgctgtgtatctgctctgacgatgtgttctttcggtgtactactgtgttgttgcctctcgctgtcccggtccccggtggggancccttccgcccctgtgtgtttacccccccccgatttgggttcgcccctcccattgcggggttttcgcccgcccccgatgacctcggcgcccgcgtgtcttttggggaaggactgcccgcgcacattctcttcgttaaaccgctcctatattgccgcattctttcccttgggctggtgccgggcaaatatcccccggtttttgctcccctccgcccccgggggtctgcgcccaaatttccgccgcggttatgccaccacacgccccacacaccacgcgtccgtgtttacttccccggcgatcgaacattacaggggcgctccttcccgacacccgcctgggcgcctccttacaaggtgtgtgaccctctcccccaggtggcgtctcgcccccaatcatgcacgacggcgtctgccccccccccaactatgttttagccgcccgtggttcgttccgcggcatccctctgtccccctggttgacaccgcgtcttgttgcccgcagtcctcggtactacctctccccgcgttccctttccacgtggcccaagacctctaactccctcgagacaccgtggctttctataccccccgtccccatcgccccccgcgtccttcggcgccaccacgagtgggctcctgcttacttccccgccggccccctcccgggtaggcggcggcctgcttaccccccgcggtcttcacccgtccaccccccccggggccctcttccctaaaaccccccccccttggcagcacacatgaca

SEQ ID NO: 588546 - DNA, 358 bp, Homo sapiens
atttgatcttaacacattatatgaatgtgtcaaaatatcacatgtaccccataaataggtacaattatgtatcaaccaaataaattaaaaataaaatacttctaaaaagtaatttgaggccgggtccggtgtcacgcctgtagtcccagccaggatgactatagttaataatttattgtatattttaaaatagctagaagatttggaatgttcccaacacaaagaaatggtaagtgcttgagttgatggatatcctaattatcctgatttgatcttaacacattatatgaatgtgtcaaaatatcacatgtaccccataaataggtacaattatgtatcaaccaaataaattaaaaat

SEQ ID NO: 588547 - DNA, 824 bp, Homo sapiens
  misc_feature (1)..(1): n is a, c, g, or t
nggcgggaccgcggttcctcatgggtcgtgggtgtaccgaccgcgccggtgcgtgtcgctgttgggccgacttgctccctaggtggtttgcctgtgcggcttgggggacgtctgtttcttggccccgcccctacggggcgggcgttcttctcataccccaggggtgccgccccccatgtgtgcctgccgggggccacccccctggcggagcactccaattgtctgtcccgcgcggtccccgcttggtcgctcgttggccgtatgttccacgccgcggggtgcatttgtaccagcttcttggtgtgtgcgcacacgcaccgagctttttttctggggcacatatcttcccgcgatgtgtacccaccggcggctgattgtcctggtgaccgttcctcactgtgaggtgactctgctccccaccactcgttggaacactcccctccattcattcgcactcgatgggcgctacgcttcacgcttcttgtttcgagccacgcccacgcaggactccatgatactcatagttctactggctagatgtcagagagcagaagctcccttcgctcctctttgtccggcgcctgacagtatctgcctccaattaagttggagaagaaccccccccgctcaccctcgcgggggagaaaaataataggaggacccccccccccgcgccgcacaccactctgatgagacccctagagaactaagaagatgtctcgtgccccacaaaagcggagcggggatcggacgccccgcccaagctcgaggtttccgccccacgccccctcaggaactacgacagactttcgccccacaaaaca

SEQ ID NO: 588548 - DNA, 1119 bp, Homo sapiens
  misc_feature (363)..(363): n is a, c, g, or t
  misc_feature (365)..(365): n is a, c, g, or t
  misc_feature (462)..(462): n is a, c, g, or t
  misc_feature (471)..(471): n is a, c, g, or t
  misc_feature (481)..(482): n is a, c, g, or t
  misc_feature (496)..(496): n is a, c, g, or t
  misc_feature (500)..(500): n is a, c, g, or t
  misc_feature (749)..(749): n is a, c, g, or t
tgtctaaaaatcttaagggataggtttcaggtgggttccctggggatggtatgtataaggttaaactctggctggccatcttggtttttatttatttttaccctttaattattggataaggtggattaattatggcttggattaaaactttggaaattacaattccaggttggtccttggcagagggtatgcaataaggtcccaccaacaaacatttggcaacagccatctcttaccccaattttccttccaccatctcccaacaatttattcatattggttccccatggtccatcaggtggataggggcaagaccaggttaccagcagaccagacggtcccttcctgcgtggttctcccctntncataggttggttcagcatcatagtgggccaacccaacaggcccagcagaggtggtctacatggttgggggttcatcatgtcacagagttcccatctntctcaacanataggggagnnacaccataggaccncagnagagtcttccccagacatgtcattaccacaggtatccttatgtccagacctgtccatatcacacatcagagccccacatcatggtcttcctttaaatcaggttacaaggtcttccaacacatcatatcgtcgtctcaatgttcaacacagttgtccatctcctcccttggaccacatccttctgggttccctttcaccgcaacacttcatcccttcaaattaagagttcctcattataggggtccagcnctgtccagtccttccccttttttatgttattatattgtatggagcaaagggagagtttcggcttccttggttaggcccaacgccgggaagtacccaacaggtgggagatcctccggcgacacctgggcactcctccgagccttcctgggggttccaacgtggactctcccgagtgcggcctcccccaaggtagcgctggggattaacagcgagggcctgcgcaaccaatggcccagggccacatacagagtataccacggacaacagtggggggttaccaggggattggcacagactggtcctgaaatcccggaacacaaatgaatccgcgcgcgcccaccctccacgcgggggcaacggcgaagcccgc

SEQ ID NO: 588549 - DNA, 413 bp, Homo sapiens
ctgtcctagagacctcatccccatttccagtctgatttatcagtgctaagtggctgaaaggtctggaataatatacatcaaaaagaagaggcacagctgttgatactcagttgcatgcatcaggttctatgagggtgggggaagtgttctgatgaagtaaaagagagtaagacaatgtaactggaacattttagctaaagttctttcagttcatctttgtctttggctccttgtttcaggatgcgtgtgaactctatgtaattgaaattcccctttttgtcaataggtgcttctctatacagctcatccacttcctcatctgtaaaccgatcccccatggttgtcatcagctctcttaggtgatcttcctgaatggtgcctgttgcttcttcatcaaagcaagtcaaggcgtt

SEQ ID NO: 588550 - DNA, 531 bp, Homo sapiens
  misc_feature (379)..(379): n is a, c, g, or t
gaggtgacaaaaaaaaaggtttcttctcggttcttgggattttttcttttctcttttggtttggggaactccagttatagacatatgttagagtttctcattccagggttcttagctctttcattcgttccatctctcgatttttttttctaaaaggtcacctttatgtctcttatgctcttttatggtctcaatcttagtttggtctcccgaagttctggagtctaatcctacttctaatccatccttccttcttttggagcttggggcttttagcctctctaccattggtgcggatcggggggtatccttttaagccgggtatgaggtaaattctttccggaggcggggggggggggaatggctttctggtttggtnaatatctcagttggggctaggggttccgggacaaaggggctgggtggtagagtactagtccatggtccctacagctcaagagaggctccggtcggccagctcaggatagtcagagaaggcatcctgtagtcccctctacactagtgggcttt

SEQ ID NO: 588551 - DNA, 586 bp, Homo sapiens
cgggaccccctcgagtcgaaggattacaagctgatactgtgtaagctggccacggaagagcctgtccatgaagagcacgaggatgatgactgccaggtcagcaacccaagcacaggagacctgttggatctgagctccttaagtggcatgggcgtgattcacggctgcttacagcgagaaggagttggtttacatgagcatctgtggggagaatgaaaactgccctcctggcgtgggggcctgtttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgtcgacttgtctccccttattcatcgcactggtggttatgaggcttatgattgaaagtgag

SEQ ID NO: 588552 - DNA, 469 bp, Homo sapiens
actaccgcatggcccaccataattattcccatactccttacactattcctcatcaccgaactaacaaatattaaacacaaactaccacctacctccctcaccaaagcccataaacatacaaaattataacaaaccctgagaaccaaaatgaacgtctgttcgcttcattcattgcccccgcaattctaggcctacccgtcacagtactgatcattctatctcacactctattgatccccaccaccagatatatgatcaacaatcgactatttactacccagcactgacccagtaaactaatctaaacccacatgatagcgcatacacaacactaacggacgaacctgatcttcttatactagtatccttaatcatttttattggcacaactaacctcctgggactcctgcctgactcatttacaccaaccacccaactatctatcctagctggcacacccctttacgcg

SEQ ID NO: 588553 - DNA, 149 bp, Homo sapiens
cataatcttagactgggaaaccacatgatctgctgaatctataaaggagaagtcttattggatttctctagtgtcacttcgggtctgttgcaaccaacgtccttccgaatcctatagagaagaagatgtccttgtgttggttcccacag

SEQ ID NO: 588554 - DNA, 882 bp, Homo sapiens
tatttctcatgggtcactgaggcttttaattttgagcaccaaaaccaccggggatctaccctgtggccaccccgtagattgacacgaggcatcacattgacctctagacacttgagtgagaaagtagaggctgagaaaaacaatgacttggggccaatctacactgacatgcaacacgctacaagctgccaacagggcctccaggaaacctctgagcattcttgataaaagttctaaggacacgcggtaccagaactccacgtggtggtgagtggcgctaactagacagaggacccctgagaagttgttaggtacggggaggcctcagagtcttgcctagagctagacaccgaagggcaagaaggttcctgagtgttaaacccaagcagagagttgtaacacgcagagaggcaatttaaccttgacaccaactagccatacacactagtgtgccccacagtggcgatatctctaacagactatctcacatagccgcgcaacaaaaaccttcaagaccccactgctgtgctttgactccccgacgagctattccctatactgtatccaaaaaattataccgtgaaagaagacaaagacgtagagaagatggagatcaacatgaggggacacacagaaagcagcgcgctcctcctaagatgaaatgcctgagtcctaaaatgatggtgggagtcacaccaccgaggtgctactttatatgcaaaacaccaataggagccccccttaaagtgtgttgccacacacaaacgggacgtccccaccacaaggacaacaacgcgcaagcggaataaaatgagaggagcaaacattgagacaaccggaggaaaaatatccactctttcacagtattatcttcccccccgc

SEQ ID NO: 588555 - DNA, 790 bp, Homo sapiens
ggccctaacacgccgtggtgtgtgtggcatggtcatgtctctcagtgatccctgaaaagttcgagcatatttggcgagtactcaatcatcgatacatcgaatggtgcggcggcacaatagcctttgccatcatggccattaagggtcgtgggccgaacgatatgctcatgtggatgttgcaggacaatgcaagaccattgaccttcgagcaagaacggcgctgggagaacgtcgacttgagcgatgaggtgtgaacgatgtgatcatcgatgtgatgctagtaatctcaccgcctaatagcaagatcccagatgtggttcttgacacagacccggacaggattgtatactggactgggaagaatttaccaggcgcaggttcgctaatgcgcagaaagggtcatggcatacataacatgcttcctgtggaacgaccacctggaaagtcagactcgatacgaacatgactctccggggtgccccactaggacgggacatggcggttcacgttttcgtagagggggccctatccggtggttttccggaagggacccaaggccacacgaggcccaaaagggaacccaacctgtggctccggcgccggtttgttggcccatgaaaacccaggtttgtggggttcgttaggttacgcaacaaggaaaaagaaaattaaacggttcacttgggttaagagggccgttgtggtactggaggacaaatgtcaacacgtaaacggtattaacttatttagccgctaactttgagagaacaaaaagaacgaaacaccagaa

SEQ ID NO: 588556 - DNA, 100 bp, Homo sapiens
ctgacttagaggatccccttccttagatcatccaatttattggatttatcgaaatgtttcattgtgggagcagacaatgtgggctcaagcagatgcagca

SEQ ID NO: 588557 - DNA, 443 bp, Homo sapiens
  misc_feature (119)..(119): n is a, c, g, or t
  misc_feature (126)..(126): n is a, c, g, or t
ctttttcttttgttcttaatacctaatacctaaaattccacttcagaaaatttagatttaaaatgcctaaatctattaccacatttactatcacccctaccagaatgcaggctctacgnaatcagnaatctttctttcttccagtcatggatttatcccacacactgagaatagtgccttgcacggagcaggccctcaggaggtaattgttgaattattgaccatcgcccatgcaatttcccctgtatcccactgctctccaactccttagacatctgccgatgtctcctctgcaaaggtctgccacctacctacctccaaatcatgtccacaaatacagcacattaggcaaggaagaaccgagagtactgcattttaaataaagcaatatttcatagataatgccagaatgtcttctgaatctcatcaaatcatttagtaaa

SEQ ID NO: 588558 - DNA, 135 bp, Homo sapiens
gcaggtccttagacttttaagctgtctcgtactgtctggcgagcacttaacgttgatttaactgttgaggtttagggctaagcgtagatggggtatctaatcccagcttgggtcttagctattcgtgtgttcaga

SEQ ID NO: 588559 - DNA, 276 bp, Homo sapiens
agagaggaagggccaggtttgcagcagctcaagtctcactcaggctgatgccccggagctgggggccttttgtaaccctttttcttttttccttttggaaaggccgtgacttttggccaccaaggtgggggggaaagggggcgacttgggccaatggaaaccccaacttcaacttcagggtccaagcgaatcctcgggcaaaaccctccggaggggtggaaataaagggcccccacaacaagcccaagtaatttttttaattttaagaagagacgg

SEQ ID NO: 588560 - DNA, 1003 bp, Homo sapiens
tgtgacatttgggctgatatgtggatgatgagagaaggagtcaggcaggcgtgccctggaggagatagcgatgcgcacagcagaagccctgcggacagagccagctgaacagcccatgtggtgccgagcaggggagaactgtgggaagtgaaatcgttccacggatgatatcaacagacgggagtactgaacttgaggatccagtaggatgtttgcagatcccttcttaggcctcaactgtgtttcctcggtttcccctgtgttgcaggatgctcgtcagaagttccgtatctgttctggttgaagacaacggtgaaactggatgaactggtgaagaagatcggcagaagctgtggaagactccaagccctacgtgggaggcacggagggatggccgaggtcaggcgtcacgctggaagtctcacgcaaagtcgcatcgcgaggaacttccagaggggacacagaggtgctccgagccggcataggagaccaatctctcctggcccgagtaggcgtggttgcgtggaggatgacatggacggtataggtgtcagactccgcctggagggagatgcctgcaagtcacgccactcagagggtcatcgacgcggagcagacaagaacagggagcgagctggtgcatcaggaagacggaggcaggtacaagtgcgcaaggggcgaatgggacggctggagaagaagactcagagagcatcacaaggtccaagcctacttgacccggcaagactatgtgcgggtcgagcacgtggcaccgacgggatgactgggggcaaatgacctggaaaggaggcacgtggccgaacctggatgtcagagaaccgacggggcccaggcagggcccgatggggtggagggcgcccaccctggtcgcggcacagcgggcctggccggagcgacacccgcatcggtagtcgcgcacgcggcacgaaccgcgacaccggggagcccaatcggcacacggcaggagagtgctgctcgcggg

SEQ ID NO: 588561 - DNA, 732 bp, Homo sapiens
  misc_feature (103)..(103): n is a, c, g, or t
  misc_feature (312)..(312): n is a, c, g, or t
  misc_feature (315)..(315): n is a, c, g, or t
  misc_feature (567)..(567): n is a, c, g, or t
  misc_feature (681)..(681): n is a, c, g, or t
aaaggaacttgcaattttaaagtatcctaaaatgaatttttcaaaagttttttgtaaggatactgtctaatggctttggagataattgagggatgctgagatnggctgctaggattggtcataaaaccagtactattaacatatccttacatatactggatatgaagaagttgtgagagaaaataattgcttaataagcatttcttcaattgtccctggaaatggaggttaataggttctggtaatgagcagtagaaggcgggaaagggttttgtaacacaagtttgggaaattctgctcttgagattcacnatnagcaagattaaaggttccagaaagttctaaatatatacctaactttaaccaggtagttcttaaacctttaattatgaaacctttctttacttcattcctttttagcatccggtgaaatagtgttctgtttctgtggtttgagaattttttgaccgtatatttcaggtgcctagaaagtgttagaagatacttgcgggtatttgaaatgatggctctatacttggcactctgccctttgcagagatgactaanataagagagttgccttcaagaaattgctgcctgatcagaggaaagaaaatgaatgcacatgcaacagcttcaggtgtacacagtccttgttcattgccatgtcatagaccacangtagaatgagtagttagagactggagagctcctgggtttgggtctgcgtct

SEQ ID NO: 588562 - DNA, 141 bp, Homo sapiens
tgacaaattggctccaggtaggagtctcagaaaataaacagaagaaaacaagccccctcccaaaagaagtatgacacacacattatgaagaaaccccaaggtttcatgcaatgggtaggcaacgatgtaagaagcccaccc

SEQ ID NO: 588563 - DNA, 1953 bp, Homo sapiens
cgctgaggagactgtacagtgtggagtcgggggggcgcagtcagggagggaggcagagtggcagaaacagggcccagccagaccccagctcctccacccacagcctggagagcttgggaaagtcagtgtcttctctccgcctgtacaagggagcgtaccagtgggccccatcccaggatgggcaggacctgtgggaaccttgtgtggaggagagaggctgtgggctggggtggagtgtgggactcaggtcctgggagaccctcctggggggctgccgagagcatccagctgtgggctgggagagcctgtgaccaggccgcgctgctccagaaagggccctcagaccacagcgtgggggtggggcttggatatgtagactcctgggcctccccttatccagagttggactcagaggagcccaggagtctggttttaactggcttcctgcagcagaaggcagcccaggcttgtcgctggggtcccgggtccctgtgggcttggtcctctctctgccccaccctgcctggggactgcagagctggctgggatgggcttcacctgacctctgcccctccccggtgaggggggtgagtacgaccggcctgccaccgtggcggctgtcctgttccatccccactgcctctgcgcccctgatcccggccgtgctgccgtttcagctcccccgtttcttctcccccagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588564 - DNA, 805 bp, Homo sapiens
  misc_feature (176)..(176): n is a, c, g, or t
  misc_feature (385)..(385): n is a, c, g, or t
  misc_feature (388)..(388): n is a, c, g, or t
  misc_feature (640)..(640): n is a, c, g, or t
  misc_feature (754)..(754): n is a, c, g, or t
aattgagacagagtgtcactcagtcacccaggctggggtacagcggcgtgttctcagcccactgcaaccttcacctcccaggtccaagcacttctcccccctcagcctcccaagtagccgggattacagacgtgtgctaccacacccagctaatttttatatttttagtagagatnggctgctaggattggtcataaaaccagtactattaacatatccttacatatactggatatgaagaagttgtgagagaaaataattgcttaataagcatttcttcaattgtccctggaaatggaggttaataggttctggtaatgagcagtagaaggcgggaaagggttttgtaacacaagtttgggaaattctgctcttgagattcacnatnagcaagattaaaggttccagaaagttctaaatatatacctaactttaaccaggtagttcttaaacctttaattatgaaacctttctttacttcattcctttttagcatccggtgaaatagtgttctgtttctgtggtttgagaattttttgaccgtatatttcaggtgcctagaaagtgttagaagatacttgcgggtatttgaaatgatggctctatacttggcactctgccctttgcagagatgactaanataagagagttgccttcaagaaattgctgcctgatcagaggaaagaaaatgaatgcacatgcaacagcttcaggtgtacacagtccttgttcattgccatgtcatagaccacangtagaatgagtagttagagactggagagctcctgggtttgggtctgcgtct

SEQ ID NO: 588565 - DNA, 509 bp, Homo sapiens
  misc_feature (21)..(21): n is a, c, g, or t
  misc_feature (130)..(130): n is a, c, g, or t
  misc_feature (138)..(138): n is a, c, g, or t
  misc_feature (160)..(160): n is a, c, g, or t
  misc_feature (169)..(169): n is a, c, g, or t
  misc_feature (178)..(178): n is a, c, g, or t
  misc_feature (207)..(207): n is a, c, g, or t
  misc_feature (308)..(308): n is a, c, g, or t
  misc_feature (336)..(336): n is a, c, g, or t
  misc_feature (347)..(347): n is a, c, g, or t
  misc_feature (395)..(395): n is a, c, g, or t
  misc_feature (400)..(400): n is a, c, g, or t
  misc_feature (408)..(408): n is a, c, g, or t
  misc_feature (500)..(500): n is a, c, g, or t
gtggtacatgcgagccttggncccgccgcaaaggggcggtcaaggggctggggggaaggtggtttgctctttccccctcctcctctctctttcctaccgggctttaagtccgtgggagagaaagtttttnatcagttngaactgataaggcctcgggggngtggggggngggtttggntgttcagtaatataaaatgtgtttaaggnaaaaaacagcccaggcttcccagcagttgcccatgtgttgggtggtttagcagcctgacctctacatctaggcaagggagtggggggggtggttgctgggnattggtgtaggtttatggggggggcggntaaggttttgncgtgggctgtggacacgtttacaaacattcatagccccttcccttagncctgntttgttgnaagggagctgctgagagtgagttacagctgggcacaaagtgtcttgtgagaccagctatagggtctaatgcagtgaagtcagtcatttaggncctattttc

SEQ ID NO: 588566 - DNA, 1612 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaaacctcaaaaaaaaaaaaaacaaaaaaaaacaaacaaaaaaaaaagaataaaaccaccacactacaaacaaccctaaaacaaaaaagggggggagggcgggggcccctaagagaagattatttcccccggagggaggcccacaaattgactttcaggtgtccacgcccagtgtttttttacttgcaaaaagaggtgggggccccacaaattagagggggagctgcttatataaacagagacaaggagcaggaggggcagttattaaaaaacacgcgcgtggtggtcggggagacaaactgcttaataagaggtgaggatcacttttgatggagagagaagacaccatcacatctgttggagggggagacagacaaaataatttgggagcaacaaactccatcactcaagagaaaagaaattaacacgtcccctgggaaacatactacaaaaatagttcacgaattatatacatggtggtacaacacaccagatataaaataattacgccgtctataaaaaatatatttgcgcaacaagagcaaatgtgttacagaaaacatatttaaacacggg

SEQ ID NO: 588567 - DNA, 295 bp, Homo sapiens
  misc_feature (41)..(42): n is a, c, g, or t
  misc_feature (72)..(72): n is a, c, g, or t
  misc_feature (107)..(107): n is a, c, g, or t
gaggactacaagcagctgggactacaggcgcctgccaccgnncccggctaatttctgtatttttcatagagncaaggtttcaccatcttggccaggctggtcttganctcctaacctcatgatccacccacctcggcctcccaaagggctgggattacaggtgtgagccaccgtgcctggccttttgaaactttaaattacaattgtgattctcccgtgtccacatggctggggaggcctcagaatcatggcaggaggcaaaaggcatttcttacttggtgggtcagaacataag

SEQ ID NO: 588568 - DNA, 1165 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcat

SEQ ID NO: 588569 - DNA, 233 bp, Homo sapiens
atgacatgatacgactcgagtcggtacctttacatctttgagcacatgtgtgagaatatctttaacctactccatttctaaaaatgtagtctaaagatattctcacacatgtgctcaagagttgaatgtcgcagggatatgcacagtaccaccatgtgtgggcagcaaagttatctatacaggagggctgactgaactacatttatgacacatccaatcaacggagatctaat

SEQ ID NO: 588570 - DNA, 1037 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaataccc

SEQ ID NO: 588571 - DNA, 344 bp, Homo sapiens
  misc_feature (325)..(325): n is a, c, g, or t
cgtacaatgggaaacccttggaagatcagacccagctccttacccttgtttgccagttgtaccaggggcaagaagcgggatgtttgcccttcctcaaccagctccctcaggagtgtttgtttcaagtaatggccggtgagctgcggaaagttcatggaaggcgagtgggaacccggctgcctgccttttttttttgatccagaccctgggcacctgttgtttaccaattggaaaattttatgcatcccatgaagcccaaatacacaaaattccaccccatgatcaagaatcctgttccattaagaacggttgttaaaggtaaaanttagtttaataagccctta

SEQ ID NO: 588572 - DNA, 898 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgattggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcat

SEQ ID NO: 588573 - DNA, 889 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtctacagactgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaataccc

SEQ ID NO: 588574 - DNA, 340 bp, Homo sapiens
  misc_feature (5)..(5): n is a, c, g, or t
  misc_feature (132)..(132): n is a, c, g, or t
  misc_feature (199)..(199): n is a, c, g, or t
  misc_feature (261)..(261): n is a, c, g, or t
  misc_feature (294)..(294): n is a, c, g, or t
ggagntgggggaagcgccgtggtggaatcgaggggtagggcattttagattgcccttcagacgcttttaggatgaggcggatctgcttgacgagggcccttggtttgatcccaaattgtataaggccgatgnatttgtgtgcgggcagtagtaatcttatgcccgcggtgatttcatgtcacatatgcaaagtaggcgnctgttttcttaggggcaggagtttcaagcttcgcttttgggcagaagaaacaaaagtaggcnccagtctgtgccatgttgatgggcagtttctgngattgtttgacaaggctttgataataaaacccttaaacttatgggc

SEQ ID NO: 588575 - DNA, 570 bp, Homo sapiens
gctgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagcttggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcat

SEQ ID NO: 588576 - DNA, 101 bp, Homo sapiens
gacacacacacaaagtgcatgacacacaacatcacgaaaacagcaagggagagaatccagcctaaaattaaataaatctttcagcctgcttcttccccagt

SEQ ID NO: 588577 - DNA, 220 bp, Homo sapiens
tggatctgacttaaacttgatccactgagttgcgcaccacgaacttcgaaagtgtgggttgctggagctagatgtcgtacctcagctcttccaaaggtggctcaagatcgtccgtgattggaagaaccctgtcgtcaatctccttcctcacttccacatcaatttcctttagttcttccacactggcaagattgctgttcaccatcctgtccttgagaag

SEQ ID NO: 588578 - DNA, 204 bp, Homo sapiens
tggcggctgtgttcactgcttggtctgtgggttgagactccaggcgcatccgtgcttcttttgcgcctttccggaaacatctcgccattcaaagtgtttctttcatcatcctcatgggtttatccatcacccatgctacgctcttggttagtgccttgaaccttctcattgtgagtagcagcggagactgctagacaactttgt

SEQ ID NO: 588579 - DNA, 181 bp, Homo sapiens
actttagttcagtacagcattaaaccacaatgggtataaatcttcatttagtaattaataatttcttcgcataacaatgtttagatatttggcaaccaaacacaaccatttttgggaaagccattcgcattccagtcccatcagcattctagtgcccaacaattcaacctaacgagtccag

SEQ ID NO: 588580 - DNA, 661 bp, Homo sapiens
taccctacccacgagcacagcagagctggattggctctaagtcctcatgcatgacaaggcgaatagtcagctacctctgtgactcgagatgaggtggagcccagcagcaggggaggtgttaatatcactctgatctattcagccctatcgctttttctttcaaagccgtggttgacgggaacactacacctatttcatcgctgaatagtgaccgatgctacaatgggtgatgagttgatcgacagcatccggagccacttggtcggacggtgaagagccttcgatcccacgcgaaagaacaaccgtggtggagatcatcttggcatagtccaagcgtcgagtcaggctaactgagaggctgaaggggcatgttcatccgcccaaattggggtccgtcctgggggtgctggattccgacatcattgtgcaaaagattcagccgtacacggaggcagagcaccgaaatggtattatctatgttcagaacgagcctccccaccagatcttcagaaggccattgaggtggcagcgatgctcaatgagtgagctgcggaagcagataggcagactaccttgatattcagagccgtggcaagtcaacactgtcaccctgtcagctgaactgttccgaccatggccactggtgactcgttcccaagac

SEQ ID NO: 588581 - DNA, 448 bp, Homo sapiens
  misc_feature (69)..(69): n is a, c, g, or t
  misc_feature (120)..(120): n is a, c, g, or t
  misc_feature (149)..(149): n is a, c, g, or t
  misc_feature (197)..(197): n is a, c, g, or t
  misc_feature (411)..(411): n is a, c, g, or t
  misc_feature (416)..(416): n is a, c, g, or t
agacctgcgggccatggaggaacgataccgccgctacgtggacaaggcgcgcacggtcattcagacccntggaacccaagcagaggccacccactgtggtgtccccagaattccataccnttgaggtcacagctctgggagcggaaccntgcggatacggcagatggagatggactatgagaagagtcggagaggcnaggaacaggaggaaaagctgcttatcagtgcctggtacagcatgggcatggcttggagcatcgggctggggaagagcacgctcctgcccatgcccagtccttcttggcacaacaaagactggccaccaatgctcgccgtggacccctggggcgccaggctctgagcctccgccccacttgacaagcactgacaagacctcgacttcctgctgcntgctnggagtcttccagtttacatttacccagctggg

SEQ ID NO: 588582 - DNA, 161 bp, Homo sapiens
ccaacttactgacgctggtctgtggagttcaccatgttggcctggctggtctcgaactcctgacctctggtgatccacctgtcttggcctcccaaagtgctgagattacaggagtgagccaccaaacctagctgaggctggtctgagttttaatgtggttg

SEQ ID NO: 588583 - DNA, 226 bp, Homo sapiens
aggtcactctagagtctcccccgtattacaactatctagcgaggggcttatgtatacttatgggcgtcgcttagtaaattgttactaggttgaacatagtttgtcggtgtatatattgtaattgagattgctcgggggaataggttctgtgattaggagtagggttaggatgagtgggaagaagaatgagaggaagtaaagtataattatgcctataagggttgag

SEQ ID NO: 588584 - DNA, 1216 bp, Homo sapiens
gacagcgattctcactccctggacatattctagaacaccaggaacagagacccaaactactacaccaaacccaacccataaaatggaagaagccgccagccaaagcttagaagaagattttgaaggacaggccacgcacacaggacccaaaggagtaataaatgattggagaaagtttaaattagaaagtgaagatggtgattcaattccacccagcaagaaggaaatcctcagacaaatgtcctctcctcagagcagagatgactcaaaagaaagaatgagcagaaagatgagcattcaagaatatgaactcattcatcaagacaaagaagatgagagttgccttcgcaaataccggaggcagtgcatgcaggatatgcatcagaagttgagttttgggcctaggtatgggtttgtgtatgagctggaaacaggggagcaattcctggaaaccatcgagaaggagcagaaggtcaccacaattgtggttaacatttacgaggatggtgtcaggggctgcgatgcactcaacagcagcttagcgtgccttgcagtagagtacccaatggtcaagttctgtaaaataaaagcttctaataccggagcgggggaccgcttttccacagacgtactccctacgttgctggtgtacaaaggtggggaactcataagcaattttattagtgtggctgaacaatttgctgaagaattttttgctgtggatgtggagtctttcctaaatgaatatggattactaccagaaagagagatacatgacctagagcagaccaacatggaagacgaggacattgaataagccttcaccatgtcagtatctcatgtctatcctttacacagtgaacactgatttttttttttggtagtatctatattcctttagcaaacactaaatatgggcctggctatttaaactcggggggggggacacactaaaattatgtacatagcactttttagtactaattactcaaattgagataatattttactgcaaggatattgtggtttttagcaaataactagtaagcagaggaggtgggtaatgtcaatgtttagatcattgtaaaaatccctttcaagttccgtgttagattttgctcctcatttttcccttggcatttttatttgggcttttcaaactgaatactgcttataaactggtttgtacaataaaaataaaatcctatgaagaaac

SEQ ID NO: 588585 - DNA, 148 bp, Homo sapiens
gtatggctcggtacccttatatgagacataatcaggtgtagaaaaatctgcctgtagggcacttccccctagccgaaattgaagtgcgtcgcggccagccgcccagagatccatggcaagcgccatcgtttctccgaccgtcaaccag

SEQ ID NO: 588586 - DNA, 441 bp, Homo sapiens
gatatgggtacggccggcgcgagattaaacctctccccggatttacaggcagcgagagtcacggacgcgcggaacgcgagctttcaagcagggccctctctcggggcgaaccattcagggcgcctggccttcacaagaaagagaactctcccggggctcccggcggcttctccgggatcggtcgcgttaccggactggacgcctcgcggcgcccatcttcggcactccggatagcggggatctgaacccgactacctttcgatcgggcgagggccacggagggcatcgcccggtcccttcggaacggcgctcgcccatctctcaggaacgactgacccatgttcaactgctgtacacatggaacccttctccacttcggccttcacagttctcgtttgaatatttgctactaacaccaagatccgcaaatggtacggcggg

SEQ ID NO: 588587 - DNA, 615 bp, Homo sapiens
cctttgttaccccctgggttcccagagctctcgatgtatactgtatccttcatgttttcaatatgctgtttgttttcttttctctttgggccgtgtctcggtgtccgtgggtaatggtgctcgtagctaggctcccaggaggcctccatgatgtcagtctggatccttgctgctgtcgcccgctggctagtccctgcagtacaccggtgagtgtgggatgatttcaggaggtcgccagcaccgggatctgcccgcccctctgcctctgggaaccagtccaaggggctgtcagttgtatttgccttttgtgttgttgttgttgtttttgttgtttatattgttactccttttaaggaattatgaagctaagaaaagttttgtgttttgggggttggatggacaaagttctagcatgatataaatatggtctaatcttattgatactattttatttttcttttaatgttgtactgtggagaaaactattttgagccatggggttaggtgtataaacaagaactttccacttttgcctaaatgtaacaaatagaaaggcatctaatactgcgtcttcagtatcctgataattttcttaaaagatctaacgtcctaggg

SEQ ID NO: 588588 - DNA, 436 bp, Homo sapiens
aggattactgtagcaccgaatgtacgacgacgtggtatgctttgtcatgcagatcaagtggcagttcaagctgcaagcgacgcaggaggattgggatcacatcacgaccatcgagcagatagtcgatttgatcgtccagcgttcgactcttcggtgaggccactgacgccatcgcaggcaagccagctcccacagttgaccgcgtcgctcgggcagtacgcgatccctgtgggaacgatcgctcagccagcatttttgccattggtgtccaactgccccaacggcacccgccgctctatggcgctggacagaataatcgaggtcttgctgaagccgaacttcgctacccgattaatcaggctctccaactcgggcatcgagcccaccgccgcttgcatgatcacgcaggggtcgccggtgacgcggtggcattcgg

SEQ ID NO: 588589 - DNA, 448 bp, Homo sapiens
gttactaaaaccaaggaaactggagctacagttaagggtggactactgtatcttatcaaacaaacttaaaagacatagtggataggaaaccaatatggcagttcttcaaaaaagcaaccatggaagtggcatatgattcaacaatggcttctctgggtacacacccaaaagaattgaaagtggagacttggggaggtgtttgtacatccatgctcatagaagtattactcacaatagccaaaagtggaagtcaccctagtgagcatggatggatgaatggataagcagaatgtgatctatccatacaatggaatatcattcagccttacaaaggaaggcaattctgtcccatgctacgacacggaggaaccttgaagacattacgttacgtgaaataatctagatgcaaaagaataaatatcgtatgagtccgtctatgaggaaaaaa

SEQ ID NO: 588590 - DNA, 135 bp, Homo sapiens
aatcagatcaagacccgagatgctctgtcctatgcgcctacagaattctccgatccgtccctaacgaactaggaggcgtccttgaatgtattactatacatactgatcctcggcaatactccccatcctccatac

SEQ ID NO: 588591 - DNA, 108 bp, Homo sapiens
gggagaagatgtgagctcagactccgcccctgactctgccccaggtcctgactcccaagcgaccccgtggaggggtgcgcagggggtgagcagtgctagagtacacgg

SEQ ID NO: 588592 - DNA, 417 bp, Homo sapiens
tcctagactgcacaaacattaagaaaattaggccaggtgtggtagtacgtacctgtggtcccagatatattccagaggctgaggatttggcttgagcccaggaggtcaagacctcaatgagcttgtgccactgcactccagcctgggcgatggagcaagacccagtcccaaaaaaaaaaaagaaaaaaaaaaaagggttttgggtttatctgggactctttaagttttgggtgagaaatagtaaagaggccctttggacacaaccttcctttaaaagagaatgatgattttataacctttaaccaccctgaaagctcaactcacttttggtccccctgaatgcttgaaagcagtgtatctgccaggtggctctccaagggactcttgcccagtttcagaatgccaaggggtgcagtt

SEQ ID NO: 588593 - DNA, 413 bp, Homo sapiens
  misc_feature (59)..(59): n is a, c, g, or t
  misc_feature (98)..(98): n is a, c, g, or t
  misc_feature (196)..(196): n is a, c, g, or t
ggaaaaattgtgaacttagaagagagatctttttaagtgggtgcccagcctgctttccnccaaagggtagaaacagggatttatattacatcacacgnggggtatgagaatggccacttccaacgaggctaactaaaataacaccttctttgttgtctctcttcctgtccaaggtgcgttctggggtaacacccancccatccggcagagtttgctggggaggaagacgtccagcgcttctttgcacagggccagcagttagcctcaactaccagctggcaggctgacccaggtgtcaatcagacgcggatgggtggttccgggcccagatcctcgcaccccattggccacccccactggaactctggcggtagcggtggtggcatgggaggaggtggagccaaggtcgacgc

SEQ ID NO: 588594 - DNA, 226 bp, Homo sapiens
tgggattccattaccggaaaggtcaaaaggtttatagtgttaacccaattcaattataaattcgcggggaaatttcacgagcgagcacttttctctccacaagagcgtggtcttcccaatctacaaattccttctttctctctcgcggtatagagaaatttattcaacgagacactatataagatgtggcctatatattataatataaacttataattctcttata

SEQ ID NO: 588595 - DNA, 195 bp, Homo sapiens
gtgctgaggtgatctagaggatctgagtgctactccacaaacagggtcaagtgattctcctgcctcagcctcctgagtagctgggattacaggcatacaccaccacacccagctagttttgtattattagtagacacgggggtttctccatgttggccaggctggtctcaaactcctgacctcgtgatacgcccg

SEQ ID NO: 588596 - DNA, 620 bp, Homo sapiens
acgctgcgcaccgtaccgaggcgcgggcgcttgcagaggctcccagtcccaagcctgagcctgagcccgcccctgtaggtcgcgcgccccaggctctggctggctctctgcgcctgtgggagccgtcatagatgggggaccaatatcgatgacaaggagctcaccaagagagaacatagggcataggaggtgccgggactctggatgatactcaaaagaagcgaggctgcgcctatgacagaagcacaagcatgtcacgtggaagacggtctgccggacaatacaatcacaagacatgtgtgcagggttatgacccaacagcaaagcccaggaggatcctggcccgggatgggcctaaccgcacgtcacgccaccggcctacacacccacagagtgggtccaaggtttagccggcagactctaacaggaggagcttcatccaatcacatgctgatggatcggtggcctatcctcatgacttccatggaccctacggatatccaaggacgggcaccgaaggaacgaccccatcttgggttgacaacactgatacctggggacatccgatgctgagcgagcccgtaggtatcaatccactggctgcttcatccatagctaca

SEQ ID NO: 588597 - DNA, 1860 bp, Homo sapiens
gggctggacgcgacccagagcctccgccacccgcttctgccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccaggcggcttgggcgtggtcggcggcaaggggagcttccagagcgacccccaagagccggagactccttcgcctgggatcggggacagcggcttgctgggtcgcgatcccgaggacgaggaggacgaggaagaagagaaggagatgcccagccccgccacaccctccagtcactgtgagcgccccgaaagcccctgtgctggtctccttgggggggacgggccacttgtggagcccctcgacatgcccgacattaccctgctgcaactggagggcgaggcctccctgtgaggggactccgtggggcactaccttcccgggctgtctttgggtttccgagtgcatgacgcgagggggactgaacggcgcggtgcggcatgcttcacttggacagctgctcttgtgggtcaggcagagagagactccctcgaggaaggatttgtagggtgaaggactttgggagcatcgagaattctttctgcccaactaagcgaattatagcgaactgcggaaaggtgaggctccgggagaggaagcgcccatctctggactcccatccatccctatcctgtcctttcccccttcccagacaacaggagaacccgtgaattgtgtaaataaaattctgctttttctattctgaaaaaggacttacctaggaccatggcaaataatctctaacaatttacctggaaattaaggaattgggggtattttgttctggcaacaggaaatttacccttctgctgaaatccaagatattcagtgctctgcagaagcctctccccctcacagatctctgcggctgctgattggtaaaggaagcttgaggagggaactgcagccctaggaatctgggtgaatggggttccaagggcccctgggctgggaggagctggctatgaatgtgcatgaagacataatagctcaacctctaggattttgcatgcagagcggatcctgccttgtcactgacttcatctgggattgcttttccactccctggggcttagagaacaaagagcccggttcacaggcagagactcgggggtgctcagcagcagcccagatttaggggacatttgagggactcttggggccgcagccaaaaactgtctctcctggctacacctgcttaacttcagttcctttttctgtcaatatgtccttgcccactgcctctcggtgttgccttcataatgtcttgtgtgtgttatgtgtgtctacttgtgtagtagtgtgtgagccctcaggggcagggcttgtggctctggtgttaggttcaggggcttcagacccttctacgagctccaagctatcaatggcgcttttctctccctcttcccccaaccagggcatggagcatgtggctgtcctgaggttcttttactgatgtgccgcccttccacctcctcaagtggtgactttgtgtgccctccccctcctttgtgtattccttctcaatgctttccttggtgttaaccttaataaaaaggcgtcatctccccttgaaaaaaaaaa

SEQ ID NO: 588598 - DNA, 121 bp, Homo sapiens
ggctggaccacatgatgctcacgctcgaactgatgagagccaggaagcggcacatctggaaggtcgtccggctcggcttttcgctgagcattcccttgatctcatcagttctgagcggtgg

SEQ ID NO: 588599 - DNA, 749 bp, Homo sapiens
  misc_feature (38)..(38): n is a, c, g, or t
  misc_feature (48)..(48): n is a, c, g, or t
  misc_feature (60)..(60): n is a, c, g, or t
  misc_feature (81)..(81): n is a, c, g, or t
  misc_feature (90)..(90): n is a, c, g, or t
  misc_feature (95)..(95): n is a, c, g, or t
  misc_feature (101)..(101): n is a, c, g, or t
  misc_feature (104)..(104): n is a, c, g, or t
  misc_feature (149)..(149): n is a, c, g, or t
  misc_feature (159)..(159): n is a, c, g, or t
  misc_feature (194)..(194): n is a, c, g, or t
  misc_feature (204)..(204): n is a, c, g, or t
  misc_feature (224)..(225): n is a, c, g, or t
  misc_feature (276)..(276): n is a, c, g, or t
  misc_feature (283)..(283): n is a, c, g, or t
  misc_feature (285)..(285): n is a, c, g, or t
  misc_feature (307)..(307): n is a, c, g, or t
  misc_feature (316)..(316): n is a, c, g, or t
  misc_feature (320)..(320): n is a, c, g, or t
  misc_feature (403)..(403): n is a, c, g, or t
  misc_feature (406)..(406): n is a, c, g, or t
  misc_feature (417)..(418): n is a, c, g, or t
  misc_feature (420)..(420): n is a, c, g, or t
  misc_feature (550)..(550): n is a, c, g, or t
  misc_feature (553)..(553): n is a, c, g, or t
  misc_feature (566)..(566): n is a, c, g, or t
  misc_feature (581)..(581): n is a, c, g, or t
  misc_feature (584)..(584): n is a, c, g, or t
  misc_feature (668)..(668): n is a, c, g, or t
  misc_feature (716)..(716): n is a, c, g, or t
gtgaacccgccagcagaggtgagcacgagcctgaaganataccagcanttcaccctgganaaagcctacctgcgcgagganttcttctgngcctncacccntgncgcggggacttcatgcgttccgcttcttccaacctctaagactgnagcggttctncttccgcagtgggaacatcgagcacccggaggacnagctcttcancacgtctgtggaggtgctgnncttcgacaaccctcagtcagacaaggaggccctgcaggagggccgcaccgncaccctncngtaccctccgagccccgacggntacctccanatcngctccttctacaagggagtggcagagggagaggtggacccaccttcggccctctggaagcactgcgcctctcgatccagacgnacncccctgtgtgnntnattctgagcgagatcttcctgaaaaaggccgactaagctgcgggcttctgagggtaccctgtggccagccctgaagcccacatttctgggggtgtcgtcactgccgtccccggagggccagatacggccncgnccaaagggttctncctggcgtcgggctnggnccggcctgggtcgccgtggcccggaggccctaggagctggtgctgccccgcccgcgggccgcggaggaggcaggcggccccaantgtgctgaggccggaacccttcccacccggcctgccccactcaccccnttttagaagagcttttacttgggcgcccgccgt

SEQ ID NO: 588600 - DNA, 375 bp, Homo sapiens
cgcggccgagccgcgggctcagggagtctggggtcggattgagcgcccttccccactgtgggcggccccttggtgggggggccttttccccccctgggggtggggttttcctgacaaatgcctttggccttccgggtggccttcgccccttcccttgcttgccatggaccctggccccaaattgttgcgggtcctgcgcgggccgaggcttcactaccaccccgggccgtgaactacgggtcggggtcaggtgcctccgcccggagaggggcggtcccgcgggccgcaccgcaggcgagggacggggtttcgagcccctgccctgctcagcgccgctcacagctggcagaagaggccacactgtgccctgcgtgg

SEQ ID NO: 588601 - DNA, 766 bp, Homo sapiens
  misc_feature (194)..(194): n is a, c, g, or t
  misc_feature (200)..(201): n is a, c, g, or t
  misc_feature (210)..(210): n is a, c, g, or t
  misc_feature (226)..(226): n is a, c, g, or t
  misc_feature (241)..(241): n is a, c, g, or t
  misc_feature (261)..(261): n is a, c, g, or t
gcccgctactcgaggaagatgacatttgcattttggacttgagcagtgtggagggtactgatgccattaataggaatcatgggaacatgggaatgagaaatgagctccaaaagaaaagatgcattctctttgggacatattgagttggctatctctaaaagatattcatgtgcagatgtctggcagactattanaaatgnnggtttgganctcaaggaaaaagttncaaaaaattggactnggttaagggatggctatttngaagttaaatctatgcttcagtataaatgaagacatattttttttttctataaccactatgaagttcccctccccctccaaattatagtattgtctttggagtgtttgatccacattggcagggactgggatatggagaaaggagtgaaaaaaggagtttgagactacaggaaaagtcattagcaattgcacttagaattgaaaatcatgacagaaagaccggtgcagtggctcatgcctataatcccagaactttgggagcctaaggcaggtgatcgcttgagcccaggagttcaagaccagcctaggcaacatggcaaaatcttgtctttactaaaaatacaaaaaattagccaggcatggttgtgcatgcctgtagtcccagctacttaggaggctgaggtaggagaatcacctgggcctgggaagtcaagcctgcagtgagctttgaatgtgccactggactccagcctgggtgatgggagtcggaccctgtcacaaaaaa

SEQ ID NO: 588602 - DNA, 133 bp, Homo sapiens
agctactatacaccctatacactctatacataggtatacaccagacagacgaaaaggtctgtgcagtaggagaaagagcacaaaagaggtctgggaacttctctgctgcaatgaaagatctgtcaggcaacac

SEQ ID NO: 588603 - DNA, 1035 bp, Homo sapiens
  misc_feature (554)..(554): n is a, c, g, or t
agcgggggtgttggaggtggcggagagccaaggagggaggcgggagcccatcagaggaaaaatccggagagcgtcgtggaaccactgtggtccaagcgtcagtgcacggttcatctccgtatagaggcctgcgctgcgcccaggtgttaacagtccttgttcaatcactgtaaatctggatacgactcagaatgaacaccctagactatacatagcgttcattgcactcttactcgcacggtgcgggcagcgaactagtctggtagcggcagaagatagcgatagggtacgtggcggcgcatcggcgatggattatggtgtcacaacctgtagtggtatcgcagaatgaggtggctacccctactcttgggctcatctgtctcgagagagtgggcctcatgtcgagacttgggcgtgtctgagaggatactctcgacccctgtctcacaagtggccttcaaggagttaagtgagggcgggacagatttgaaccaccgggtaaacgatatatatactggtcagatcgtgaggtctatacatttcagagtatagancaatcaattggaacctatttgaagtgaggggaaaatttactaaaggaacttgtgactagggatgtttatgactagagttatcccgtgaaacataggattggcgcgtgtggtaccgcatagtatggggtatactttcaagtagggagattcgcacccacaggtcaaatcagagagagtcttcgtatgggacgaaacaaacaaagtcagggttgcgaacagttgaagaaaacgctaggtatttctcgagccaaattggtctttcaggctgcggacccccaaaatggcgggggcctcgcggatgattcccagagcaggaaaaaattccttgagatgtccctggaacgagtacgccgagtgggggtacacccatggagtggaaatacggctaattgggggataatagacctacatggtacgctgaatgggctgtggataacgaagcgtgaaaaccaaatagtgaaattcaagacgctatgaaagt

SEQ ID NO: 588604 - DNA, 436 bp, Homo sapiens
  misc_feature (42)..(42): n is a, c, g, or t
cctgctttgaggatccctctactcgcgagtgctgccagtgcntgatgtgtgtgggaagcctgagctccaccgtgccccgactcggggcccacatgaggtagagggcacaggatttatcggggacagaggccaggaggcagcacttgggggcctttggatgggcctgaagagaggcagtggaggaggcaggcgtgtggagattgaggggccagtgccacctcctgaggagggagctgcgggggccacgatgtcaggtgggccgggcgatgttctcaggtgtggatgagtggtggaggtggccgtgggaaacccacagaggacgttcagaggcttctgcagacacaggtgtttgggctcaggagtggtcgaggggtcagctggcatggtaatctgaggggcgggcatgtgtggggtgaggagagggctcccacactgt

SEQ ID NO: 588605 - DNA, 805 bp, Homo sapiens
  misc_feature (285)..(285): n is a, c, g, or t
  misc_feature (336)..(336): n is a, c, g, or t
  misc_feature (338)..(338): n is a, c, g, or t
agagtgcccgcccacagttccgacgaaaaatggcggggtctcctgagttggtggtccttgaccctccatgggacaaggagctcgcggtggcacagagagccaggccttggtctccgccactccccgagaagactttcgggtgcgctgcacctcgaagcgggctgtgaccgaaatgctacaactgtgcggccgcttcgtgcaaaagctcggggacgctctgccgtgaggagattcgggagcccgctctgcgagatgcgcagtggactttttgaatcagctgtgcangagaatatcagcattaatgggcaagcatggaggaagcttcagataattgtntnatggagttcgtgacagtcaaagtacttgaagatcagtttgagtgaatagtcatagtagatatagccacaaatacgttagcagtatcccatgaaagatcctggaatgtgtcttcaattagcataataaggaaaactacgaaattcttgaacgcagtgacctagccctgtgtgtgacttcccacttggaccttaacaatagtgaccctgatgccaagtccctcatatggtaacgatttgaaattgccagaggggaaagcagtaagcaaaggaggatcagtgaaaggccatgaatgtccttgcctagatttacttgaaccaggagaagggattctcccagagtgctcaggatgctgcctggttgtccaggctccagaggattcacctaggaacgtttttccagttgtcctaggaaaccagatgctaagactggtgaactttgtaaccagattgaaaccgagcaaggagga

SEQ ID NO: 588606 - DNA, 433 bp, Homo sapiens
gggcgccgagcactgtacggttacacggttactgttagtcaaccgacttcacaaccttaccctttataaacaacacaaagaaaggcgtcataaacaacagtactattttgtttacaagttctcaacactgcagtgatcgaggctccatactatgtttcctatagctttatgtctaatatggaatctactcattataaatatctgggatataaaaagccctggaatattcattgtaagtaccaataccagggtcagcctacgttgctgaaaatcccaaaatatactcttatatttctgtatgccatccgtatctcagacattttcaaaaacctcacagggaattctaacatactttttcttgaagagatttggattcccgttcttgaacaatattcagttcggtcctaactgcatgacgatctcgtacgtgtca

SEQ ID NO: 588607 - DNA, 151 bp, Homo sapiens
attggtgttgcgcctacgcatagtgttcgcgtttggattagtgggctattttctgctcgggggtggcagcggatgagtaagacggccccagcccctagtctcagccgctactccactcaagcactatagttgtagcaggactcttcttact

SEQ ID NO: 588608 - DNA, 281 bp, Homo sapiens
caaagggtctgaggacaggttggcattttgtcttcctcagcagggctggcggctgcgggggtgacagtggcggtggggcctcctcggaatcctcctcctcctcctctacttcagcctcttcttcctcctcctcctcctcctcctcctcctctgtgggcgaagcgggcactggcggctgctcctccttgggctccgtcaagtcaggggcagcaggtgctggcacggtcggtgggcagtgcctcggaacggtacttgtccctaatggcggaccagacgcggac

SEQ ID NO: 588609 - DNA, 192 bp, Homo sapiens
agtagtgtctgagtactaggagacgaaggccacagcgggatagcggccaagataagccagatccccgggcagtgcaaaggacatagaatttcagcagtaagtgtccaagtcccaggtcaaacttgattctgtcacagcatcgcagcttccatccaaaggccctcaagctcctgcaggctatgcgaacgtggc

SEQ ID NO: 588610 - DNA, 356 bp, Homo sapiens
tggtccccacctcgctgagctcagcctcactcccactcgtaaaaatgtaagatcccaccagaccatgtgatatggtttggctgtgtccccaccaaaatctcattgtgaattcacatgtgttgtgggaggcacccagcgggaggtaattgaatcataggggctggtctttcctgtgctgttgtcatgatagtgaataagtctcacaggatgtgatgatttttaaaaggagagtttccctgcacaagttcccttctcttgtctgccaccatgtgagatgtgcctttcaccttccaccatgattgtgaggcctccctagccacatggaactgtatgtccaataaacctcttccttttgt

SEQ ID NO: 588611 - DNA, 1786 bp, Homo sapiens
  misc_feature (228)..(228): n is a, c, g, or t
  misc_feature (468)..(468): n is a, c, g, or t
  misc_feature (1437)..(1437): n is a, c, g, or t
  misc_feature (1447)..(1447): n is a, c, g, or t
taaaaggccgggttggtgaaccaaattttcttttttcccccttctcagggggaaatatgattatctccttcgagggtccccgagctataggggcaagaggggagtaagagtggtggtagaacaagagggggagggcacaagaagaagagagttaacaccactcttagacacgaggtggaaaaagacgccgatggggtggtggtggttcctgtggagaacacccacacnacacacactgtgggcgaggtgtatataagactttttctctccgcgagggggtgtgcactctacaagagaaagagaaaacaccgagtgtgttttgtggggagagaatttaaagagtggtgggtgtggaggtggtgcctataaatttacaccatctccccatatttttttatatcatatatatatctccacacacacatcacacctctgagagggggtttataaaagaaagtctcagagggngtctcacccttcgtggggcgggagaagcgggtgtgtgagtatcacactatgttgtggcggtctctttttagagacaaggagctataagagctccgggggagatcacggcgggcgtgagaattatacgagggtctccgagggaacaactctcgcgtggagaaacacacacgcgcgagaatgcgccgagagaggggggataattttgcgcgtgagagagagtgggggtatgtggagcgagggggaaatagcgcgtggggagagtttgtgtgggggcacaacgcgcgagggctctctacagcggagagtgggcgggggacaacagatgaaaaatctccacgagaagccagatagacggtgtggtgggtggcaacagcacaaggcgcccgtgtgggccaagagaatgtgtgttccacaaacactctgcgggcaggaaaccaccggcgggtggctccacaggccaaacctcaacgggaggtgggaccaactccgcgagagaagcgggcggtggtgttgagagtgcgcacccccaagggggggggctgtgtgggggggggggcgcactactaataaccgcgggggggagccataaacaacccaacgcacggacaacggttctgtagacaccctgttggaacaccatcttccccccctgtttccacaagaggtaggccaaaattcccccacattttatcaaaactacgacccccttaaagatgagagaggtccccctggagcggagaggagaaaaggcgaggtgggtctaaacccctccctccaagcgcgggggcaaacccttataaaaaaaagcgcgcggaggaagggtcccccccacaaatactacaaacgtcctcgagagaggacggcgaaggacggcgagagcgcggggaggagggctccccctcgacgcacgcgcgagggagagaggagccggagaccccaacagaaacaaatcccactccctcggttggnagagagtctnctgtctggtgttggataaagacaccccacctgtcgtagtgtgaaagaaccacctcgctgaggaggaaaaagaggggtggtgcgcccctcctcgtgcggggggccaaacaaacaatcagaggcagggccgagacgtgtagcgcgagcaattagtgcaacacgcccctacgcgagagaaggggtggatccccaaccacaaagagacggcagggaggcgggacaaccacaaaaagaggcaaacaacgaggagggagtggactaaaacaaaagaagccctcacacgccattattggcagtggccacaagacgatcacaaatagtgcaccaacaagccacgccg

SEQ ID NO: 588612 - DNA, 221 bp, Homo sapiens
tgattacaggatcctaagcgttgtcagtgcagcggtgtgatctcgtgctcactgcaaccttcacctctggggcttgagcaattctcctgcctcagcctcccaagtagccgggactaggcacttgtgctgccacacctggttaatttttttttttttttttttggtattttaagggaaagggggttccatcatgtggcccggggtggtctcaaatggctgag

SEQ ID NO: 588613 - DNA, 1642 bp, Homo sapiens
  misc_feature (566)..(566): n is a, c, g, or t
  misc_feature (1004)..(1004): n is a, c, g, or t
  misc_feature (1059)..(1059): n is a, c, g, or t
  misc_feature (1141)..(1141): n is a, c, g, or t
cctcccttcccacacgccgcgtctgagtaggtgtgttaggttgctcgtatgcctctggtcggtggaccttcaccctgtgttggtctccttaatgtctccgggtccgctcctctctggttttactcttgaccccggggtgcgttacatcttttctccaccgggggcccgctgttcgtccttaggccccttttttgggcgcccaactagtataggccacagggctggtccccacaacgacccggctgtgtgttccccggtctcccgggattttccccgcggggattatttctgttggcaacacccacggcggtttcccccaccacgggttctccggacaacatgagccaaaatgtggcttccggccccccctattatgacgcgctgggtgagccgacagccacccatttcctggtatatcctgcgtgaaggtcgacccaacggtgatgtttcctggaaaggacccattttgtttttttgaagaggtttagaatctcttccaaagcccccgcattgtgtacacgaggagttttttcctaaaaggcgccctctttaccgcgccccacccnacgagaacccacgaaaaagaggtataggcgttgtagtaaagggcaaagattgtgtaatactccacgcgaagggggggataccgcaggatcctgttttaagagggtttttttcgccacagagaaaacaatatgttgtggtgggaggaaagccccccacgaaaatggggattcccccgcctgggcccctcaaacctattgggtggggaatatgcgacgaaatattctcttcacagaaagattttttttcgcctcaggattttcttttttcttgaggagaattagacacaacaggttctcacgcgtgttgttttttttgggtttcaacagatccgccctgtgtccctggtctaaaggcacattggggagttctacacacgcccgcccccgttaaaaaatgtgttggggtaaaagtgtttgggtccacagaagcgcacaggngcgccacaatatatctttctgtagacgttctctcacacagtatattgtagagggnggagaaaatataggaaaacgccacaagccacgccacgcttttttatagccccacggggggtttcacaatgagatatagaggntgtgagaggtataaatttataagaggcccctctccacgcggctcgtggagattcacccaccatctgtgagagaccactctaataacactaaatattggttttgtgtgatatatataagcccacatttgtagaattttgtataaaacaatgttcacataacacatgcacacatggagaataataagaataatggtaataatacaccactaatataataataataatgctataaagtatatataaagaggtaaatatagtataatgagcacaataaacacaaacccctcgtgtggcctaccaccccacccttatttgcctcttcctcttgagggtatccgctgtgcggtgtttcctgagaacctaattcttctaatccctcgttctgaataagagaggggaacccctgtactgaaactttgtgttgaccatagcctttttgtctttcatcactttatctccaagtatgtatccttaaagaataataaatgggatttaactgga

SEQ ID NO: 588614 - DNA, 480 bp, Homo sapiens
  misc_feature (322)..(322): n is a, c, g, or t
  misc_feature (354)..(354): n is a, c, g, or t
  misc_feature (372)..(372): n is a, c, g, or t
  misc_feature (440)..(440): n is a, c, g, or t
  misc_feature (460)..(460): n is a, c, g, or t
cagtgccgtcaataaatcatcgtgaatacattgttgagcctgttggagtgcatttgctgatacgtcggttggtgctgacacattcgcctcgaataacaataggataaattaatctggtgctcagtttgcctgagccgatcatttgaaatgatctgttggcatgatactgctttctgcccgctttctctatgccgaaagcacaaacaaggcacagtattctattaatttttgcagacgaggtgataagaatgacttttctactatttcaagcaaccattacacaagcaatcaagctctaaaattcactgctcatgctcttggntatttttagccttcttatcacagacctagagntgacataaaaaaagcctntacagaaagagctttttacatagcgctactccagctttccgctggaatacgccccccaacctttcatnaacacgccggatacacaggncccaagaagaaggggatctt

SEQ ID NO: 588615 - DNA, 223 bp, Homo sapiens
cgaggatcccctaggtggaagcgagtcggggcagccagaatttatgctgccatgaaaagcaggtacagtgccccttttcagacagttttgattcgctctagacttttttttttttaatagggagggaaaaaattggatcattttcttttttctacatgcgcttaagactaaaacacaggttgggattaagttaattggctacctttttccgcgttccacctag

SEQ ID NO: 588616 - DNA, 374 bp, Homo sapiens
aattaggggtaatgaaaaagcaacttcaatagagatcgacgggaaggaatccttatggcaggctacaatctactactaagagtggagtaaatggagggatcaaagggagagattacacttgtgtctctaagggcaaagaaaatgcacaacagaactgagtaaaagtaggacatgcagaactgtaacaacgaaggtaaagaaaccagaagaagtatcacccagaccaaatttcataaagcagagcggaaatatctgacatttagagagacaacccctgtgacaaggaatcgaaacccgcacgaaatagcaatggggagaaagctacctaccttccctcattaaaaacattccattggtgcttgcggcagtgcagg

SEQ ID NO: 588617 - DNA, 961 bp, Homo sapiens
ggcggtgtggtcgttcgttgtggctggtgtggttccctgcgctcgtcgactgcgtgcgtcttcctgcgggtcagcggtaagcggcgcggtggtcggagcaagtggactagaacttcggcgtcgggtggaaagaatagatggaccgagccaaggtgactgctcgtaagtccaccggtgggaaagccccccgtaaatagctggtcacgaaagccgccaggaacagcgctccgctctaccgtgcgggtgtgaaggaatgcctcatcgcgtacatgggcccggtgcaaccgtggacgcattctgatgaggattcgtcgtgtgatcaccaagtcgaacgagcgtgcgtcatccggaagacgtgaccttccaaaggttggtgagggagagtcgccgcaaggtattcaaaattcgtatctgaggtttcagagcgcaggccatcgtgtgcaggctgcagagagggctagcgaagcgtacctggatgggtctgtacgaagataccaacctgtgtgccatccacgctaagagagtcaccatcatgcccaaagacatccagttgggtcgccggatacggggagagagagcttaagtgaaggcagtttatatggggttggtagtaaattctggtacatactttgggttgaagttgtgagtttgggggtaagagaattgttctatcatatgttggctttgtgacttaaagtcatcccatgcttgcaagtcagatgagtgcgacacgtgatgtcccagacttcagtgatgtgagcactgtggtcacgacgtgccagttgccatatgcgacaggcgtgggtgatacagcctggtcatgaacaagtggcggcaagacagtgggggctcaggccaaacgtaagggccggcccggctacagggtctgcaaaaaacaaaaaacagcgctttttgggacaaaacggagcggtcaccgcacggacgggcatttaccccacga

SEQ ID NO: 588618 - DNA, 220 bp, Homo sapiens
tacatcagctcggtcacccatgacagctgcatcttcgtcagacagatccggacatgcctcaatcttgtgtccattgcatgatgtcatgcgccctgcagtggtgctcaccaccaacaagctcgaagctgaccattggctttggggcggacgacgatcggattgttgagaccgccgttggcctggatcgcgtcatccagaaagagtctgaaagcggtctgga

SEQ ID NO: 588619 - DNA, 762 bp, Homo sapiens
  misc_feature (6)..(6): n is a, c, g, or t
  misc_feature (97)..(97): n is a, c, g, or t
  misc_feature (131)..(131): n is a, c, g, or t
  misc_feature (179)..(179): n is a, c, g, or t
  misc_feature (315)..(315): n is a, c, g, or t
  misc_feature (331)..(331): n is a, c, g, or t
  misc_feature (453)..(453): n is a, c, g, or t
  misc_feature (500)..(500): n is a, c, g, or t
  misc_feature (560)..(560): n is a, c, g, or t
  misc_feature (590)..(590): n is a, c, g, or t
  misc_feature (688)..(688): n is a, c, g, or t
  misc_feature (725)..(725): n is a, c, g, or t
ggggcnatctcacagcaatataaggcgtgggtgggcaggttagtctttttagattattttgccttacagagaaactactagactctgctgaaaaganccctgtctctcttctcccatttcttccataaganaggctccttattctctctctcactctaatgttacatatcccaaatggnagggcagttcatgctcattccccccacccaattctacaagtatctctctcttcttaagggggaggccagacaggggaaggggggcttggggaggtcctttgaggcgaaactgtggggtccttggggtgtgtgtgtnggggcgggtgtctgcngcggtggccgggggggcggggcgcgcttggctgggctcggggttaagagttctgtcttacccgtctggcttcttccttcttcccgccgccggccctcccctcccctttttgtttttctcccncctccttgctgctccttccttggtctttgtctcgtttgtctctgtgnctgcctgtgcgtttgatgttttttggcatagccttcttttttgtttggtctctgttgcgntttgtttctgcctctcccttctctgtggcnttcccctcccacccccgctctggcctagacaataagttaatgctagacaccacaaaaagggcagacatggcagtgcagttttaatatacatatatgtngaatatatatgtacacacagttagcacggtcagggtngggaggggcatcttggggtaggcaggaggctggggtc

SEQ ID NO: 588620 - DNA, 490 bp, Homo sapiens
ggcagggctgcctgtctccccagcgtggcagccgggggcccgggaggaaactgcctggcctcaaacccccagacccagcccttgcctggccccacctgagctcaccccaggatttcactctgtcacccgggagtgcggtgacatgatcatagctcaccacagcctccaccacctggactccagcaatcctcctgcctaagcctcctgagtagctgagactacagaagacatcatttaagaacatgaaaaggccagctgcaggctgggagaaagtatttgcagtgtgtgcgtctgacgaaggagctatgtctagaatacacaaagacctcctccagcccagtgataagaagacagcccaatttctgtaaatgggcagattttgagcagacatttcacgaaagaagatctgcagtcaatacagacatgaagagatgcttcacgtcgtccgtcatcaggaaatgcaattacaaccacggcgagatacaactac

SEQ ID NO: 588621 - DNA, 399 bp, Homo sapiens
  misc_feature (36)..(36): n is a, c, g, or t
  misc_feature (276)..(276): n is a, c, g, or t
  misc_feature (324)..(324): n is a, c, g, or t
ccaaacacaacacttgcctaaattttgtgaattaanatggttgttggctctgcacccaaccttcatgaagccccccaggggtcagggcaagccctaggcttaatcgaggtcctacgttcctcgtcctcctggctgtcaggccccagccagaacgctgtcctttagggaagtcggagtggcggggtcccctcttcaccctcccccatctccactttagatgcaaagtggacatatggctcatctccatctttgggggaggttctgtctaaagtcctnccaaagattcagattgtatgacaaattacgttctagactaccacgggnaaggaaggggccagggatttgcatcattacccccagacaacagcttcattaggctgaaagggaaggtttgacgcg

SEQ ID NO: 588622 - DNA, 859 bp, Homo sapiens
agcggggtcggacctctggcgctaccatggcgtttggcaagagtcaccgggatccctacgcgacctccgtgggccacctcataggccaaaagatgcagtgaaagcatttgcacagcaaacaggcatttcccacacacacactcaccaatccatcacacagcaaatcccaacttcaccattgtccactttcattgcaccatgttgttgtgccagcacactgtaggtcaccaagttatcccagtcatctcgcattagtcgcacagcacaggcacattctgtctcacacagcagccacatttcagttgacaggccgttcactggccaatcccacagcaatcaccacacttgcacaatctcaggccaccatttccagacatcagcaatcatttgcaaatttcaaattcaagcaacttggagtcccacaagagggcatatcacccacagtgcaagggttcgtagtgcatcggttcacatgcagccaaaagtccaaacacaagcaacaagttattcacccctctaggaacaccgtcggggcttacacaggcaacacaggtggcgaggtatccacaggactgcgttcacgttccaccacagtccgcaggcaacaggccaaagcactgaggcctttcgcacaacacaccaggcctacagatggcaacaccaaaggaaacgaaaagttgggccgattccacaaaacacactcccatgcaccacgttccagacgagaactattcgacagtttccccgtaaaagacaaaactttacagtggggatttcaaccccaagtttaaaccagttagggcacatagacccgaaaagggagagtgcgtatctcgatccaattgctccccttgggcat

SEQ ID NO: 588623 - DNA, 972 bp, Homo sapiens
  misc_feature (403)..(403): n is a, c, g, or t
ggggtgatacagctgtaccatctggaagcagcctgatattctggcatctgtcggagaagatgatgcagggctatctagaccccttctggtctaggatctgcgaaccgtgcgagcaagagagcagtggctggctaaatcccacgtcctgcacgtcggagatcgtttccctgcgtattcgcaggaacagacgcgcaagcgtgttagtatctatgctttagacctgtccgatagaaacatctacaacattctatgagcactatctggctttcatcatgtataggacagggttgacagttgtaacgaacaggagcactatcaaccacggaggacctggtcaattacgcagatgacgccgaggattatgtagcacaagacggcggcaacttgattcctagtataactnggtatgtgggcgctgtatcggcaccacatgccacgtgtacagatgaccgacttccgacatatagttgtggtatctaggacccaactacgacgcacaccgtcacagctctcgtatagtagatattcgtggaaagataggacttatcgcgcgtcgccgatggcagatctggatcgaccacaatgcgttagtaggaccgtgtcagctgcatctaggcccgtaagtcgacccctttcgtcaggaacgctgactagtgttcattagctggccagggaggatgaagtagtcgtactaactgtgtaacacagccataggatgaacggtagtggcccttgactatcgccgtttcgaagggccatctaaggctcattagcaccacttggttgtatgagggctaacctatattcagtggtccttccccgtgaacccgcgacaggttctcgtcccaaggtcatgagttttaccaggcaggagattcaccagaagctcctgacaaacgcaagattctaaaaccatctactgacctgttgcaatcaagttccataagcctatagcaccgtctttcgagcgag

SEQ ID NO: 588624 - DNA, 120 bp, Homo sapiens
tgctgggattacaggcatgagccactgtgcccagcctgcaataatattttggataggatacagtaaggggataggatacaggtagggagatctccctacgtgtatcctacaccgtctcat

SEQ ID NO: 588625 - DNA, 693 bp, Homo sapiens
  misc_feature (220)..(220): n is a, c, g, or t
  misc_feature (336)..(336): n is a, c, g, or t
  misc_feature (653)..(653): n is a, c, g, or t
taggtgagagttgtgacggtgtcagagacagactgtctcgggccctgtgaaccatcaggaagggttctaggggaggctcatggttgtcagagggtcttcccagacacccgagcacccacccgcttcgtggatgatgaggagctagcgtatgtgattcagcggtaccgggaggtgcacgacatgcttcacaccctgctggggatgcccaccaacattctgngtgagtgcccccaaccctgatggcctgtctccctggggtggcttcagggccagggcagggcttgcctatctccaccaccctctgcatcacctggcttggtgcctcaatttctgctntacctgaacatcttagtagcatctttgccacatgtgccccttttttcttccactgtccctcagggctcctgcactaatggagcagcagagcccatctttaaggctcctcgtgtctttttaggctttagcttgcttcctgctcttgaacctcagtagcttcctaagggctgcaggaaccattctggagtgtttaagctcgcttatggggtcatggggtcctcttgggcctgagcccaagcgttcctttcatatcctaattccttttgtgtactcttgggctcttttctggacttcaaggcaagtggccacaggcccanacaaggcacgaattgcacacagttgaccccagagagttgg

SEQ ID NO: 588626 - DNA, 410 bp, Homo sapiens
  misc_feature (220)..(220): n is a, c, g, or t
taggtgagagttgtgacggtgtcagagacagactgtctcgggccctgtgaaccatcaggaagggttctaggggaggctcatggttgtcagagggtcttcccagacacccgagcacccacccgcttcgtggatgatgaggagctagcgtatgtgattcagcggtaccgggaggtgcacgacatgcttcacaccctgctggggatgcccaccaacattctgngtgagtgcccccaaccctgatggcctgtcttccatgcacgtccaaggcttggcctgatctcctgaaccagcggggcctgtcctacctacatcatcccctgctgtcctgggaggcatagggcttccttgactacctttgttcctattctttgaacactgacccttggacaacagtcatcattaatttgtca

SEQ ID NO: 588627 - DNA, 593 bp, Homo sapiens
ggacgcgtgggtcgattcagaaatgctgaggtagggaaacctaaaaccctcactggatgtacatgtgcaaggagtatggtgataatgtttgttaaaaggcatagcagatcgttacaacacggactggacacagttgcctgagcataatgatagcagactcacacatacgggcaccgactctaggtacaacgaaagcaagagataagacaggtaagacgaagagagaccagtacgaaggataggtcttataagacaggcccgtgcacttttattgacatgatacgacaatattataatattacttatcatacgagaagagtgataagaacgaaatccagtgtagtgaaaggggataggcccacacacggtgagacgaatagtaaaccagaaaacaaataaagacaaaatgaatggaggagagcagagagagccagcacagcggaagagagaacatagaaagaaaacaaagaagcagaggtagagcagcgagaaaaaacacaagcaaaaaaaagcagccacacaacaacatacgcgaaacagggtcatacaacattccgagagcatacaacacatatgacacaaacaagaccacc

SEQ ID NO: 588628 - DNA, 277 bp, Homo sapiens
agatgccccagaccggacggaagtggagagccggagctcaggcctcgagtctagtgaggcgcgtaacaaattcgcaggagccagatccatcttatctgacatgttctttgagcagcacgtggatccgccatattagaccaggtctcagctgaactagctctcaggcatctatgccttcagctgttcacacctctttggggacatggatggagctcacggagcacgaagtgtatttctggggaacgggctgcctacgaatgtaacacgcccaatttaa

SEQ ID NO: 588629 - DNA, 365 bp, Homo sapiens
  misc_feature (134)..(134): n is a, c, g, or t
gtgtgtttctcacaacaaagattccattgacagacctgaatgctcagaatgtaaaaatatttgtcaaccttgcattaattgttcttaccatctaataggggtagaacttatgatatcaaccaacatggcttatnctatttctaaccattgaaaaaaaaacgcgtgccaccatgagaccaccaggaccaccaaatgctttggcaattccagctaaagaaagctcacactggaatatcccaaagttactctccacagtaggcatccatctaaaaagactggaaacatgtgtagggcttcaaacacacttcagtgtctatattcttgaatgggcggctcataaatgaaatatttaaaaaagtcttttc

SEQ ID NO: 588630 - DNA, 141 bp, Homo sapiens
atccataccatatatgctccgtgcagtgtggcgcagtccagctataatcacttatgacgccggtgcggctaagcgatgattatggtagcggaggtgaactatgctcgtgtgtctttcgactattcctactgtcaatatatg

SEQ ID NO: 588631 - DNA, 664 bp, Homo sapiens
gagaattatcaggcgattatagttgatacatatgcaacgaagctttttgtctctgatctctgttctgatagcgtctacgcagtatacatattagtggtcatagttgctaccatacatgtgaatatagggtttcatgctggttcccagatattaatcgtttggctacgtacaatggaactttaagtcatatatacatacatatatatatatatatatatataattctaaggggggaaatgttatattttctgtgtctataagagatgaatacagtggatactttctctattggtaatgattgagttcacctctttcagaagacattttctttctcttctgagtaattgacaataaaatctggcccttgtgaaaccctggaaatcttaagtctgttgaaataccaggttaaacacattccaagagatctgtcaaactcaaattcttgtgtatacttctgagagtgcctgagaaaaagacttcattatctcactgaagaaaatatgctttatctttggcaaacttcgtgtcccacatggttagctttacttatttgtcgcaatgcaatgttcatgaagcctgatatgagaaccatctccagaaagaaccaagtagggtccctttgacctttgcctggcttttctgaaccattgtggactcttaccac

SEQ ID NO: 588632 - DNA, 169 bp, Homo sapiens
  misc_feature (38)..(38): n is a, c, g, or t
  misc_feature (58)..(58): n is a, c, g, or t
cataaagagctcttacaactcaataaaaggcaagtaanttaaaaataggcaaaagaantgctggatggtatggtagttctatttttagtttttaccctaactactctgacttgatcatttaacattctgtgtatgtaacaaaatatcacatgcataaatattatgtatc

SEQ ID NO: 588633 - DNA, 151 bp, Homo sapiens
aaattttggccccctggttaaaagaatcatttcccttgcccttaattacttgaaaaacatcatttaattcggttcaattgaaataaagtaagtttttactaaggtattgccccaccaaaatcaataaatttaaatttttttccattaaaaa

SEQ ID NO: 588634 - DNA, 398 bp, Homo sapiens
tttctttgtttttgttttttatggcaactggaaagtatttactatgggattcaattctttatgatagaaagacagacataaatgaatcccatagtaaatatgtgatttgaaccatggttgacttacaagtgtcactacagctttttagaaaacatagcctaatatatgttaagcaaggccccggggtgagccagtgggcttgcggttttaatgtaggagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaacggcaaagatataaatcta

SEQ ID NO: 588635 - DNA, 198 bp, Homo sapiens
cgaggagacacacttacaacttcaaggacctacacttcaagatgttcgaagtgggtggatcagcggctctgagacggaagaagtggatccacatgcttggagggcgtcacagacatcatctactgcgtagccttgagcgcctatgacttggtgctagctgagcgacgaggacgatgaaccgcatgcctgacgagcatg

SEQ ID NO: 588636 - DNA, 296 bp, Homo sapiens
cactatcaggggggtgttgaagtcttccattatgtagttatctaagtctcttgtaggtctctaagaacttgttttcctaatctagatgctccaatgttgggtgcatgtatctttaggatagttaagtcttctggatgaattgaaccctttatcattatgtaatgcccttctttgtcctttttgaccattgttatagcctgttgtatctaatataagactagcaacctttgttcttttttgttttccatttgcttgataaatcttgctccttacctttactttgcacctagtatgtt

SEQ ID NO: 588637 - DNA, 957 bp, Homo sapiens
ttttcatggttcccatgctgccttttgtgggcctcgttttttgccattatattctccgccccgcatatccgttttccttcgcgggttttccctcgggcacaaaccacggtccctggcgcccccccccgtttagcgtcttgttgccacccggccccaagtcttgttttcccgtgttcgtggtgcccgaactgcctctttttgcccggggccgcaaatggacaacgggtgtagggttcccgacttcggcgcacacttggtttcgcataatatgccgccctgcctctcttgaacccctgctggtgcgcccgccattggggcccacacagccctcgctggtgcaaacttggtgcgcgcaaagagctctctcaaaatttcccgcgtgggtgaacaaaccccccttccaatgtcaatccggctcacacaaaaaggctgcttccccatgcccggggtggaacacgcggtcaccacacacccagccaccaggagcagcctcctctggtggaaccccccacgggccccgatatgggcgcgggaggtccacaccactcccggcactactgtgaatacagagtcctcactgcccacccactatgtgcacgcacacacaacggaacacacgtctacttagggcgcgcccgcccctcggcgcaaccattccagaagtacaccgtgcctccagagagcaagtctccacatcactcatagacacggggctgctcaaccagatgccaccatgctgcagtgagattctcagacaacagggcggcgtattgcagaaggcgtcgatcacccacgagaacacgtcggggacgaaagcagaaacccccgcggtctggccccctttgggaacaatacgcggggccccccgcctccgatgagagggcggtcccaagtcgacgcccccccccttaaatggccacccacgaaatgtttaattcccttggttcaaaaaaaaca

SEQ ID NO: 588638 - DNA, 231 bp, Homo sapiens
gttactctaacaaggtattcttacgtccttttttatgaaataggaaagtaaaacgaaagaactatttctgtgtgtttttaaaactagccttttctaatattgatatctaattaaagttagataatatgtaatatgctttggaacaataatctaaccagaaaatatggtataataaattaccaagaaatcattacatttattagaccggttttgaggtgattgtgccccgcg

SEQ ID NO: 588639 - DNA, 385 bp, Homo sapiens
attctgtgggctgatgaagctcgctttatgtgccaggtgccatgttggtccctcattcattcattcattcattcattctgtgggctggtgaagctcactttatgtgccaggtgccatgttggtccctcattcattcattcattcattctgtgggctggtgaagctcactttatgtgccaggtgccatgttggtccctcattcattcattcattcattcattctgtgggctggtgaagctcactttatgtgtcaggtgccatgttggtccctcattcattcattcattcattctgtgggctgatgaagctcactttatgtgcgaggtgccatgttggtcccacattcgtcgacgcggccgcgaatttagtagtagtaggcggccgc

SEQ ID NO: 588640 - DNA, 187 bp, Homo sapiens
tagctgggtttgggtctaatatgaataaggactgatacgaaaacagtttatggtgggtggactaaagtttaacttctgactgtccttgtgtgtattagaccttctaaaatacagagctatctctgggcccccgggtccccaccattgtattgggctaggcaggattgacggtcctccggcggctgtc

SEQ ID NO: 588641 - DNA, 139 bp, Homo sapiens
atgcaatagagaatcctggcaaccagaaagaagggaagtaagaggaaagcagtgtcaagttacagaacggccaaacatactaaacttaatgaagaagctattatacatcatgattagaaagtaattggtgggagcaata

SEQ ID NO: 588642 - DNA, 197 bp, Homo sapiens
gtagaggatccggacgagcatcttacacattctcaaaaaaaaaaaaaattactcttctcccgggtaatggggtagtcctggacggtaagatatttttttcccagggggtcaaagggtccctacagtatctgatggcgagtgggaaaaataggggacagaaatcaggtatgggcagttttcccatttccattggtgtg

SEQ ID NO: 588643 - DNA, 151 bp, Homo sapiens
atcaaccggaggtgaaatgaaataccgtcaacctgtgcatgagtttgtgtgaactgaatgtgtgtgcatacacataagcatgtgtgcgagcgcaaatgtggcgtctccacagcatgcgcaatccatgagtctgtttctaacgcgcgcgcgc

SEQ ID NO: 588644 - DNA, 670 bp, Homo sapiens
  misc_feature (595)..(595): n is a, c, g, or t
gcgtgccgcatgtattggacacagaatggcacgttcagtgtgcgcgcaggcatcgggtgggcctcaggtgagaaagcgtgagacttcaagtccgggagacgagtgactggtctgtcattgtacaataacttcactctctggggtcaacttaactagctgtaaggcacagtcagtatctaaactgatgttcctggcggtcgatgaagatcatgtagtactgtttatggtacagatacggagttcatgctgaatatcactgtcctgtacgttcggtaattgaaagaactgcgtacatagctgtatgctagctactgtgataagactggatgaaatggcttctcatacagacaatgccctaacttacattgactgattcgatccgagacacttgcactgtccggagttcagtgtgtcatgactgaggacttgtgaaagcctaggctatagagcctagtaggagacactagcgggtagctgtacatgggacatcgtatcatacacgtgtgaacacgatctgcgtgcagcatacacactgtggcacacacggacgcaacagctatatcagtgcttactgagacgtgcactagtctacgtntcaatagtgtgtttgcaccagtttcacaccgcttgactatgcacggtttctaccaggggctatattcttaggcct

SEQ ID NO: 588645 - DNA, 283 bp, Homo sapiens
  misc_feature (171)..(171): n is a, c, g, or t
ttacacgcttactcagctgcccgctgaaattgatcaggacacggctaaatggagttcgcccttgcagctcccaaaggtgcgtattggatactgcacgccttttcgcgccaaaagtatgaaggccgagagcgctgcataaatgtgtctaactttaacgccgagcatctaaanccacaccgttgatgacaccggcgtagcgccgtcatcgttttcggcgcagatagagcgtaaaggtcaattcaaatgagaatgacagtgaagtggatggatgatgtgctggaga

SEQ ID NO: 588646 - DNA, 205 bp, Homo sapiens
  misc_feature (13)..(13): n is a, c, g, or t
  misc_feature (52)..(52): n is a, c, g, or t
  misc_feature (77)..(77): n is a, c, g, or t
  misc_feature (185)..(185): n is a, c, g, or t
  misc_feature (197)..(197): n is a, c, g, or t
ggggcgagactgnggcctggagactcccctgggaggcaacagcggggtctgnagacacccttctccagctggagctnggactgttcagtcactgggagaagggatgtgggtctgaagagcttggttgcagaaacttcggggtctacaaaggccggcgggactgagccaaaagagcttgtttgctngggaggcggganatgcatcc

SEQ ID NO: 588647 - DNA, 172 bp, Homo sapiens
cattcatagtcatcattaagtaatcatatggacgtatagacaataatactaggaatagccccctttcacttctgagtcccagaggttaccccagggaaccctcttacattcgggctggattcttctcacatgacaaaaactagcccccatctcaatcatataccaaatctct

SEQ ID NO: 588648 - DNA, 403 bp, Homo sapiens
  misc_feature (285)..(285): n is a, c, g, or t
tctttcttgccaacgatcggataattttgtattttagcagagacaaagttctacatgttggccaggctgaactcaaactcctgactcaagtgatccaccgcccggctcccaaagtgtgggattacagggtgtgagcaccgtgcccagccctgtccactttttttaactggggaaaattttacattcaatttccattaaaggaggcggaaagacccagaatctggaatcagagagatgaaataattcaagtcatgttttacatgtataccattagatgctatgatngtaaccctaccaatcctcccaaaatgaacaggatcacaaacattctgcttttcctaatggaatctatatataccctcagcaacacattttaaaaactactctttcatttggggtatcc

SEQ ID NO: 588649 - DNA, 787 bp, Homo sapiens
  misc_feature (91)..(91): n is a, c, g, or t
  misc_feature (327)..(327): n is a, c, g, or t
gggctgagcttgtacatcctacagaaagagatctaatgagaagtgttctctaatactatgtgtcccatctcgccggatgtcgtctattgtnatatcgaccaggtagctctcaggcggttcatcgaggattgtgccttgttgtactatttctcgagacaagatgtagcatgcatggccaaggatagctgaacatgaacgctgccacgtggaatgcgagctgtgatggcccgtaggcgatcagcgacgttgatttctctctatatagcatacaccaaggacctatcattaacgccataccatcccaaggaacttgtacactgcgtggangactctatccttaatggcagcgtctcgcgcgatctgggatttactattggacaagaggatatgatgcggggctatgatgattcggagactactatagtcagatccatacacgaggaggacggtgggatgagcggaggaaggagtggatgatgctgcccagaggatcagtggattcatgcattttgtagcaaatggcggtcaccgttctcctttactataagtcgttggaagtgattacagcattcagcgtttgcccagattctccctatcgatactcaccttcgctcgcatatttagacgccgtgaacgagcttttcttgataaatcctgactctagagctggggactattgccaggtagggcaatatctcatcattttgttgtccttgtttacctataagtgaacagtgtcctaggtgaacgtcagtgtgattttttagaacctgttaacgacttgact

SEQ ID NO: 588650 - DNA, 888 bp, Homo sapiens
  misc_feature (58)..(58): n is a, c, g, or t
  misc_feature (82)..(82): n is a, c, g, or t
  misc_feature (133)..(134): n is a, c, g, or t
  misc_feature (136)..(137): n is a, c, g, or t
  misc_feature (139)..(142): n is a, c, g, or t
  misc_feature (144)..(145): n is a, c, g, or t
  misc_feature (200)..(200): n is a, c, g, or t
  misc_feature (333)..(333): n is a, c, g, or t
  misc_feature (372)..(372): n is a, c, g, or t
  misc_feature (392)..(393): n is a, c, g, or t
  misc_feature (428)..(428): n is a, c, g, or t
  misc_feature (469)..(469): n is a, c, g, or t
  misc_feature (493)..(494): n is a, c, g, or t
  misc_feature (500)..(500): n is a, c, g, or t
  misc_feature (521)..(521): n is a, c, g, or t
  misc_feature (528)..(528): n is a, c, g, or t
  misc_feature (539)..(539): n is a, c, g, or t
  misc_feature (541)..(541): n is a, c, g, or t
  misc_feature (548)..(548): n is a, c, g, or t
  misc_feature (551)..(552): n is a, c, g, or t
  misc_feature (557)..(557): n is a, c, g, or t
  misc_feature (560)..(560): n is a, c, g, or t
  misc_feature (566)..(566): n is a, c, g, or t
  misc_feature (568)..(568): n is a, c, g, or t
  misc_feature (570)..(570): n is a, c, g, or t
  misc_feature (572)..(572): n is a, c, g, or t
  misc_feature (575)..(575): n is a, c, g, or t
  misc_feature (578)..(580): n is a, c, g, or t
  misc_feature (587)..(587): n is a, c, g, or t
  misc_feature (591)..(591): n is a, c, g, or t
  misc_feature (595)..(595): n is a, c, g, or t
  misc_feature (601)..(601): n is a, c, g, or t
  misc_feature (603)..(603): n is a, c, g, or t
  misc_feature (606)..(606): n is a, c, g, or t
  misc_feature (613)..(613): n is a, c, g, or t
  misc_feature (623)..(623): n is a, c, g, or t
  misc_feature (626)..(626): n is a, c, g, or t
  misc_feature (631)..(631): n is a, c, g, or t
  misc_feature (633)..(633): n is a, c, g, or t
  misc_feature (636)..(636): n is a, c, g, or t
  misc_feature (651)..(651): n is a, c, g, or t
  misc_feature (653)..(653): n is a, c, g, or t
  misc_feature (667)..(667): n is a, c, g, or t
  misc_feature (690)..(690): n is a, c, g, or t
  misc_feature (697)..(697): n is a, c, g, or t
  misc_feature (705)..(706): n is a, c, g, or t
  misc_feature (710)..(711): n is a, c, g, or t
  misc_feature (713)..(713): n is a, c, g, or t
  misc_feature (715)..(715): n is a, c, g, or t
  misc_feature (722)..(723): n is a, c, g, or t
  misc_feature (729)..(729): n is a, c, g, or t
  misc_feature (733)..(733): n is a, c, g, or t
  misc_feature (737)..(738): n is a, c, g, or t
  misc_feature (750)..(750): n is a, c, g, or t
  misc_feature (759)..(759): n is a, c, g, or t
  misc_feature (770)..(770): n is a, c, g, or t
  misc_feature (810)..(810): n is a, c, g, or t
  misc_feature (886)..(886): n is a, c, g, or t
agtagaaaaatacccagaaacaattaaaattataagactatttttaaattcataaaantggtactgttctgggtgtgactanatttccattttttggtgtctcatgtgatacagactcaggaggacttacatnncnngnnnngnngggagctgttttcctaatttgttactatttaaaaatggttaagggtggccacatnttgggggcttctcctttaatgtaaagtcccttttggaatatcacttaaaatctgggacaggtcaaatcagctgctactctacacgaccgtctgcagtacaggcgtggtgagaagacctatacctcactcggcngagtctcacctatgctgttcgcagcaacgcatcggccgnaggacagagcgccatggccnntgcccaccagggcagccgcctcgcaccacaaccangggcctcacagcgcgcaatcaaaggtctggggctcattctncgctgcggtcgttggggggggcgnnaaaacngggcaattttctgtttggggnttttttntgtgttgttgntnttgcgtntgnntttgngcnagattnangngnagngtnnntgtggantgtnaagngggtgnanttnatatttntctcctggtnccnatttngnaanagcacagagtaaatnanaatttataaaaggnatcgcatcttcgctctgcttccnccccacngggggcgnngctnnangngagatgnngcactncttnacannctggggtggcangagaaaggncttgtcccgcncttcgccggacatctgcacctgtgcaaaatatagctttancttctgcccattgaagtctgtttcgtggagtctattcgcgctcttgctgcgcttcaggtttgcatccgggaattcngg

SEQ ID NO: 588651 - DNA, 1129 bp, Homo sapiens
cccacgcgtccgctctgcagcagccggcccccgccctatggccctacggccccctcaccagtgccctcgtgggcacacccctctgcctgggccccctgagaccacccaatgatggcttgccagcccaagtgagctcgcggctcctagtgcccccgctgggctccagtggctgcacgtgaagtgccccactctgtgaagagccagcagcaccgccgagagctgggcctaggccaggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccgatgccattgcccgagcctgagcccctgaccctcccgttggaggtcgtccgacggctcctgccccacgcatgcggcattccatgaacctcctgtcccatgcgtcctcgagacccggacacactcgagccagagacacccaccaggcctcatggctctagaaggtacccagagccccatgagagtgaatgacaacgaagcacaggggaagccacgagaactagaaacggagcatacgcacagcaggaagggcagccacactgggcaggacccaagactagctgaacatgggatgcaagactgactccggatcatctgagacgatctgcgcagatgaggaaaccgaagacatcaagggaaacgcgccttcagcccgcaataccaataccttcctcaaggacaaggacgatccgcgacgagcgaccaggcaagaccacggaaacaggaacgaggcatcacgaaccagagaaaagagggcgcaagcgctaccaggacgggacagcatgaggtaagccccaagcaagaacgcagacaccgatgcagaccggaaacaggagcggcccgagagaacagaaacaaaggaaccaggcgggagcaggcgatggccagcccagaccaccgcggacgagcgcaacagaggaacacgagcgcccacgccgacagcgaacaagaccacaaaaacaacccgcaccacgcggagcaggcagcgaagagcaggcgagaagagaacagccgacacatcacgggaggacg

SEQ ID NO: 588652 - DNA, 135 bp, Homo sapiens
catcacgtatactactaagagagcgtaacctcgacagcagcttcttcgagcccgccggaggaggagaccccattctataccaacacctattctgattgttcggtcaccctgaagtcatattcttatcctaccagg

SEQ ID NO: 588653 - DNA, 1184 bp, Homo sapiens
gagcaagatctggacaccacaccttctacaacgagctgctgcgtggcccctggaggagcacccagatgctgctgaacgaggaccccctgaaccccaaggccaacagacgagaatgatgactcatgattatgttatgagacctatcaacaacccctggaccatgtactgtggccatccagtgccgtgcctgtaccctctacgcctactggtgacgcaccaatggcattgtcatggactctggagacgtgggtcacccacacggtgcccatctacgagggcataagcacctcccccacgccatcctagcgtctggacctgtgctggccagggaccatgaacgagctacctacatgaatgatcctcactgagccgaggactacacgcttcaccaccacggacctgagcgggaaatcgtgcgcgagcatcaaggagaagctgctgcatacgctcgaccatggactatcgagacaggagactggacaccgccgcatacctcctactatctctggagaagagctacgagtctgcccgaatgagccatggtcaatacaccaatctgagccaatgagcggcacccggtagtccggatggcagcatgaaccaaaacattcctatcctggagctacttggaatctatgacggcatccacgatcacacaccttcaaactccatccactgaccagtgtgacagtagagaacatccgccaaagacccggcgaccgcccaaacacgagagccacgacggccgcgcgccacacacgaccaccgggccacatcgccgcacacggacggcccgacaacggagataccaccggccctggaagcccaagcaccaaaagcacaactcacggacccatcgacacgcaccagaggagaaagaacctccagaagaggatagagtaggctcaaccatgggcgcaaaagagccaaccaatacgcacgcaaggacgcaggcaccaagcacaagcacagcgaaggaccacaccgacaacggcgggcccaccaaagagaccacgcgccaacacgccgacctcgaacggcaccacaacagcacgacgaaccacacacgcggcacagggcagcacgccgaccgacacacacgacgcccgcgcgaacaccgccaccacaagccggcccagggaaggcaagaccgacaacgccaacgcacgcaaccccagcatcct

SEQ ID NO: 588654 - DNA, 146 bp, Homo sapiens
attcgcggccgcgtcgacagacgagatatgacacctaaggaattcccctgcttcagctcctaactcaatcaacccgaaatactcctccgggaagtgccccaccgtcaccactgctggcttgacagaggctccatactcggcctggc

SEQ ID NO: 588655 - DNA, 338 bp, Homo sapiens
  misc_feature (239)..(239): n is a, c, g, or t
attcggcacgaggctccagactccacccaagaaagagactttcattcctccctcaaacctttgggcagtgttttttgttgctactttagtagaacctacggaaacaattcacagtttacagcagtccctgcagcaagatcccacacatgtggcagaactgggcagactcctgctcatcattcctacttggggctccccacacaggagcgggggcaggaagaaggctcagcaatcacttntacagaacctcctcctacaggacttttacccatcaccccaaattttgggtacacagcttgaccaatatttatctgttcaataaatactatttgaggtta

SEQ ID NO: 588656 - DNA, 1548 bp, Homo sapiens
  misc_feature (1059)..(1059): n is a, c, g, or t
ggtctttgctgcgtatcgcgacgctacggtcagtgccggaggacctccatcaggcatgtcgaagccccatatgctgaagcctgggatctgccttcattcagacccagcagcttgctacgcagcctatggcgtgtacatcaattccctgtgtagcatcatgtgcctgcctggtacttttgattcacacacccattcacagcccggaatcactggactatcactctgtaccatatgcggccccacggcattccccggactccatgctggcaagacggcttcgtaacgtgacgtaattgaattcaccgctccttggcacactagtaaactgtagagcctccgcttcgtgtacaacatctccttcctaccacttgaggagaccttccacttgaatgtttaaccctaacttgagcgcgcagcacctccattacgacacgtaaagtcgctgggtctgtcaacctacggacaccttacccgtgcatagaagtcctatgtgggctgtacgtcgaatccccaccagttcccattcattatcaccgggccccctggtatatgccgtggtggggcccttcgtcaggaagccaacgttaaaaacgcgcaacccattgaaagtacttcccagtaaatcgtaggggtcctacactcctaaaggggcggctacagactgtgcctacctttgactacgaacggcgattgtgaacgtcctagtaaaggataggggggtacgcctctatcatacctcctacatacactaacaacccgtcttagtgcaattaaaaccgccccttaggcaaattcgggcacatccattgtaggtttgaacctgcacgtaagaccaatttccctttggttaagcgccctttggtggagcttacacctagagcgtaaaatccgaattctttggactacatgcggctggcggtcgtgaacaacgtaggaggggccaccgacaaaccggaatcattaaccgctttgtgcattagcaatttgtgggggcccttcaaatttagtccctgaccttcccccagggggtagggaaaagtcccatcccaagaggcggtntgccacagcaactttcgcccctagggagctgcacccgggaaggggctcgcccaatatacaatagcggctgagagtatacccttatggctgaggccaacgccaaaatgtacaaggcgggataggtagtctaaactctctttcccttggggagaggctcggcatgtttaggccgaacccttttgcccacctggccatgggctgtgtttcgtgaaagccaacagcggaatattgttacccggaggggaatctctcgcacacccgtgtataggcgggggttatcaccagcaccaggcggaagttgtttggggatcaaagcagcgagaggtaaaccgcgcgaggatcatctatagacaccctctcccccagagaggagacatccataggaataggtatccctcacaagcagacgtgtttcgcagcagcgagtatcgacgcgagaagcaaagcagccggcgacgcagtaagtaacgcctccgcgatagatttaga

SEQ ID NO: 588657 - DNA, 143 bp, Homo sapiens
tctggacacgcatgggctggggctacaggcggcatcccaacggatacctggtcctagagctcagcgtgcaagaggccctctcggggacgtcctgcctcctaggacctagacctgttctcaccgtcctggcactgctcctagcc

SEQ ID NO: 588658 - DNA, 472 bp, Homo sapiens
tctctctcccctaccacctatctcttcactgccttgctgcaggcaaagagagggtggagggagggccagcaagtgaggattttgatggttaacccttggtaatccagccaatttccagactgccaaagccatatgtgtttatataaggaggaatggttaccttcctctggttagcagcagtcttcaaaagggttaatgagctcacatacaagagatggtggatcttgtggcccagaagtaccacgtctttgtgtgtgggacaagcgaggtgcctttcaagttgccaggtgaataaacgatgtgtacataaagattccaggatgaggagatgggcacagagaagtaatgggtcgctataactttttagatgactgtggaagcgtctcagttgtagaggtaattggcttggggtatagttgtgtgggtaaaataggtggcaatctggggataaagattgcaagacacttgggac

SEQ ID NO: 588659 - DNA, 143 bp, Homo sapiens
cttctgctcgaattcaagcttctaacgatgtacggggacatgttagccagaattacttgaactcctgacctcaagcagtccacctgcctcggcctctcaatgtacaaaataatcttttaaagtgctatctgaaatacaaaaaa

SEQ ID NO: 588660 - DNA, 188 bp, Homo sapiens
agttgataccctgggatgggagtctctactctcagacagagtttcatggttgaaacaagctctgctggcttcttattaggatgaacctgtcccttgtagcttcatcctgatcctttgctgccaccacgctgcataggaccatgggttgcttctgacagcttgggtagagattgcgcgacagatctgcg

SEQ ID NO: 588661 - DNA, 505 bp, Homo sapiens
tcagagcttgtccagaggaccacgttcaagttttgagattgatttaacaagcagaattgagcagattgcttgcgctgttggcctttgccctcacgatgtccccatgcgttttgttgagagcttcacctccagctgcgggagaattttggggacaagatgttgcgcattgcagaagggtgacccacaagttctatgaagaacttttcagtttactcttgccccaagtttccttgtcgcctgtattgcccaactatgatattgtgcaccccaagtaccacaaagagcgcttcgtgcagcagctgaaggtgtgtgctgatgaagtacagcagcaggcccagttttcaaccatccgcagtttcctgaagctctacaccaccatgcctgtggccaagctggttggtttcctggacctcacagagcaggagttcgggatccagcttcttgtcttcaaacacaagctgaagaacctcgtgtggaccagcggtatctcagccctggatggtga

SEQ ID NO: 588662 - DNA, 257 bp, Homo sapiens
  misc_feature (226)..(226): n is a, c, g, or t
tacaggatcttatagctcgcactcttcccgccaggcaagtgtaaaaacaaaattttggccaggcgcagtggctcactcttgcatcccagcactctgggagaccaaggcgggtggatcacctgagatcaggagttcaagaccagcccgaccaagcatggtgaaacccccgtctctactaacaaaaaaataaaattacctgggcattggtggtgcctgtgcctgtgantacctggccacttctggaaggcttaaggtgg

SEQ ID NO: 588663 - DNA, 87 bp, Homo sapiens
atattgtcttgtaatgttgcataatgttccctttttaaagtgtgcccttatttctaaacagtaaagtggtttaatttctatcccaaa

SEQ ID NO: 588664 - DNA, 1061 bp, Homo sapiens
tggggtaatttccactttttccctttaaacattttttaaaacatttacaaacatctaaaaactacaacacgtcacagctacaggggggtgaggggagggcaccaaagaaaagcagccacacagagtagggggggagggggcagcctaacctacagaggctatgggggtggaggggtaacacgggggaacacggaggcttcatagtcccgtgcattaggggtccctcactcacggcccaacctctccccactcagaggagctgccaggagggccccgtgtttccgtgcctcgtgccccagctcttggtgcttttggatctgcgtggtttgaccaaatgccgggtttctttccctccctgtgttcccctcccgtgtgaggggacaggtagggaggcatggagaggggcaggaagagcagggccccgggtgaagctcgagccggagtagaaaggggccacaggggcatggggacggccgtctgcacggtagacggcggcaacggagcatggcccctgtgacgcgattgcccaacaaaatctccaaaaaacgaggggagaactcatataaacccaagagactggaccaaagggcgtatcactacaactacgcccaggggtacaaacacgagagcagaaaccaagacaaacacgagaggcaggacaaccatgtgacgaagcgccaagggtaaggcagtcagtagcaacacacggcggaaaaatcgtagacaccgaaaggacagaaagtcaagagagagaaccgagaacaataagaggtaaatcgcccacgcgcgaacaccacccagaacgaaccgaatgtgcaaaaagcccacgagatatatagcacgaaaggaaaaaccacagacaaaagactcacacccacagaacgaccccagaacggagagacatgacaccaaacaaaaaagtaaaacacacttacaatcaacacacaaaagaaacactagcaggaggaacgaaatgacaagaaacaaccctcagcgacacacaataaatagacgcccacaaacgacactagcgacagaaaacgaagccaaaccggcatcag

SEQ ID NO: 588665 - DNA, 522 bp, Homo sapiens
ctgttcccttgatgtagtattctccccctttcctgtgagctgagctgtagtgattgctatctctcttctgggtctaacctccacagcacatctacccggcttcaagctggcagtgggggttgtctgcacagtgtcctgtgatgtgaaccatctgtgggtctctcagccgtggataccagcacctgttctggtgggggtggcaggggggtgaaaagggctctgtgagggttcttagctttggtggtttaatgttctatttttgtgctggttggcctcctgatgggaggtggtgctttccagagagcatcagctgtggtagtatggggaggaacaggtggtgggcagggccccagaactcccaagagtatatgctctttgtcttcaggtaccagagtggatagggaaggcccatcaggtgggggcagggctaggcatgtctgagctcagactctccttggttgggtcttgctgtggttgctgtgggggatgggggtgaggtcccaggtcaatggagtggggaac

SEQ ID NO: 588666 - DNA, 124 bp, Homo sapiens
cggtccgtgtacagcggatctggggcaccatctggtctcttgtatcaaggtcagagctggattctcaaaaaacaaaaaaacacacaaaacacaaaatttggggaacctttagacaccaaatggg

SEQ ID NO: 588667 - DNA, 412 bp, Homo sapiens
atgcgagtactaagcaggtaggtcagatagggaagaacctccgagtctcctggtgcccaggtcatacccaagaagctggagaatagcacaagcagcatcactgatgaaggctgactcccagatatcactccataattttggaattcaaaaactgcctcttggccaggcgtggtagctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactcc

SEQ ID NO: 588668 - DNA, 1134 bp, Homo sapiens
gttttcatgaacgaggcctattcaagtggtggctttggcacaaaaaacgtattatctttaaacgcctctacgtttaactaccttgagattccagcgatagcgagcgtaaagactggactgtagtagttcgtggcaagtaaaggctgatgactcctctttaatcctacagatctagatgactcatgacgattgtatattgaccgaacatagcacatgatgagatatcaaggtaattacacatagcatgctctgacaacaaaatacgtaatctgtttcacctgtaactgtttaagccaataaacttttcagaatttatgtaatgtggggcttatatgtagcactttacgtgttcatgctgcttatcgtataatgctactgaaaaaaatgaattccaagattctcaactatgctaatttcaaaacatggtctatggtttagactataggaatacaaaatttcctatttagggagaataagaactctttctgtcatttagggctatgaataaactttctggtcttacgagaccagccattgacataggtcagaatcagaaaacaggtaaacctcactcacacattgggactcatttgaacaaacaatctaggccaacaatactgacaaagcctatgtgtcattaataggaacgtatcacgtacaggtaatgcactccaggaacgtgactaaccacagaccaacgagcacatccagcagaatgtaacaacacaggcaaacaagggaggcaggccatggcccaaaagcgcgaggaacgccatccgaaacaggaggagctccaaaaaatagtcgaaactggcaaaagagaaagcggagaaactcaacgcctagacaaaagaacaagaacgacaacaacaaacaaaaagcagggagcgctcaaagaaaatgcacgaggggcccacataatacggactcaaactaatagaagaaagaggcagccgaaaaagcagcgaaaaacgaagacgcacgcctcgcatttatacagaagaaaagaacacaacacgaatgccaacaagtgcagcgcccacatcaggcggcgaccaagagccaaacacccacgaaaaccacaggcaaaagcaagagagcaagaccaagcgctaccatcacatactacgcatg

SEQ ID NO: 588669 - DNA, 166 bp, Homo sapiens
gaccagcgtgccgcgcgtcatgccggagatgatgcggttgcgccgcgggaaattgggcttgagaggaggtgtgccgagcgggtactcactcacgatcagcccctcgtcggccaggcggtgcgcgagcgccaggtgtcgcttcggatagacgcggtcgaggccaatg

SEQ ID NO: 588670 - DNA, 253 bp, Homo sapiens
ttaacaattcacatcctcccaccttcttctttccggaagaaaggcagttggcagcgacaaaagggcggtggcgtggggatcatccaccatctccaggtttaacacccaggctacccagggttgggcagtcaggcctctaggcgtgatgctctcagaggcaatagaggaaaagtaaagggagggtctcatttcacggacaaggaagccttcttaaccttcttccccagtaccaacaattccttacacggccaat

SEQ ID NO: 588671 - DNA, 1018 bp, Homo sapiens
cgagtattcttaaaccacgcctatcaactgtacacaatgtggagcaggagcgaagtttctcccaattgttttcctaactcgcttcgaggcttactacagacgtggtcgtgttggtactgtcgaactgctctgaccaaataccctgcgaccaatcaacccctggtgcgggcgttaatgctcactagttctcgacgaacgctgattgagatatgtctgatgagctacgggcgagccatggcaatgtcacactgtcacgatgaatcgtcaattaccacgtcaatatttgctgcaagtttcggcgcacgactgttcacgcgcgtctaagtctctcctggctttatattgacctgtctccttctactcaggccagaatctatctgtttctaccacaccaggcaagtagcccatacaatgctagaccctagcaggctatgtcctctaccgcaggtacctagcatgtcagtggctacgagatacatgtgttgaagatggctctagtagtgagtctgtacatcacctaattgactgctttggcacaggcgtgatatacagagactatagaccgcagacactgccttggagttagctactgcagagtgtcttggcttgagagaataacctcatagtatgcaatcagtgagcatgatgacctgtggaaagagacatagatggactcacacttgataaatcatggggcacacgatatgttcccacccaacaaagtgtgataagtgatatgtgcagccagtagccagccttccttcaatcaaggtttccaggcagagcaaataccctagagattctctgtgatataggaaagtttggatctaggaagctggaagtattagcagggatgtctgtcaatcccactagggactacagtgctgcctggaaataggtctgtccactcctggtcattggtggatgttaaacccagattcctttacaactgctgcctgctaagggaaaacatgctcctcattatcatcgactattatgtatacccgcgggtccccta

SEQ ID NO: 588672 - DNA, 140 bp, Homo sapiens
tacactaggtcccttttcttgtgcactgcactgtccagaactggagatggcgaactacagggcgaggacatcaggagggcaccccgaggcccaggtgtcccccctaggttccctcagtcctcgggtgggattgccccggg

SEQ ID NO: 588673 - DNA, 764 bp, Homo sapiens
tctcgagttttattgtaatgttgttaatcatttgatattatttgggtattatctaatttaactgaatttagattattatattatattattattctttctttgaggcagggtctcactctgtaacccaggctggagtgcaatggtgcaacctcaacctccgtgggctcaagccatcctcccacctcagcctcccaagtaaccgggataacaggtgcacgaccaccatggcccagcgttaatttgtggtattatttgtaaagacatgggtttacgccgtgttctcccagaacggggtcttgaacatccgttgggctcaaggaatctgcctgccttggccccccaaagtgctgggactatgggcgtgagcccaccccacctagtaatttaagagtgttggcccacattttctgcctacacaaggatatacaaacacaatctataaataacaccgtgtgaagtaggtcagagcatttccaagaacactcatcatgtttaagttccacaataaccctgcatggtttcactggacagatgacgcaaactgaggctggcagggggagacaatgtaccaacccaaggccacacggaactagtgaacgcccaaatccaaagcctgtgactggtgtcactgtgcacagggttggaactccagaccgaagcctgatttttaaagaagacaggccccaaattggggtatctcatctctaatgatggggacaagtggccctaattcattctccgactccccaggacctcatggagag

SEQ ID NO: 588674 - DNA, 750 bp, Homo sapiens
gctgctgttcagtgtatcccgacggcagtgcatccgtggatcatggtctcgcgttgccagtgtatgaggcgaggcggcgttgagtgccctgtcgtgtatccgtcttctgtatgccggtgtcttccagggtagggacttttggctgctctgatagtggacagagtgggccgtgtggaggtctttttactcttccctttgtggctgggtcgtccagcaggggcgtgtactacctcatggccctcacgccgcaaaacatccagcactgtgtagttgcccatgaaatgaccagctccaaaggcaaagaagaagcctttgtcagggaactcctccaaaagggccttcacccgcttccctattctctcactccgcttgtagatcagctcccggcgtaagtagctgtcaatctcctgagcagtgatgcgctcctgggagctgtcatggctgaggatgacggagctgaggtccccgcagttatagtgtttgatgagatcctccgtcgtgtaggggatctgaagactgcctgctcgcagggctttcctgctgcaggagggtctggttcaaagcaaagatgacctgtgaaaagttcaacccattcaatggatggcactgctcttccaccttttccactgccccagtctgtttcctcagccgctcaggctcctggggcacggcacaggtctaagacaggcactccacggaacttactgtccacttcagtcaaggagttgaccatgagcatcaaccagaaag

SEQ ID NO: 588675 - DNA, 1242 bp, Homo sapiens
ggcacgagggaaacaccttgtgttcaccacagcacatccctggaagaaactggggacgcttttctctgctctctgtgctcccactcatggtgtgcttcatgggaagcagattctgtgagctttgcaaggactgtatgcaaaatgaatttcgtctgtgttatgatgaaagcgcaccatgctaacttctttcttttttacccgtaggaagtgagaggagccctggaaaggagcgagccactcttgcttcagtgtccagaggccaccaccacagagctgagtctgtgccgcatcacgggaatgaaggagatgctaagaaaattcagcacggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccaccccacccccaagagtttccattaacttgatcccattatgaacagccacattacacaatcaacttcaaccccaatagaagagagctgatcatattctgtgtctttaagtaaatgtattctctgggctaccccatgtgtgtgctggtcactcaaatattgagcccctattaccatgaatcctactgccataggccagattttataaatatatgtcactttttcaagtgtatttaattatttgactctt

SEQ ID NO: 588676 - DNA, 125 bp, Homo sapiens
ctcgagctggtaccgacagatcctaaccagtatactcaccagagacaaccactctgtatcagaccgcctggatggtggggccagtagcgacctcggggagcagagtctcagacactactcggaac

SEQ ID NO: 588677 - DNA, 448 bp, Homo sapiens
cacccggcgcacttctgcaccctggtgttgactgagctccaagttggcgtcactgttgttgcttagcgactctgggtgctgctgctgtacagcgttccgagaggcattcacaataggtgtcccttatggccaggtctgggctgtggaagatctgagagactgaggtgacacctttggtcgtgaagcccttcagcggtcctggtgcacactggtcaagtccttcgcgtaagagaggatgctctccaggtttgttttggtgttctcccctgtccccagcaggacctgggctaaggaggctggcgactgctaaatggggaaaaggccatggttgtgtctccaccttcttcattgctcagaaggcctgatatagcttcagggagaaatctaccaaagcatcccccaacacggtctctgttgaatgactctcccagtcagagcagagagtaac

SEQ ID NO: 588678 - DNA, 406 bp, Homo sapiens
atcattatggaaaagaatgctgacaacggaagccatacctgagcccagatcgataactgaattatatgtgcccatcagtaagctccacacacatgaaatctctcaggtctcgtgtggaaagatacatcagaagagcactcgaataaaatgtactgaacttgaccatgacagtggagatataggggtaccagcgaatgggacggatgaccaatgcaataaccttctccatcaaatagactagtcccctcactaatcttccacctaagggattgacagagcatcctatagcagtcacctaactttttctcggaacttccacaaaagctataggtttgatgtacaagtatgttctcccatgcagacggtgaatgtaatcacacgtacagcatcagccttctttatttcc

SEQ ID NO: 588679 - DNA, 1152 bp, Homo sapiens
ggcacgagggaaacaccttgtgttcaccacagcacatccctggaagaaactggggacgcttttctctgctctctgtgctcccactcatggtgtgcttcatgggaagcagattctgaagtgagaggagccctggaaaggagcgagccactcttgcttcagtgtccagaggccaccaccacagagctgagtctgtgccgcatcacgggaatgaaggagatgctaagaaaattcagcacggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccaccccacccccaagagtttccattaacttgatcccattatgaacagccacattacacaatcaacttcaaccccaatagaagagagctgatcatattctgtgtctttaagtaaatgtattctctgggctaccccatgtgtgtgctggtcactcaaatattgagcccctattaccatgaatcctactgccataggccagattttataaatatatgtcactttttcaagtgtatttaattatttgactctt

SEQ ID NO: 588680 - DNA, 939 bp, Homo sapiens
  misc_feature (18)..(18): n is a, c, g, or t
  misc_feature (26)..(26): n is a, c, g, or t
  misc_feature (85)..(85): n is a, c, g, or t
gatcctttgcatctttanttcaaaangtgtaaactttctttgtcaatctatggcatgcccatatatgaaggagatgggtgggtcnaaaagggatatcaaatgaagtgataggggtcacaatggggaaatgaagtgtgctaacattgccaaatagtgtgccactagaaatggtgtaaaggctgtcttttttttttttttaaagaaaagttattaccatgtttttggtgaggcaggtttacaacactacaagtctggagtttaagaaggaaagaggaaaaaagaaaaaacaccaatacccagatttaaaaaaaaaaaaaacgatcattagtctttaggagtttcatttaaaaccattaggaacctttcactttatctcatgtttagctgtaccagtcagggatttaagtgaactacaagtggtataggcttaatgggtaatggcgggttatgaccttaataaaggtgtactttgttttaccagcggggtgttttacctggtgacttttgtttaaaccaattcttgatttccagaagcacttgaagtttgcaattttccaccctgcccatttttgtaacactgcagtcatctgggacctttaaaacacaatttttaaactcaacaagctgtgatagtgaatggtcactggtaaaacgcggatatgttcgatacacgaaaatatggcttctttgcacggccctttgagaaattaggggaaacaaactttccagtccgggtttggtgaaccttgggctacacggtggcaaatcggaaatgtgccctgtgcttcgaggaggtgttgtgcacagttgttaaccggtaggggctactgtggccaaggcatgtggtttgtctaccacacaacaaactgaattaccaagagcacagcacacactatacatcagatccctgcttctctattcttttcctcttccttcttg

SEQ ID NO: 588681 - DNA, 728 bp, Homo sapiens
cttatacatggcctaaaatgtttctacaaattagagtttgtcacttattccatttgtacctaagagaaaaataggctcagttagaaaaggactccctgatctcgggtgatctgtctgtctcggcctcccggggtgctgggattgcaggcatgggccaccgcgcccagcctcaaagtgttctttttaaagaataagaaaacgcacatgggctgggtgtggtggctcatgcctgtggtcgcagcgctttgggaggccggggcaggcagatcgcccggggtcaggagtttgagaccagccggactaacatggcgaaactccatctctactggaaatgcaaagttggccgggcgtggtggtgcacacttgtagtcccagctactctggaggctggggcaggagcattgcttgaacccaggaggcagaggttgcagtgagccgagatggcgccattgcattccagcctgggcaacaaggctgcaactccgtctcaagataacaggacaagaagagaaaagaaaacacatgttactatctccagttaaaacttttttctattatcggcaagatatggtccttacactaatattcaccgctttaaaatgggcctggagggcttggtaatgggttctacacaccattccagctttatttatcccagtctactctttgggcacctaggccactcccaggataagacgctaacatcaggaagtgccatgccaaaaaaa

SEQ ID NO: 588682 - DNA, 413 bp, Homo sapiens
tccaaagttcctattggacttaaatcccaaggtgatagtattaagaggcaggactacctgggaggtgcttaggtcatgagggctctctgccctcatggatgggatcagtgcctgtataaaggggtttgaggtagcaagtctcttccatctcttctgccacatgaggacgtagcatgatacaccatcttgggggcagaaagcaagtccttatcagacactcaatctgtttagcaccttgattctggaacgtcgcaatctctaaaactgcgataaatacatgtctctggtccataagttacccagatctaaggtctttggttatggcagcgtcagtagagctaagataattatccattttctcatcactcatacaggataagtaaaacaaggaggataagaatccatgttccaca

SEQ ID NO: 588683 - DNA, 420 bp, Homo sapiens
gcacgagggctcctctgagtctctgctggggcatgaacacggctgtccacctggtgatgatcatggatacccagtactacacatggcgagatacacgcctatgtggattaccccatctatgacgtgctctagaaggtgggccacgccaaccgccctttgcaagacgaggggcgctgtgtcatcatgtgtcaaggctccaagaaggatattttcaagaaggtcttatatgagacattggcaggagaatctcaactggaccactgtatgcatgaacacttcaatggtgagatcgtgaccaagaccattgagaacaagcaggatgctgtggactaactcaactggacctttctgtaccgccgcatgacacacaaccccaattactacaacttgcaggggatattccatagtcttgtgggaccc

SEQ ID NO: 588684 - DNA, 2037 bp, Homo sapiens
  misc_feature (1584)..(1584): n is a, c, g, or t
  misc_feature (1717)..(1717): n is a, c, g, or t
  misc_feature (2037)..(2037): n is a, c, g, or t
gtctctcatttaggagggtttgcaggtccagagtaaagtcactgaagagtggaagcgaggaaggaacaggatgattagacctcagctgcggaccgcggggctgggacgatgcctcctgccggggctgctgctgctcctggtgcccgtcctctgggccggggctgaaaagctacatacccagccctcctgccccgcggtctgccagcccacgcgctgccccgcgctgcccacctgcgcgctggggaccacgccggtgttcgacctgtgccgctgttgccgcgtctgccccgcggccgagcgtgaagtctgcggcggggcgcagggccaaccgtgcgccccggggctgcagtgcctccagccgctgcgccccgggttccccagcacctgcggttgcccgacgctgggaggggccgtgtgcggcagcgacaggcgcacctaccccagcatgtgcgcgctccgggccgaaaaccgcgccgcgcgccgcctgggcaaggtcccggccgtgcctgtgcagtgggggaactgcggggatacagggaccagaagcgcaggcccgctcaggaggaattacaacttcatcgccgcggtggtggagaaggtggcgccatcggtggttcacgtgcagctgtggggcaggttacttcacggcagcaggcttgttcctgtgtacagtggctctgggttcatagtgtctgaggacgggctcattattaccaatgcccatgttgtcaggaaccagcagtggattgaggtggtgctccagaatggggcccgttatgaagctgttgtcaaggatattgaccttaaattggatcttgcggtgattaagattgaatcaaatgctgaacttcctgtactgatgctgggaagatcatctgaccttcgggctggagagtttgtggtggctttgggcagcccattttctctgcagaacacagctactgcaggaattgtcagcaccaaacagcgagggggcaaagaactggggatgaaggattcagatatggactacgtccagattgatgccacaattaactatgggaattctggtggtcctctggtgaacttggatggtgatgtgattggcgtcaattcattgagggtgactgatggaatctcctttgcaattccttcagatcgagttaggcagttcttggcagaataccatgagcaccagatgaaaggaaaggcgttttcaaataagaaatatctgggtctgcaaatgctgtccctcactgtgccccttagtgaagaattgaaaatgcattatccagatttccctgatgtgagttctggggtttatgtatgtaaagtggttgaaggaacagctgctcaaagctctggattgagagatcacgatgtaattgtcaacataaatgggaaacctattactactacaactgatgttgttaaagctcttgacagtgattccctttccatggctgttcttcggggaaaagataatttgctcctgacagtcatacctgaaacaatcaattaaatatcttgttttaaagtgggattatctaaaaaaaaaaaaaccagttatatcacgtggtttgtattggagatgtgccaaacatngcaagaagtttttggatctttttcttacaaagaaaaatggatggttatcaacccaaatgcccatcaatgacagactggataaagcaaatgtggtacatatacaccatggaatactatgcagccataaaaagcnacagtcctctgcagggacatggatggagctggaaaccattatcctcagcaaactaacgcaggaacagaaaaccaaatactgcatgttctcacttataagtgggagctgaacaatgagaacacatgaacatagggaggggaacaacacacactggggcctggcagtgggtagggtagagggagggagagcattagcaaaaatagctaatgcatgctgggcttaacacccaggtgatgggttgattgataggtgcagcaaaccatcatggcacacatttacctatgaaacaaacctcacatcctgcatatgtacctcagaan

SEQ ID NO: 588685 - DNA, 1521 bp, Homo sapiens
gtctctcatttaggagggtttgcaggtccagagtaaagtcactgaagagtggaagcgaggaaggaacaggatgattagacctcagctgcggaccgcggggctgggacgatgcctcctgccggggctgctgctgctcctggtgcccgtcctctgggccggggctgaaaagctacatacccagccctcctgccccgcggtctgccagcccacgcgctgccccgcgctgcccacctgcgcgctggggaccacgccggtgttcgacctgtgccgctgttgccgcgtctgccccgcggccgagcgtgaagtctgcggcggggcgcagggccaaccgtgcgccccggggctgcagtgcctccagccgctgcgccccgggttccccagcacctgcggttgcccgacgctgggaggggccgtgtgcggcagcgacaggcgcacctaccccagcatgtgcgcgctccgggccgaaaaccgcgccgcgcgccgcctgggcaaggtcccggccgtgcctgtgcagtgggggaactgcggggatacagggaccagaagcgcaggcccgctcaggaggaattacaacttcatcgccgcggtggtggagaaggtggcgccatcggtggttcacgtgcagctgtggggcaggttacttcacggcagcaggcttgttcctgtgtacagtggctctgggttcatagtgtctgaggacgggctcattattaccaatgcccatgttgtcaggaaccagcagtggattgaggtggtgctccagaatggggcccgttatgaagctgttgtcaaggatattgaccttaaattggatcttgcggtgattaagattgaatcaaatgctgaacttcctgtactgatgctgggaagatcatctgaccttcgggctggagagtttgtggtggctttgggcagcccattttctctgcagaacacagctactgcaggaattgtcagcaccaaacagcgagggggcaaagaactggggatgaaggattcagatatggactacgtccagattgatgccacaattaactatgggaattctggtggtcctctggtgaacttggatggtgatgtgattggcgtcaattcattgagggtgactgatggaatctcctttgcaattccttcagatcgagttaggcagttcttggcagaataccatgagcaccagatgaaaggaaaggcgttttcaaataagaaatatctgggtctgcaaatgctgtccctcactgtgccccttagtgaagaattgaaaatgcattatccagatttccctgatgtgagttctggggtttatgtatgtaaagtggttgaaggaacagctgctcaaagctctggattgagagatcacgatgtaattgtcaacataaatgggaaacctattactactacaactgatgttgttaaagctcttgacagtgattccctttccatggctgttcttcggggaaaagataatttgctcctgacagtcatacctgaaacaatcaattaaatatcttgttttaaagtggg

SEQ ID NO: 588686 - DNA, 279 bp, Homo sapiens
cgtacccggtgcatatgtagaacatcagtcttgtagctgtagtcaggacccaccaagccactccattctcttctcagctcccggagtgtgatggttaatattgactgtcagcttgatgaaattgaaggatgcaaagtattgttcctggtgtgactgtgagggtgttgccaaaggagattcacatttgagtcagtgggctgggagaggcagacccaacctcaaatctgggtgggcaccatctaatcagctgccagcatggttggaataaaagcaggcaga

SEQ ID NO: 588687 - DNA, 436 bp, Homo sapiens
acgatgacgagtctcacggactgacctggttctgccatcagctcgctgtgtgatcttgagcaagtcactttcctctctaggccttagtttaccccctgtgtaaaacgagggtttcgtcggcagatgtatgtacaggagttgggtcccagctgttgtctgagatcttggacaagttcttccccaggctgagcctcagtttccatctctgggccatgaagtaattgaggtgctcgttgaggccccggcctgctaaattgaggaggacactgtgtgtgtgtgtgtgtgtgtgtgtacgtaccatgaagtaattgaggtgctcgttgaggccccggactgctaaattgaggaggacactgtgtgtgtgtgtgtgtgtgtgtgtgtgtgtaccatgaagtaatagaggtgctcgttgaggccccggtctgctacatagagg

SEQ ID NO: 588688 - DNA, 354 bp, Homo sapiens
  misc_feature (354)..(354): n is a, c, g, or t
ggcatatgctatattatccacgctggtctagaactcctgacctcaagtgatcctacatctgagcctgacaaagcgcagggattacaggcgtgagccacagacgatggccttaatactctgcttagagacagagtctcactgtgttgccaaggctggtctcaaactactggcctgaagtgattctactgtctcagcctccggagttagcgggattacagacagaagccacaacacccagactcctcttacttttaaatacattctttacgtgattatcctagagtatgaacccagtatgttgcatggtcttggatatgatgttggactacttctgtagcggctttatttatattn

SEQ ID NO: 588689 - DNA, 365 bp, Homo sapiens
  misc_feature (41)..(41): n is a, c, g, or t
  misc_feature (90)..(90): n is a, c, g, or t
  misc_feature (155)..(155): n is a, c, g, or t
  misc_feature (222)..(222): n is a, c, g, or t
  misc_feature (322)..(322): n is a, c, g, or t
  misc_feature (340)..(341): n is a, c, g, or t
  misc_feature (362)..(362): n is a, c, g, or t
gggcacagggcagagttagaaggtatcccaatcctcagggnacgaaataggccctgaagtttaaaggcaggcccaggcacagtggctcanacctgtaatcctagcactttgggaggctgaggtgggtggatcacctgaggtcaggagtttgaganaagcctggtcaacatggtgaaaccctgtctccactaaaaatacaaaaattagccaggcatggtgcanacgcctgtaatccctgctacttgggaatctgaggcagaagaatcacttggaccgggacggggaggttacagtgagccaagatcgtgccactgtgctccancctggctaacagaacaannctccgcctcaaaaaaatttanttt

SEQ ID NO: 588690 - DNA, 1356 bp, Homo sapiens
  misc_feature (1355)..(1355): n is a, c, g, or t
acaaaacaccaaatggcggatgacgccggtgcagcgggggggcccgggggcctggtggccctgtggatggggaaccgcggtggcttccgcggaggtttcggcagtgtgcatcctggggccgcggctcgcggcctgtggcacggcggcccggggcctgaggccgcggagctcgcggaggccaggccgaggataaggagtggatgcccgctcaccaagttgggccgcttgcgtccaaaggaccattgcaaagactccaacagtccctgcgcaagcgacggcatctaactctcgtatcatccccatgcccccattacaggaaatcagaagatcatctgactttcttccccttggcgcgcggcctctctccaagggaatcgacgcgtccaccggaacgaattcaattgcccaagctggcaccgaaaagcgcaggacacccccgttgaccccgggacacaagagaggccaacccacggggtttcaccaggtggcaataactggtacggcactaatcggggggggacctttacaaaagtgaggaccgaacgacttcgagcgctaccttgggcggcatggttaacaccgttggcctccgcacacggcggggagcggggttcgggcgccccacacctgggacccaatttcccctggtagggagaggtggacccgaatttctaattacccctttgtggggcccaaacaggtcatttctattccccatgtaccggttacgccgcccgcggaattgccctgcccagcacgaaagatgggacatacccctttggagagcaggcggaaccagcgacagaggcgaaacttccgaggccaaaaccgggaccgcactcaccacgacagcactcgggacagacgcacttcatggacacacgggggggatgcggaacgaaaaccgtgaggcccacggcgctttgcgatcagaggactttcactctggcttagcccctatgaggaggtccacgcgcagccgccctatcaaaagttaccaccacacttatggccaagacccacccaacaggtgcgagcgcagacaaacctctcaggcgcgaccgagcttacgaggtaccccttcacccacgtgacgacaccgcttggggttcaggcccaccatcatacagtcgacaacgaccggccgttatagggacatcacccacgttccggaccaactccggcgcccttcgagcgatcccactcagcgcgaccgcgccagaccagccgtatcggaccgttaacgcgaacggccaccttcacgataggtgcccactggtgaggagagcaaccatgttgggcacagcattcgtttggacgacgatgcagcactcctgctgtgtggtagcggcaanc

SEQ ID NO: 588691 - DNA, 289 bp, Homo sapiens
  misc_feature (170)..(170): n is a, c, g, or t
gagtgcatggctgatataaggtgtagcatgctagcagccactgaggacaacttgcattgcagctaaaatgactctatgtcggcaggcgtgtgcttacgctataatactagcactttgggaggccaaagcgagcggataggctgaggtcaggagttccagacaagcctggncaacatagcgaaaccccgtctctactaaaaataacaaaatctgctgggtgtggtggtgcactcctgtaatcccagctatcctggaggctgaggcaggagaattgcttgaaccttggagg

SEQ ID NO: 588692 - DNA, 569 bp, Homo sapiens
ggggaacatcacacaccggggcctgttgtggggtgggggcagcggggagggatagcattgggagatataactaatgtaaatgacgagttaatgggtgcagcacaccaagatggcacatgtatagatatgtaacaaaccggcgcgttgtgcatatgtaccctagaacttaaagtataatttaaaaatatatatatacatatataaagtatatccttagcacttgattgtgcgtctggcacacagtgggtcttcaatgaggtttactgaatttaatggagtgaaatcaaatttaactctacaagatataaaatgcctgacaaaatctgaaccactcgtgtgattacttaaagaccatcccacatagaatcagtcacctgtgttcatgttagttaaggaaggctctggtttaattgagccacaagccccttagagagtagaaacacagcaaaggtgcacgctcatcaggagagaacctgggataaagaagtctgattttgcttacactcaaataggaactctaatattaactctctctttctagcaaagtcactccatttctctgagttatc

SEQ ID NO: 588693 - DNA, 156 bp, Homo sapiens
atacttaagttagaaattcgaactatgaccaatacataagagaaggtaataaccctcttctgttctctgtcccagctaatattgactattgcaggtctcctcataatgttcatccatttaaaactccataaagcatcagtatacctgggactgaca

SEQ ID NO: 588694 - DNA, 382 bp, Homo sapiens
  misc_feature (13)..(13): n is a, c, g, or t
gaaagtagttttnagatgtgatgccagtgtgctccagaaagtgtaaggggtctgtttttcatttccatggacatcttccacagcttcacctgacaatgactgttcctatgaagaagccacttgtgttctaagcagaagcaacctctctcttcttctctgtcttttccaggcaggggcagagatgggagagattgagccaaatgagccttctgttggttaatactgtataatgcatggctttgtgcacagcccagtgtggggttacagctttgggatgactgcttataaaagttctgtttggttagtattggcatcgtttttctatatagccataatgcgtatatatacccatagggcctagatctatatcttagggtagtga

SEQ ID NO: 588695 - DNA, 203 bp, Homo sapiens
  misc_feature (1)..(1): n is a, c, g, or t
  misc_feature (28)..(28): n is a, c, g, or t
ntcgtgttgcaactatcgttagtagtancccgctgagctttacaaacccaccaaaggttgggaagaacgacctcaaaagataggaccaaccggctctgggccacttctacatatcccacatagggctattccaacctggagacaaggaatacagagaagagtatgagataatcaaattgctactcagctgataacaatgctaa

SEQ ID NO: 588696 - DNA, 179 bp, Homo sapiens
  misc_feature (9)..(9): n is a, c, g, or t
agtggtaangataggcattttccccttttttagggctgattaatattccattgtataaaataaacttttaaaaaaccaccatttctttatcctttcatctgttgaatggaccaaccaaagggggtttaattttcacatcttgggggggggccttaattgcttggaataatgctgcaatg

SEQ ID NO: 588697 - DNA, 497 bp, Homo sapiens
ctgtgtctaaatatcaaaagatatttgtgaggaggggggaactctgcctgcctccttccctttcttagtgaatctgccctgaactgttttagcacagctttgaaatatctcctggggtccacatttgaataattcaattcagttgtaattgagtgcctactataagctgggtgccatatggccatggcatgatggtgtggaggggatatgtgaagcacacgggcagcagcttaagtgcatgggagcttggctcagccggggatggcaagggggcagcagacccttcctccaaggagggccggcatccagaagcagtcacgagtgccgtgcctcacgcacctgccctgtgccaggcatggccccctgccccgccgtctcttcattcccatgcactctctctaccatgtggagctctctagtttcccacaatttacgagagaaggttccttttctagtcaaatgattattcagatcagactaagcaatggctagactgc

SEQ ID NO: 588698 - DNA, 609 bp, Homo sapiens
aaagtaggctaggtcgaggctgggtgttgggagagggaccagagagcctagcagccacgcgcgcggctagttacatcacaccccgggaggagccgagctgcgcagcggcccagtcaccatcaccgcaacatgagcagcgaggcgagacccagcagccgccgcgccaccccggtcgtccccgccctcagcgccgcgacaccaagcccgggcactactgggcagacggcgcagtggacgcggtggcccgaggcggggcctcacattcgtgcggcgccctgccggcgtggcacacagacaggtcagtcagcagacgcgaagcgttatcgggcgaccaggctaaaacatgggttcaatgtgttaacggaaacgcgattattgcgtttcagtccaaccagggactttgaccaccgcagaggaaagcactgtattcgggtaccagccaatggacgtttggccgatttactagtggcacatgactgttaagcgcccctcagtcgaaatgttacccttttcggacaagattggttagggggaagatctggcgcgtaagcacttggttgagagcgtttcgggcttggtcaggtttggaatcgtgcgaaccaagcgtgg

SEQ ID NO: 588699 - DNA, 947 bp, Homo sapiens
cgcagccagccaagttcgacgcaagcggagcaggctgtgggctgtgggagctacgagcacggaggaacggagcacacgacctctacactggacaccggcgaggcagcactccgcttccgggctggtggacgagcagctctcgctcgacacgtcccccacagggcccagcctcagcagactgccaccaccttccagctgacggacgctgccaacagaacgcgacggctccgcctcacacgctctgctggcgactccactcagctgagccaggccctggcgccttctctcctggtggaccagcaactagccctggggctggacagtggaccctaccagcctgcgggcaaggtggtatggccggctgctgaagacaacagcagctgaggccgactgctaaggacgatagtgtctcgcagctggacagctgcaggcaaggccaggagtgcccaccagccttgccccgctcctccaccatctaggccctgctcctccttcactgcagtgactggatccatctgctggctgctggctgtcgggcctccactgaccttgactgacaagacccttcctggaccctggcacttgacaacaaacgggccacagacccccaactcacctcacagaacagtcactgggttcgggattctcgtcttcccctgccaggacccccccggttctctcagaatcccttcagccccccaactgccctgatccggccaggacgaacacttcgcactggggagccctggccctccaccactacactccggctgcctgcagctgctcacagcatctggaacccaaatccactcggagcacggggccaacaacgccccccagaacccccccacacacccacccacccgcgggcaacgcggcaccgcccacccccggcccccctggaccgccccctcctgccggctgacaccatggcccccccgccaccc

SEQ ID NO: 588700 - DNA, 149 bp, Homo sapiens
cggccacagctttctcggctgcacatggttctcgaggcggcccagggtaggtgtgcatgtcgtgcgtccatctcgccgtgcccagcctgtgagccgtcgttctactgttgtcaaggtcggcgatggagccggatcaggtcggccagcct

SEQ ID NO: 588701 - DNA, 851 bp, Homo sapiens
gttgtgcatatagctatagtttattcatttttaatgctatataatacttgcacaaatataccacaattaaattttccattctgtcatgctgtgtatggaaatgtgcctgtttttgctctttttaaagcaatgaagctattaacattctggtcactatatcctgctgttcgtatatgtgagtcctgaggttacgggtgtgggtgtacaatgttttagtttgtcttttttaaatacggtaaggcagaaattcctgatcatagagaaggtgaacgctcaagttaacttaccaactctcatatacccactagcagttcatgtatgttcctgttggctcagatgtagatgttcactaacatttggtataatcaatcttcttccatacttgggcaacctcgtgggtgtatcctgttaacttatagggatctgagaagcttttcctacgtaccagttaggttgagcccttcccatatccatcatttagcattcagctatggtgaagcactgtgtagagtctctcctattttcttttgtgggtaattaacactcattttctccttgtctaacaacagctcattataattatattttacccaacagagttcactctggtcagcttcaggcaggcatgcacggctggactcaggttgtgaacccctgaccccagggcaagcgatctcctgctcagcccgaagaagacgaatcaaggatgccaaaagccggaaatcgataacgcaaaaggagcccagagcgaagcaaaccggacaaagaactacgcccaagatactaaaagccgtcggagggaaaccgacctgtcccattggcaaccgcaaaagcacatccaggaaaaaaag

SEQ ID NO: 588702 - DNA, 969 bp, Homo sapiens
cggacggagccatcgcggggcgaaccggcgccccgcccccgcccccctaggagcgatgccggaatataagctggtggtggtgggcgcctgggcggtgtgggcaagagtgcgctgaccatccagctgtatccagaaccattttgtggacgaatacgacccactatagatggattcctaccggaagcaaggtggtcattgatggggagacgtgcctgttgtacatcctggataccggcggcaggaggagtacagcgccatgcgggaccagtacatgcgcaccgggaaggtgcgttcctgtggtgtgtttgccatcaacaaacaccattgtctttcgaggacatccaccagtacagggagcagatcagacgggtgaaggactcggtgtgatgtgcccatggtcgctggtggggacccatgtgtgacctgtcctgaacgcagtgtggaatctcggaggctcaggacctcgcccgaaggctacggatcgcctactatcgaagacctcggcccaggaccgcgcagggaagtgaaggatgccctttctacacgttggtgcgtgacgaatccggcaggcacaagcctggggaagctgaaggccctccatgattgagaaggtggccgggtgggattgaggcggaagtgttgtgttctccctgagggccataggaggtcaggacttgggggtcccgaatgccagggaagcacggtgcacaggaacgggggagacaggaaggcggcaaccacgaagggaaagaagcggtcgttgagccaagtaccccgggaccgttggcccaaggggacttggagacctcccaagggggggtggtggccaattgtttagagtcccaaatgcgcgaagccaaggcttagtccctccaggcctgtgggcatcgcgagagggagtccgcccctttcttgggcgcgcaacacacacatcaacacaaaaaaacacggggccttgggggaggaagg

SEQ ID NO: 588703 - DNA, 159 bp, Homo sapiens
  misc_feature (154)..(154): n is a, c, g, or t
  misc_feature (156)..(156): n is a, c, g, or t
atgtgtggctcctccctttaaaaaaagacttgctgcgggctggagagttctgagattggaaatcataatgcattcaggttcttgagaaagtaccgagaaaaatattgtactttcaatgatgatattcaagggacagctgcagtagctctagcangnctt

SEQ ID NO: 588704 - DNA, 329 bp, Homo sapiens
agaatcgagctcggtccgattatgctcctagacggaagagctttatagttttagctcttacatttaggtcttttatgcattttgaattaatttttatatatggtgttacataaaggttcaatttcattcttttgcatggatatccagtttcttcaatgccatttgttgaaaagactatcctttccccactgaatgatcttggcacccttgtcaaaaaacatttggctatgtatgcaaacatttactttctgggctctatattttattccactaggtttctatttctttttgccagtaccagtactggttttggattaactgtagacttt

SEQ ID NO: 588705 - DNA, 287 bp, Homo sapiens
  misc_feature (39)..(39): n is a, c, g, or t
  misc_feature (65)..(65): n is a, c, g, or t
  misc_feature (230)..(230): n is a, c, g, or t
  misc_feature (257)..(257): n is a, c, g, or t
  misc_feature (284)..(284): n is a, c, g, or t
atatggtctacctacattaatagatttttggatgttaanctaaccttacatcccctgggataaanccctcttggtcattgatatggtttggctctgtgtccccacacaaatctcatcttgaattatactcccataattcccacgtgttggagggactggtgggagataactgaatcatgggggtggtttctgccacactgttcttgtggtagtgaataagtctcatgagntctgatgatttgataaggggaaacccntttcacttggctcattctccccctctncct

SEQ ID NO: 588706 - DNA, 689 bp, Homo sapiens
  misc_feature (316)..(316): n is a, c, g, or t
tggtgtgtaacgtagacaagaataaatgataaaccaatcaagaaatagtaagctacaatcttttcagagcaccaagtctacgaagaaatatacgcataacacattcagagagacgaacaacaaagttactaagtggggggcatgaagttaagatgtagagttggtattagtcttgtagtccgttaatgcaaacagtgttaccaggttaaaatacatgggttcacgaaatagtatttgtgatccttatggtaacctcaaaacctaaaatacatacacgtggatacatagacgaagatattcagagcttaaaaacctnaaatcatatctaccagaggcaatagctagccttccctacataggaagaccaggacagcaacacgaacagaagaagaccagcaaaatgaatctagaaacaccaagatagaattaagcaaggccaggagtccgtcgtttacttatcggatacatccatttgacttggcacactatggagctatgatctccaatcaaaaagacatagactgggctgaatgacatgcgagaaaacaagacccattggatctgtttgcctacaagaaacacacttaaaactataaagacacaccattaggctgaaagtaaagagttggaaagagttattccatgccaatggaaaccaggaaacaaccacggctgaataaaaccccacg

SEQ ID NO: 588707 - DNA, 1012 bp, Homo sapiens
agcgggaaaacctgtccatgcctgaagcagcttgaccccagcaaacaccctgcctccatggagtgaactgcaaatctccaaaaaaaaaaaaaaaaaaaaaattcttatttccttaccccttcctgtgctcccctggtggggcagggacagcagggttccctaaaacttgacagtttcgcctccagtgatctttaaaagagcagaagctggcttgtgaggcttgcagtgcttgcctcgatgggggtagtgtggccctctgtgcgcaggctggggcctccaagggaagacgccacaattgggcctcttagatgagagaagggacgccttaaaattttgaaaaagatttcggcaaaagagggcgcttctcttgtaccgccatgtggcttgacacacttggtgctcggttccctttcgcaagggtgaacactttgcgccagttctcatcccctttggccaagttataaaacccttagaattttactttttgtgtgaaacacacgacacttttacggtctcaggaaaaccaagggctcttctcggaaaacaccgtggtgacgtgttgtttaggagcattaaaccgtggattttcgggaagtggactcttttaaggcgtgaccaccagggcggtggacagttgtcccccacttccgagaaaacaccgtgtgttctttgatcaattaaagtggagcctttgcgacatattcccccgccaacgtggcgtgtttgcccaacaatgctgttggtttgtattgcacgccgcccgccgtttgaccatattgtttggccggttggtgtgacataactggggggcataacgcggcgtgtgcagagacgtttttgtggccctctacaactcctcgaagtgttgtcctattataagcccaattgtgccctttctccttattcttgggcgagcctcctttctctccgggggggcccccgcggtctcctatatttgggaaatcccccctttttatagtctacagcttcttaatcaggggtcccatctgcc

SEQ ID NO: 588708 - DNA, 106 bp, Homo sapiens
gaccccgacttcaagtgatgggtggtgggtattgtggtaaggatgatggtgatggtgatggtggtggtgatggtgatagtaacgatgatggtggaggtagagatgg

SEQ ID NO: 588709 - DNA, 938 bp, Homo sapiens
  misc_feature (914)..(914): n is a, c, g, or t
cgcgctctcctccgcgttcgccgccgccgtcctcccgcggcggcgcgcgccgcccggggcggccggcggccgcgcccctcgcctgccccggggcgcccccctgtcctgcgcccctctggtgccgccccctgcctgtcccctccgccccgccccccctggcgtcccgcgggccgtccgcccgccgccccccgcccgcccccccggtgcccccggtcccccccgcggccccggtccccccggccgccgctgggcccgcccccttgcccccgccctcgccgccggcggccccggccgcgccgccgccgccgcccgccgccccccccccggcccctgccccgccgccctcggccccggccgcccctgcccttctcccccccccccgccccctgccgcccgcccccccggtcccccgccgtcccgctgcccccccggcgcccccgggtcctggggccggggcggcggccgctgcggctgcccgtggggggcctgggggccgcggtcctggtcctgtgcgcccttcccccccctgctggtggctgggggtgtggccgtggccgccctcgccctgcttctcggtgtggccttcctggtccggcccccctcctccctgggggcccggcggggggcccggcgccccttcctgtcccgccccgcggccgcccgtgcctgccgcgttcccccttccctcttcgtccccccgccccttccttccccccctccctctgcccccccccccccgcgcccggtgccgcggccgcccgcgcccccccctgctgcccccggccttcccccccctcccgggccgcccgcgccccggctccggggtcccccgccccggctgtggggcgcgggcccgctggggcccggccgcccggctggccctgtgtgtggcccccccccctggcggtgggtgntctgggcccccgggttggttgcct

SEQ ID NO: 588710 - DNA, 929 bp, Homo sapiens
aatttaatgtgtatgtgtgtatgtgtgtatgtgtgtgtgtgtgtgtgtgtgtgtgtgtgtgtgtgtgtacaaacatgtatttttctgcaactctcattatgctggctagagtgatgcagacttgttcttctttattaaagcactctcaagaataagcatctctttaaaatgtttctgtgtataatctagtttattacagagtccattttttcttatcgtctttataagggttcacttaacttaaaaacagctttataaaacaactttagtatcttcgtgtcgttgctatcattgtgcctacttccctagagaagccctggctacctcgcgcattaggaccacgtcgtgggttttaagcggctctgggaagcagggttggttaagtaaagacaggaatgtggggggagaggtgagtagttcctttcctctttctcctctccaatttatgcttttaacttattttctacctggataaacttctggaacggttggcttataaatttaacttctctagttttataaggcagtttccaccgttggctgggtctaatgcttttctgagaaatgctaagcagaattcccaagctttttccagttctagatatctttactagaccttgggggactcttataatggagctgctttgttgaaaaagccactttaattagattagtgtcattgcggactaactcacgaaggattgcccagtgagaagcttctagcgctgatctcagaggaccagagtgactggaggggtaagtgtctcaccaggcccatggatgaatttctggcctttaaacaatgatactgcgtcttgggaaaaagaggcctcatttctccgaacgagagaaagatttttccccgggtcccatctgtttgggtggcggggggttccaacggcggcacccccgttcccaaaaacggtttt

SEQ ID NO: 588711 - DNA, 580 bp, Homo sapiens
accctaaaaacccaaatttttttttaaaaaaacctcctttttatagggaatttcccctttagggaaacctaaaaataaagtggtttaaaaaaagggccccccccaaaaatttggccccaaaaggggccgttttttttgttttgttttaaagggcgggaaaaaaaaaaagggtttttttaaatccttttttttcaagggaaggttttttccagttaaaaatattaaaaatggctttttttttcccgggtccaaaaaaggtttttctttccttgttttctgggggggggtcaaaccccctccccatttttgggcaaaacaaaaagggcccgcccctctgcaaaaatgggggggctcccccattgggcccaccacctggaaacctaaaaaaaaaatggtgataaaagttccccgggggtttttaaactcttggcggctatttgggggggaacccccacaaaaaaaaaggttttggcctcttcccgcggactttgaaagggggccgccctctctcaaatatttccaccccgcctaattgtggcctaattctccgggccacaacaaataggtggcgcctccccga

SEQ ID NO: 588712 - DNA, 133 bp, Homo sapiens
cctgccggtcgagtctagcaggattcccccagttactgagctttacctatggattgtttttcttccagcctacgcagttaccttttgctatgatatattggtaagggatcagtatctattactatgttatgaa

SEQ ID NO: 588713 - DNA, 119 bp, Homo sapiens
cattgtcaaaaacaatggagagcaactgaatggacattataactgcataacagtagaaacaagcagaagtctgacagaaccagggaaataaacaatcaagaagagtcctcctaggatta

SEQ ID NO: 588714 - DNA, 1153 bp, Homo sapiens
gggtcactgtggagcctcgtttcgctccctatacctgtgcccgaaagcgtgccgcggagtcactccatacgaggacgtgatctacaggccacctgctgtatgactatccacacggaactgcgcgcgtgtgcggaggcagatcggaccattagtgcgcgcgaggcaataagggcgttccgcatacagatgatatgcaggggttagtgtcccgcatctagagttcaagcgtacatacagaggagtgcccaagtatacgagtgctatttcctatcaaggactggagggagccaggcatagaagtaacacggaggagatcccagtgtatcgttcccttggagggctcatcacgcacatgatgtggactcgagggcaacaatcatataagaaacgctaccaatcacagggagcactccttagacgggaactatagcctagacacgcgtggacggcccactaacacgtaaaaggacgtcgatcacttcatcccttctcctctgctccaaatcaaggcgtcgtaggcaacgaatccggacacctgggacaattctacctaaacaggagcctcttcctagcgcggaagccatcgacacggacgagttcatcatcgcacccaatgtcgtgctcatgtgatgtatgcgaaagttcccaagtccagggtgggcacctggcaaagcctgtacctgcgagaagccgacatggcagaccaaccagacatagggccaaatatcgtgcggaaaggcttggtgaaccaaacactccgaaagataccccataatgacaaagacattacacaccattataaatagccacacaaatacaagacaagaacgagaatggaacgcaaacaatcaacacggagtgcctaataaaccacggtagacaagacatcgacacaatcaaacagacgaatacaccaccatgtagaccccactggggacatcgagcaccacacggcacagaggccatgggccgcaaagagacccgccgacgggcacccagccacgacaacacggaaacagacacaccaccaagcggctaaacgcaccgcaccagcacagacgcacaatagacgagcggtcccaatcaccagggcggagtagaccacaacgcccagctccatacccaaggccactccaagcaaagaccacacacc

SEQ ID NO: 588715 - DNA, 240 bp, Homo sapiens
aaagacatccatgatcctaccttagtgtgagttactcacagtggctatacactctcccgactcctcatcaataattatctgcagtatatttttctttttttttagacagggttttactcccgtcacccaggctggagtgcagtggcacaacctcagctcactgcaacctccacctcccagactcaagcaatcctcctgcctcaaaaaaataaaatacagcagttaagctaaacctctttg

SEQ ID NO: 588716 - DNA, 213 bp, Homo sapiens
ccaaaattggcccccgggaactttttagcttgggggataaaaggccgaacctgggatttttgcctcccagggccaaaaaaatgttttccccccaattttggctgtccatttttaaagggccctgggggggggggaggggggcggggtgggttccccccaaaaatggggtttattaataaaaaataaaaggggggaggggtgtttttggtttta

SEQ ID NO: 588717 - DNA, 182 bp, Homo sapiens
  misc_feature (24)..(24): n is a, c, g, or t
  misc_feature (27)..(27): n is a, c, g, or t
  misc_feature (35)..(35): n is a, c, g, or t
  misc_feature (52)..(52): n is a, c, g, or t
tcccagttctgagtccagaagtanccnaggcattnactacaagcagctactnttactaacatgacaaaaactagccccattatcagtactatgccaaatctcacaatcaatcaacccaaacctaatactaactatagccatattatcaacttttaatccggagggcgtaatatagggtttca

SEQ ID NO: 588718 - DNA, 405 bp, Homo sapiens
ggatggtgtcatgaattctaaaaggctttatcaaagtgggtgggattccgagtcaggaaagggcctttatagacacagggaccaatccaaacctgtgcaggagtccacacaggtcagatgtgggacagcagagcaaaactccagctgggaagacctctagccccacctgttttgcaaacgggaaaagagccccaggagtggctcccccacggttgagaagttaactcagccccggcttcacaaaccccacgtgcagtatggcagttagtatttttgggcaccacctttcgggtgtacctgtctcctatacaccttgtgccaataggcacaaggcaagtctcttgcccagaaccagtggaaagcaaatgaattcgttagcctttacaaaaaacacctttttttttc

SEQ ID NO: 588719 - DNA, 136 bp, Homo sapiens
gatccagtggcaccgacaataagcatacagcaagaatgcagatgtgtgagatctcatgactgcaggtacacctgtctcaggtgatggcagctccaccaggaaccagttctctctccctgcagcgtaccgagctcga

SEQ ID NO: 588720 - DNA, 540 bp, Homo sapiens
agcgggggcgggctctctgacgaatgactggaaggtgacggctggtgacctgtgcaggccgttggtgcgagtcagaggcaggtgactatgaaaggcttatagttgcgcgaacacgagttccagcatgaatcatagcgagtcgagatgtgagaggtccaggacgccggggccactccccgtgtgagtcgcaggagaagcatggagagaataccgaaagatccatgagcggaagccgtttcgagaacacgcaggaggtgatgtcgtgaagccgagacacgtgacgccacgagaaatgagagaaatgtcggcgacgacagggtgccagtcaagccacacgtgttgggcagaccagaagccgacgataagagacagggacacagaaaggtacattacccgacactgtctcccgagataaagacttcatggggcaggtgaaacaacaatgaacatcaaccgccaaattactcaactgattccattcaactgagaggaacactgggggttgaccaacacgtggagcaagagtcgcgcagagaagac

SEQ ID NO: 588721 - DNA, 267 bp, Homo sapiens
atcaatgacaatatcacgagagtaaaaagataactcacaagcctgggagaattatatttacaaatcttacatccaataagggattaatatccatactatataaagaacttatacaagtcaacaacaacacaaaccctgatgtaaaggctaggtacagtggtccatgcctgtaatcgcagcactttaggaggccgagatgggaggcatcacgttgagcacaggagctcaagaccagcctaggtaacatagggagaccttgtctttacg

SEQ ID NO: 588722 - DNA, 115 bp, Homo sapiens
tggagccgctgttattgctgagcacctgcaatactacctactcgggaggctgagacggacagattgcctaagtccaggaggctgaggctgcagtgagctataatggggccactgc

SEQ ID NO: 588723 - DNA, 202 bp, Homo sapiens
atcggcgctggaacttcacggttagtccgaggaactgtacgggcacgagctgtgcgcgcacgtcgtcttcgccggaaccgaaagtggttttgaatagagcttcggagcgcaggcggcccggatcccagttctggcgtgtttcggggagcggcgttgcgcccgtcaggtagggatacatgagcaccgagctcatatccatgtc

SEQ ID NO: 588724 - DNA, 169 bp, Homo sapiens
gatcgggtggtgagagcgctgcggtcaggtgttaacttgcgcagtaggtcagactcgtctagccggacggcggggattcagctgagcgccacctgtcggctgtacgctgctctagagggggccgtggagccatgcagaagacgtgaaccccaggaagaccgcagaatgc

SEQ ID NO: 588725 - DNA, 223 bp, Homo sapiens
gcgtgattccctggacaaacttcttgcagaacaacttttggactttgccagtttcaaaaggtttcttgaaggtttgaatttcaagttgaggaaaacctttgaggtttttggatttgccctttgagggatttacaaagaagatctaagtgtcccctctgccaaagatgggcttgagaaggcaaaagcaaaatttttttgtaagatttctattctaaacgggagg

SEQ ID NO: 588726 - DNA, 608 bp, Homo sapiens
tagggacagactctcgaaatcctgacctcaagtgatgcaccgcctcggcttcccatagtgctggaattataagtgtgagccaccatgcctggcccaggtgagtgttctttttttttttttataacacaaacagaactaggtgagccttcagggaaagaaaaaagacggggtgcttgtgtgcgtgcatgcccgtgaatgccggcctgtgatttccaacacacgcgtcctccctcctcggcctctcaaagtgcggggagccactcacgggtgtgagccaccacgcccagcagagcttcgtttcccaatcatcttcatcatctccatctctgacaccagatcagaagggtctttctcgggggcatcatctttcaacatcttcagggccagggtgaccggctcctggggctggtcttggtcaatccccactgcttccggcatgaccactggcccaaagcaaccttctcccaggggctggcccagtgtcagcttatctctgggaaactcccattgggggtcctcgggaagtccatactcggagacccctgccagcatgggggtgtctgccgttgaagagaggcgtgtggtaatcctcaccaggggggttgtgg

SEQ ID NO: 588727 - DNA, 381 bp, Homo sapiens
tctcccccttcccactgtgattggcacatcgacaagggctgtcccaagtcaatgcatcgacaaagggtccgggttagggcaaggttgtggggctcaacaagactcatagagtcaaacagttccaagtgtccacttggggtaaagccactgccaacaataccagtttatcatgctcattagtttggtatgtcgaaactcaaattaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaaga

SEQ ID NO: 588728 - DNA, 424 bp, Homo sapiens
aaaaagttaagggcaattataattccaatacattaattcagtaacagctactaaatccataatcctattagtaaaaccacagacgttgcacaatgtgaatgtacttaacactgctgaactatacacttaaaaatggttacatcgccatgcgtggtgccttacgcctgtaatctcaccactttgggaagctgaggcgggtggatcacttgaggtcaggagtttgagaccagcctggccaacatggtgaaaccccatctctactaaaaatacaaaaattagccgggcgtggtggcgtgcacctgtagtcccagctacttgagaggatgaggcaggagaatcgcttgaacccgggaggcggaggttgcagtgagctgtgatcacgccactgcactccagcctgggtgacagagtgagactctgtctc

SEQ ID NO: 588729 - DNA, 381 bp, Homo sapiens
ggatgcatccctacgcctggtcgcctgttcgggatggagtattgcctcgtgtgtctctccaggcgccgccaggacagtgggtgtccgcttggcaggcgagaccaggggacctgctcggagggctggcacgtccggagaggggacctcttcgaacgtggctgggagtccagagagaataccaccccgaagagctgggagcagggtagagaggaccacctcgagggcctggcagtctacaaaggggactggtgaacgcagtcagtattttcggatcgtcgatggcatggtccattccgagcagaaccaggagatggtggggaaaaaatgtatccatatcaccgggatgagcctcctagggctccatggaaccatggagaagag

SEQ ID NO: 588730 - DNA, 115 bp, Homo sapiens
  misc_feature (69)..(69): n is a, c, g, or t
  misc_feature (79)..(79): n is a, c, g, or t
taacatcgcatggcaggatgggtgttggaataattactttcctccacaatctatcattttaataagttntataatagtngcagttcatgggaaacatgccaagtcgtcgcgacgc

SEQ ID NO: 588731 - DNA, 422 bp, Homo sapiens
gcgtcgacccagctgcataatttacacctagtgcaaagcaaaaatgcagggccccttgtttaaaaattattaagaatttcagctgggcgtggcggctcacacgtgtaatcccaacactttgggaggccgaaatgggcagatcacttgaggtcaggagttcgagttcagtctggccaacatggtgaaaccccatctctactaaaaacacaaaaattagctgggcctggtggtgtgtgcctgtagtcccagctacttgggaggctgaggcaggaggatcacctgagcccagaaaggtggaggtgcagtgggccgagatcatttcactgcactccagcctgggcaacagagcaagactctatctcataaaaacaaagaaagaaagaaagaaaaagaagtaagaaaagaaaataccttgccttgag

SEQ ID NO: 588732 - DNA, 461 bp, Homo sapiens
atcccagcactttggaaggctgaggcaggcggatcatgaggtcaggagttcaagaccagcctaaccaacttggtgaaacctgtctctactaaaaatacaaaaattagccaggcgtggtggcaagcacctgtaatcccagctactcaggaggctgaggtaggataatcgcttgaaaccgggaggtggaggtcgcagtgaaccaagatcgcaccactgcactcccgcctgggtgacagaaaaaaaaaaaaattccaaagattacacttttaaattttacacaggacattgaatgtgggctgaaaaaaggtacaccatggttttgcagtaaccacgagagagtcaacggggtatactattaccagacaaaatagactttaacacaaaatagtactagagcacaaagaatagtatttataatgcaaagagtcaattcatcaggaagatgcccaattttaaacata

SEQ ID NO: 588733 - DNA, 156 bp, Homo sapiens
ccccccccccccccccccccctttttttttttggggttttttttttgggggggcgccccctttccccccccgggggggcctgccccttttttttggcccccttggggggggggggcttgggggggggggggtttttttttaagggggatatttata

SEQ ID NO: 588734 - DNA, 398 bp, Homo sapiens
  misc_feature (153)..(153): n is a, c, g, or t
  misc_feature (235)..(235): n is a, c, g, or t
  misc_feature (245)..(245): n is a, c, g, or t
  misc_feature (289)..(289): n is a, c, g, or t
  misc_feature (313)..(313): n is a, c, g, or t
agcttagacgatcactgggtatctgagataatactcggcttggttattaatgtttaatatattctcaactagatgcgtatggtgccatcaccaccttgatagtgtgagcattcttcatgaccacgtcacgtgcatatgttaatctcattcaangtgacatcgcagttctatctagtgtcgctctcgagtcattctggtacgctcacgtgcattgatgcgtgaacagtgtacttcnttgccaggangcttttctaatagagcgtgcgcgaaagttttggacttgtggaancgaatgatctcagtgtgcagtagntgtcgtagacttatgctacgtatacttagtgaagatatttaaagatagcaccaactgatactatataatgtaacacttcacatat

SEQ ID NO: 588735 - DNA, 108 bp, Homo sapiens
  misc_feature (69)..(69): n is a, c, g, or t
ggacagacagagattctcatgatgaagctgcagtagaggcagaagaagaagccagctacccaaagactnaaaaagttgacaacaactgttttgggacatggggacctt

SEQ ID NO: 588736 - DNA, 210 bp, Homo sapiens
gtcagaaatacaccaggtagcaagtgcttgctacaagggtattcagtcatactgcagcagacgaataaacccaacttagatatttcctacatactgtcatcttctccaaacgaaaatagtgatgcatctcccatagagaaaatcacaacacttgtaacgctataggtatctctttatattattttgggcgggaatattttccccagacga

SEQ ID NO: 588737 - DNA, 125 bp, Homo sapiens
gagtgaggcattcttgaatgacttcacagtatggttgcatagatgtttcctataaagattctgtacatgtatccataggtgaattgtcttatccatgactactacaattgtatgcattttctttt

SEQ ID NO: 588738 - DNA, 145 bp, Homo sapiens
  misc_feature (16)..(16): n is a, c, g, or t
tctagagtgatccccntagatgtaaccacaaacacaatagtgtgctcactacacccaccacatataacaacataaaaccctacatatcacactgatgtgaactgacccacctgaaggaactgactgtgtgtacctgatgcgtctg

SEQ ID NO: 588739 - DNA, 863 bp, Homo sapiens
ggcttgcagtggcccccgccatggctctacaagccctgggcctgcggtccccgccttccccgcctgcgtccctggtcgctcctgtgccctgacccacgaggcctggcggctgctgctactctggggcctgttgctgcttgtgccgtgagctgactgccaggccattgtcccgcgccgctcctgtcagccgcgccctggccgcgcgcgcacctggaaggctgcattggcgtcttgctgggctccgggccgggtgggcagtgatggcctccacagagcctgcattgtgcggcgcattgggtgagccttcctgtttagatagactgcgctgacggcctgcccctacctgcatgggcttgcagtaccggctgtgaaatgctcctgtgctacccgcgaattctgtcttcccgtgtccctgttcacctggagctgtccctctgtgaacctaagcagtagcggttccgccaattgaaacgggtctgcacctgggagcattgatgaccccaaaaggacagggacactgatgagacaagaagggaagtacgccctccgggtaccatggggtgcagacacccagaagacttcatatgccaccgaataacctaccctgaggattcaacgcggaatcggcccatgagacatagccccggtccctttggcccaacaccctcaggaccccatatccaaaaggaaacatatatctgaaaacgaacgtgaccatgggggttcacaacacgcagactggagagaaaacagcaggccataacccatacaagagcaataagccccacacgattatggagtcaggatccaaacagagggtaacaacggatacatgggaatcacgaagcaacacaatacaaagc

SEQ ID NO: 588740 - DNA, 763 bp, Homo sapiens
tgagatgttgttgttttgtgttgtttttggatttactcggctcgttgttgtggtctttatcggctgagtcactggttgcacctcctggtgcaccgccacgcgcgccgcgtgaggtgcgccgcggcgctgcgacgcggtggtagcctgcattcgtacgagtgctgcttcgtctccgggtgcgctgggagcggcggagtgcggcgaacgccggcgccggtctcgcccgctgcggctggcctgtgccgccgccgaggtgaggtgcctggcgggctgtcatcttcgtggtttacggctgccgcagcgcgtcatagggtgggctgtcgtggggggtctgtgttttttgtgctgtgttttctccgcctgcgtcctctgtgctgtgggtttggggtcgcctcgcgccgcccgccggctcggggggggcggctcgcgcgcccgcggcgccctcgttgttctctcttcttgctctcctgcgcgctctgttgtcggggtcccgtcgactccccccccgctgcgggccacggtgctcgttcggcggtgctggcgtcgccgcgcgcgccggcgggcccggctggctggctgtcgcgtccgagccgcactacacagttcggctcgcggcccggcccatccccccacggtccgcgcccgccccccccccccgccgccgcgcggcgcgcccccgcgcgccggccgcgggggggggggggggcagggccccccccccccccctcccggttgcgccgtggcgctggtggggggcggaaga

SEQ ID NO: 588741 - DNA, 422 bp, Homo sapiens
ccagttcctgcttcgaaaatattgccccctggtgttccgtacacgaacattggagagaattatatggtattgagtaaggcaatcatgacaatcatccatagtatttagggacgattgcttaggaagcttgttagcacaatcagaattctttagcccaggacacatgacaccttctatacatgctgtggtgacaatagtgataaactgtgaacagtccaactctgattgcattcctctcagaatatggaggacaggagagtggggacaatctcagcattaggactgccctctctcgttttgtttcaaaaagagtttaagtcacttagaaaatacatataataagtgtaaaaaaaaagggaaattgggccacgggaacatggcgagcaatgtccagtgaggtcaggatcgaggtcagtatgtgg

SEQ ID NO: 588742 - DNA, 254 bp, Homo sapiens
gggggggggtttttttaacccaggcctttttttttaccccccggttgcccggggggccccccccccctttttttttcccccttaaaaaaccccgggggggttcccccccccggtttttttttttggcccgggggggggtaccttttttcccccgggacccctttttccccttgggccctttttggggccccttttaacccgtttttttccaaaaaccggggggggcccgggcgggttttcccggggtttgggga

SEQ ID NO: 588743 - DNA, 1028 bp, Homo sapiens
cacgcgtaccgttgcctttctgctcccgcctatatgcttccagagcttctttcaatggggtaattcagcggagtatagacacaggtatgagggagaggtgacggacggcagtgctagatatagatagagatagatagggaacctggaaggacagctgggtacggtatggggcatgcttcgagggccactcgcagagcggcagccatcagagacccacaagcaaagaacaacaacaaggagaaaacgccgacaaagaaaaaaaccacacaaaacaatcaagaacacccacacaacagaaaagccggaactcacaaacgcacaacgccggaacaccaacacacgcgcaccaccgagaacccaagccccacgaaccacaaacaaacacacaaccagcaacgaacacacacaacggacaacaaacacaaaaagcactaaagacaaagacccaaacaaagatactaacaacaagacacaacacaaccacgacgcatacacagccaccagtaacacttcaacatgacaaaccaaaacaacataccccctaaagagcatagtgcagcacgacagtatcacaacaacccagcacagaagccacacagacccaccaaaagacgaacacaatagaacgccgagaaaacaggtacagcaccagatacaccagaaaacgcacaagacgagacacaacaacagtcgacccagcgataacagaaccgcaagcacgacaagcataacagcaccgcgactcacacccggcgaccaaacacaacagaaccaccatctaacaaacacagaggcgcaaacgacgcaagcaccaaacacaacgaatccacatgaaaatcaccaggaccacacaaacacgcatcaaaccacactgaccaaacacacagaatgcaccaacaacaaacaaacgaagcaggaaagacaacaggccctcacacaagagaacataacgaagagacaaacacatcaagacaacaaaagagcacaagcccaaccgcacgcacaaccacaacaaggaccccgaaaac

SEQ ID NO: 588744 - DNA, 227 bp, Homo sapiens
  misc_feature (123)..(123): n is a, c, g, or t
tcccggtctagaatgccactcgcgaactctggccgaactatgacaaactgtggagcaagctggtgtacgctcgtgtccatgctccgagatactgcccacggctgtcatcagctgtctcaccgngtgtgtagctagtttcttccatccttctcccgaggtagcgctgtccttcacgcgagtatccgacgtctcagatcttccgctaaatctctagttctatagcctga

SEQ ID NO: 588745 - DNA, 244 bp, Homo sapiens
tggcgaggctctctacctccggaaggtagtccagtgaacgggaactctacccacctttcccccaaaaggggagaggttgggtgcagataaatctggcagcgtggtttggagggaaaccaaggccatgaccaatggctcctccattatcttcttggctatcggcttagggtatagatctcttcctccgggaagggaactcctggagcacagagagggacaaggaaggtagaagccggggggtacc

SEQ ID NO: 588746 - DNA, 609 bp, Homo sapiens
ggggaaaagtatctcaggaaatgattccaaaacattttcaaaagacatcgtgtgatgctttcaaaaacagtgtcggccaggcgcaatggctcaaacctgtaatcccagcactttgggtgcccaatgcaggaggattacttgaggccaggagttcaagatcagcctgggcaacaaagcaagaccccatctctatttaaaaaagaaaaaaaatagaaaacattagccaggcttgctggcacatgcctgtagtcccagctacttgggggtctgaggtgggaggatcacttgaccccaggtgtttgaggctgcagtgagccattatcacgtcactgcattacaggctggacaacagagcaaaaccctgtctttacaacaaaaaaggttaaagaaaaaactgtttacaagaatgtgacaacaggtttggtgtgtatgtctgtgtgtggggaaacaggatgagacagcagataaagaaaacacagggaccgggcgtggtggttcatgcctgtaatcccagcactttgggaggtcgaggcaggtgaatcacgaggtcaggagtttgaggaccagccttggccaacatggagaaaccctgtctctagtaaaaataca

SEQ ID NO: 588747 - DNA, 922 bp, Homo sapiens
ggattataggcatgagccactgcgcctagcctgttgcagctttttaaagcaggaaaatatccatataaactgttgggttagaatctatattagaatctttcaaactaattgaaaacaggaagactatcatctaagtagccagataatctgggtttcacaaagttattccatggtactggtttagaaaatacttgttcaagtgtttaaatttttaaagtgtaactaattcttcaaatatgttatgctgttaaaatatgtattccataagtacttttatgtatatgtattcttagacttttagaaaagtcaagctgaactgcgcacaacgatgattactaacttctgggactgtacgaccatttaaacctagacttcccagttcctcgtccttgcaaaagcttggatctttgttttttcctactagggacacaagagtcaaaagtaagttccatagtaactatcctcaaagtagctattgtgcttgtagtaaatgaccggttggatgcgatggatactgacaatggtgagcaggcatttcgaagcctttcaaacttagtacttttgagtcgtcttgccttagttaaagattaccgttaattttacgcatagaccaattgtcgctgataacactgtgtgtctcgatggatggctttcatagcacaccggttacaccatattcttatccaaattcccccctttttcgggttcccgtccccaattgttccttaaacatcagcgactcaaccagtcaatccatctaacacacctgcgactcaggatgatccaacccgagcgcattgaaccaacagattcagctaagggtgcacatgcaaagaccattcttcgaatccttttacaggaaaaaccatgcttaaggattcatcatattaggaatgttattcctttaccattgggactattg

SEQ ID NO: 588748 - DNA, 334 bp, Homo sapiens
  misc_feature (166)..(166): n is a, c, g, or t
  misc_feature (173)..(173): n is a, c, g, or t
  misc_feature (187)..(187): n is a, c, g, or t
  misc_feature (256)..(256): n is a, c, g, or t
  misc_feature (329)..(329): n is a, c, g, or t
taaacagggttttgctctgttgctcaggctggtgtgcagtggcataatcatggctcatggcagccttcactgcctggactcagccatcctcctgcgtcaacacccccacaccccccagagtagctggggactacaggtatgtgccaccacgcccagctaatcaaanaaaaaanattatacagacagngtcttcactctgttgcccaggctggtctcaaactcctgggctcaaacaatcctcccacctcagcctccnaaatttcctgggatcataggcatgagccacctgtgcccagcaaatttttaaaatgtttttttttgttaggagncaggg

SEQ ID NO: 588749 - DNA, 359 bp, Homo sapiens
gccccccccgggggtttttgaaacctttttttatgtttttgggggggggggggggccttttttaaaaaccccccccccccttttaccggttttccgggggggccccttggggttccccaggggtgggggggggaaaaaccgggggttttttaaaaatccccctttgggggggaaagacccgggttttttggccccccttttgggggccccccttttttttttttttggttagcccccccccccccccctttggggggggggccccccctttttgtttcctgggggggggggggggccgggggttcctggggaaattttttgtttcccctttttcccaaaggggggttttttccccccca

SEQ ID NO: 588750 - DNA, 486 bp, Homo sapiens
  misc_feature (7)..(8): n is a, c, g, or t
  misc_feature (24)..(24): n is a, c, g, or t
tatttannataaataacttcagtncaattttactgtttttaatgaccaggtaattttgccgcaagggtacttaacggggggagatgaccacttgttgtcctcgggctgggaagataaatgtggctttttccacgggcgggaagggggtttgcaggtgggacacccccctagcagacctcggggcaccccgaatttaagggtcggtttacattagggagacaagtctttaaaaacggaacctgaccgggaaatacaacttttgggggttcttaccaaacaaggataccctggggaattggagatacttgggttccaaagacttccacaaaaattgggtgttttatggggtaaaggaccaaaaggccctaaaatttgtccttaacatccagtttgaagtgagccaaaaatttccgtttcctgccatggaggccaaatttgtaatcgggggatttacaaaccctttttcggcaggttgtttgttcaaag

SEQ ID NO: 588751 - DNA, 658 bp, Homo sapiens
tacttcttctttgagtttctagcccatatattcacaggcctatctgacagtttcacctgctttactcaaaaagcatctcaaagctagtttctcctggataatgggctctggctacctgcatggccacgcttacggtgaggcagatatgactagacaggaggccaggctatttctatctcacacaagatcgcctctgctcctacctgcgtgaccgacggccacaccggacagaacgcatgaacatgctgtctctagcgacagcatcagctgacgattcgttatgggggatacatcgacgccgagatccagaacttgcttgagccaagttggcgatcttgttcgcgaggagctcagcaaataccagtaatcccggggggcacattttccctagggaactctttatcgggccgcataagggttcctgtcgtcagggcgggttccccgttttccaatgggacgaagcgtgaaggaacggctttcgtgggcaaaggcgttccctttcgtgccccacgtccccgcgccggcccccggattaaaaaagacggacgcgaacgggaggaacaacaacaggccagaccctgggaggaaatctctgcgggaacaggggaaacctcacagtcgggcgggggggaaccctaaatgggggacaaagtaagca

SEQ ID NO: 588752 - DNA, 307 bp, Homo sapiens
caaacaaaatgcaagtggaagctccatgggaaggtggagtgtgttgtccgggggatctcattgcgaggtgactgggtggccaagtaactcttcactggggaccctcaaaaattaggccatgggtttgttctctcgagacaaggcagtttttccagagagtaagcctctgtattgtccaatgcgccttgttgtcctcccgttttaggatacaggggggaagcgtcctggagttccccgtatccgtatgcaatctgttgcgtctgagcgtttcggcaatccagcaacagagcaagaggcgctgtttata

SEQ ID NO: 588753 - DNA, 1068 bp, Homo sapiens
gattcctcatccaatcccaggtctcagatccggaagctgagcgtgtctgaccctgcgtaaggggaggcagagactgaactggactcgtttgggttccctgatcctttcacactcactactctcgcttgtgaggtgctgggctgggagtacttcacagagcagtataccttactaccttgtgcatatggggctcccaatgtgcccatctacacgtggtggcttacgacagggcggacgtgggtgatgcgttggagactgccctgtgagcagctcaatcggcgctatcagccccgtctgcgcttccagaagcagcgactgctcaacggttatcggcgcttcgacccagcacggggcatggcgtatcaccctgggacctgctgtttggaactgtgtgacaccacgcgtgggccaccggcggggccctggactcgcaaggggtcagtcctgtgacggccacctgaagccgggctgtgaaatccataccatatgccctaatgtcacgtgatggtcacccgatttgcagctggtgctgccactcactgagtggctgaagctgctgccagcccctggttacctcgaggcttttgcagacaatgtcctggagtccacgaagaacatgccatagctcacctctgattgctggtctagcgggccaccgaagactggtggtcgtgggatgctccagaacaccattttctttgggggctcgaaggtgcaagtagctggagtttagaagcgacgggtacccctgggtactacggctggcctggttcggtgtggcgaagtaagaaggggccccttacctaaggtaggcgaccttcattgcgaccgatgggttctcagaaaagagaagacaaccctggtgtggaaccacttctcctctatttacgtaaaaccaacccggtggttggaccacacgggcccttggggccccggaaaatcctctcacactcgcttgttggcttagatatggccaattctcttgtccttgggaacagagctactcttccacacggcccacattcccacggaatttcccatccttgaccctgttaccaaagagaattc

SEQ ID NO: 588754 - DNA, 158 bp, Homo sapiens
cgcggtggctcacgcctgtaatcccagctctcagggaggctaagaggcgggaggatagcttgagcccaggagttcgagacctgcctgggcaatatagcgagaccccgttctccagaaaaaggaaaacacaaaacaaaaaacacaaagggcaaaacaac

SEQ ID NO: 588755 - DNA, 155 bp, Homo sapiens
cacggggcattcatctcctcctcgtggttcttcttcaggtaggccagctcctccttcaggctctcaatctgcatctccaggtcagctctggcctcctccagtgcgcgcaccttctccaggtaggaagccaggcggatcgttgagatcatgcatgt

SEQ ID NO: 588756 - DNA, 732 bp, Homo sapiens
tgacgccggtgcagctggggtggtgccctggggtgccctggtggccctggtgatgggtgaaccgcggtgtgcttcctgctggagtgtttctggcatgtgtgcatcctggtggccgggtgtcgctgtgcctgtgtgacgtgtggcctgggtgcctgatggcctgctggatgctctgctggagtgcaatggcctgatggataatgtgagttgtgatgccctgtcaccaagtttggtgcctgcttgtgtcaatggacatgaatgatcaatgtccctgtgaggagatctatctcttctccctgcctattaatggaatcatgagatcatttgatttcttcctgtgggtgcctctctcaaggatgaggtttttgaagattatgccagtgcagaatgcagacccgtgcctggccagctgcaccagtgttcaatggcatttgtatgctatctggggactacaatgtgccacgtcggtctagggttgtaaaatgtgctccaatggagtgtgtgcacctgccatcctgtggggccatacatccatgtgccaatgctctccaatctgtccccgtgctgcagatggctactgtgggtgaacaaagatctggcaaggccccacacttgtccctttgcaatggttgacatgggccgctagcggctcatgtgctggtaacgccatcatccctgcacccagggggcactgggcatcgtactccggactggtgcctaagaagctgtcat

SEQ ID NO: 588757 - DNA, 328 bp, Homo sapiens
tttttttttttccgggggggggggggcccccccctccggggggtttttttggggggccccggggaaaagcccccccccccccccccccttttgcccggaattccgagggggggggcttttttttgggtttagaaatgggggcctttggggcccccccccggggggtttttctttttaagcccccttttaaaaaccccccccttttttttttttttttttgggggggggggcccaaaaaccccgggtgcctttttttttaaaagcccccttttttttggaaaaagaaaaaaaaaaaggttttccccttttttcctgtggggggccccca

SEQ ID NO: 588758 - DNA, 148 bp, Homo sapiens
cctgtggcaggtagcaaaagtggacatccctgtttacatcatctctagattactcataatacctaatacaatgtaaatgctatatacatagttgttataatgttttttattcgtatttttttttactattgttatttccagtttttaa

SEQ ID NO: 588759 - DNA, 156 bp, Homo sapiens
  misc_feature (146)..(146): n is a, c, g, or t
tttaggtaagacggtttctccatgttggtcaggctggtctcgaactcccaacctcaggtgatccacccacctcggcctcccaaagtgctgagattacaggcgtgagccaccacgccctgcctaaagagacatcttaaattacgccntttattttta

SEQ ID NO: 588760 - DNA, 88 bp, Homo sapiens
gggggaggtgaaaagggcaaaggcaaggatggtggggcccccagccccctctgttagtgccccaataaatgctcaatcatgtgccaga

SEQ ID NO: 588761 - DNA, 308 bp, Homo sapiens
gcgtcgaccagacccaatgtgggatacagacaaaggtaggcccccaaacctgacactattactgaggctatggagtgctcacaaaaagggatctatcatgactgccctctgaaagaccaaagatgcagctgcaagagtcacagtcagatatttgcatgcaaccaatggacagaagctgctgacccctttggttgaattaggggaaagctggaagaagctgaggaggagggtgaccctgtaggagacccagcagtcccatttaacctctgccccagaaatctgtcagatactggagccaccaagtcgac

SEQ ID NO: 588762 - DNA, 439 bp, Homo sapiens
aaaatttcctaccttttcaaatggaatccctgtttaaaaatatcctgttaaaaacacacaagtatctggtgcaaatgaaacctttgaagtggagtacacaatctttaaacggacagttggagatcccactagaacccccagcactgccttcgtttccgtattgctcgtctccagttcacattttgttggcccacaaggctccaccgggcccaaatcctcccccgacaaccaccattgtactcattacatatagagaaaattatgtatggctctcatggccaaatcccaggcagaaaagaggcagaaagagactcgaacaatttttcaaatgcgaataccacctaggggtaatgcacgacggtcttccagttttaagtctcaagttctccaactaaaattacttaaataaaagtaccagcctactccactcctccccctt

SEQ ID NO: 588763 - DNA, 217 bp, Homo sapiens
ccagttcggatcgtggccacaccatacccggctatttttttttgtattttttagtagagacggggtttcaccggtgtcacccaggctggagtgcagtggctgaatctccactccacctcccgtgattcatagcgattctccctgccttcaggcctcccagtagtagccgtgaattctgggggatcctgcctagagttcgactctggcagggcatgtc

SEQ ID NO: 588764 - DNA, 1173 bp, Homo sapiens
  misc_feature (580)..(580): n is a, c, g, or t
  misc_feature (1000)..(1000): n is a, c, g, or t
  misc_feature (1034)..(1034): n is a, c, g, or t
  misc_feature (1080)..(1080): n is a, c, g, or t
  misc_feature (1142)..(1142): n is a, c, g, or t
gctcactctagcgtgcggcggttgaatgaagcctcatcgtgatgcggtccggaaccggtggtgcttgcgtaaagaaacgacaggcatcaagagtgctgaacgaggctgttacattggggaactgtgccctctccagtaagcttgcgtggagaggagtatcgcggcaagtatgtctcaaggacactgaagtcctgtgatgctagtcaagtagctaccaagcgatctggggtgcgtcgtgccacgaaggtgatatgcgggacgtatgctacctttcgcctggggtctcgctatccgtccgtatgtagcctaaccctgctgttagtccaatcccatgctcgttaccaggatatcatgccatgcatgtgggcccgaatggtacattcaccacgctttggatgtccgcaccgtgaactatcggtggcagaaccgatcatgcatgactttagcgatcgagaggaggcagggatccgaactaatcgcgacggatttctccgctcatgtcaggagtttcgttgattgtgagactaaacgttgcccgggggataataccttgtgctggtggcacccttttgaaggtatntgggtcaaccgtgaaatttgtgtcatgttcattgaatgttcaactgtttgtcgccattgtttgtgtcacagtttcacagaatcacaatctctcgcactctatattgccactgtctgagggggactgtccacatggcggtgagaaataaggtgcactatggtgtccatcccgtgacctttccaagggtgacactggttcgcaagcgagactggatagggcgtgcaagtgtaatgatgcagctagaaggtacagatcttgttaactcgtcggagacagacgtgcggagttggggggttcgatgtgaagcgtaattcgttgagggcctattcgttcgagtaggaactttaccacgtggggttcgcgtcctcgtgtactctggtgatgttgacccatttcggctctaggggcgtaacgtactancacatagacgtggggactcctatagacacggttngaggtgaggccacctgtggggtgggcaccgcggggatagccgcatntcctgggcacggtttatcagaaccctagggtttctcttataagccttcgcaatttcgccgcngtttgtttttatggccccctagggggggtct

SEQ ID NO: 588765 - DNA, 192 bp, Homo sapiens
cattacaggacatgctgactgtggaggactttgatgttcctgatgccttccaacgcagtcaatcgacagagtccgtcgaagtcggtctgcctctgatgacctaacatcagcaatgatcacacattgccaagtagtgagtctgcccgttgatctgtcgcggtactcgatgctcggaattctgtaagtcatgga

SEQ ID NO: 588766 - DNA, 194 bp, Homo sapiens
gctcgtttatctccgggtggaagcgtgaattacatcgagaatgagaacgtgattcctatgaggttgtacgatcccgtttcgtgcaagaataagatggtggattgctgctagggctgcaataatgacgggcatgatgatgtgaaaggtaaagactcgtgttaggcgctgggactgcccatcagatccccacccat

SEQ ID NO: 588767 - DNA, 251 bp, Homo sapiens
  misc_feature (21)..(21): n is a, c, g, or t
  misc_feature (23)..(23): n is a, c, g, or t
  misc_feature (141)..(141): n is a, c, g, or t
  misc_feature (168)..(168): n is a, c, g, or t
  misc_feature (179)..(179): n is a, c, g, or t
  misc_feature (203)..(203): n is a, c, g, or t
aggtggagactgtgcccgagncntttgtgcaactgcgagagcaacctcagggcccggtgagtgtcagcggtatctggcatcccagtagcttccatgttctgtgtatgtatgtggtgtgcccttcctcccactgtttgaatnactgaaaagcccatgtctctccaactngctcccacagncactctgaagggtcaacttttcantcctcctgctcctcatccgtgtcatgagatggacggttcagggttcgg

SEQ ID NO: 588768 - DNA, 1169 bp, Homo sapiens
gcagaagaaggtggggaggaagaggaggaggaagaagaaggtgatggtgaggaagaggatggcgatgacgatgaggaagctgagtcagctacgggcaagcgggcagctgacgctgatgaggatgacgcccctgctaacgggaatgctaatgaggaaaatggggagcaggaggctgacaatgacggtagaccgaacgaacgacggacagaaggtgagggcggaacgaggacggaggaccgaacgaccggtgactggtgacgcgacacgacggactggacgactgaacgactgacggacacgctgaagtcaagctaccgaggcaacgcgggcagactgaagatgactgaggactgacgactgtcgactaccacagaagcagaagaccagacgaggactgacatagaccagcaaaacaaggcaaaagttaaactaaaacaaaacaacaggccgacagaggacctattacaaccgtacacagctatcacagaacatacaacaactctacaccagtgagtaaccataacagaagtaagagacgtgaccaagcaccggcaccgacacaagagaaaaatagcacgacaccggcagagactgcacaccgacagacatacatccaaaacaacaccaaagcgacacacaagagaacacataagaagaaaaggggagcaaggacaacaagaaccgaaaacattcacaaaggaccaagcgagaaaaaaaaccaacaaaagacacacaggaaaaccaagaaaaacacaggcagaggcacacaacacaaaaacacaacaaacaacaatcacccaaagacccatactaggacgaaaggaacaagacacaaaaaaacagaaacacaggaacaacaccaaaaccaagacaacaagcaaaagcgactacagtaacacacccacattgacatacaaccatcgaaagaatgatacacaacaaaatcaaacaaatacaaaaaaagaacaaatacaaaactagactacaaaaactaaacaatagaacaaccaaaacaaaaactaactaccgacactcgcggataccaaatagacaagtatacatagtagaaaacaaaaacaatatgaaatacaatgatacaacgcccaaaatcagagaatactcaaaacaatacctaacaaaaagaataactaactactgaaaaacaacca

SEQ ID NO: 588769 - DNA, 240 bp, Homo sapiens
gtgggttgagcgtggcttggtagttcacgcctgtactttgggaggcagaggtgggtgaatcatctgaggccaggggttcgagaccagcctggccaacatggtgaaaccccatactctactacaaatataaaaattagctggttgtggtggtgcatgcctataatcccagctacttagtgaggctgaggcaggagaatcgcttgaacccagaaggcagaggttgcaataagccacggtcaa

SEQ ID NO: 588770 - DNA, 118 bp, Homo sapiens
gtgaccatgatgtatcaatgggtggctaattggcgagtggatttataaactcgctgctagctgccacgtagtgcagctagcccactcacccgtatctgtagcttacccgtaactgtac

SEQ ID NO: 588771 - DNA, 870 bp, Homo sapiens
aggcgagagggatttgttgaggagcaaggtcttccacaggaactgcgacttggaaagtattcaccaagggctgtgccatgcgaaaccctctttaaaggaaccgcatcgctacgcctaacgggcatttcttttttaatgtaatggttcagagctatgtctaccacgcctcgcgtgcacacgcacacacacgcaagttccctcagtcagccgagaatcctgccatctcttttagataacaaaagctcttaggccttatgcttgggtaggattgtcttccatggacaggtattcagttggaaacaagtatatagtcactgcctctatggtatggagatactccgatttagtccctctgcctcttggggaaacaaaaaaaaaatttgtaaacttccccttcagaagtttctaaaggtcccctgtaccaggtggagggaccctttacccgtggaacttcccgtggattcatgggatccttctgggcaggaaaaaaaaggcaaaacaaaaaacttaaaaaaaaaaaaaaaaaaaaaatgtttgggggggcgcggccaaaaaaagtttttaaaaccactttgtggggggggcgggcgcccatgtaagtggaactggccacacggtggcccaagaggaacccgtgccagacatggggcgggtccccccaaaaaaccgcggcgggcaccgggttctgacacccgcggggtctgggcttcgggtctacagggcaggccgaatcccgcccgcgcgggggaaagtcgagcagagacaccacaacaaaacacactagtaacaacaaaccacacacaacacaaaaacaacaaacacaaacacaggaagacagatagacccgaatcacacagcagcagacagcat

SEQ ID NO: 588772 - DNA, 241 bp, Homo sapiens
cgcagggatacgtagagagtgacagccagagggaggaggctgggataaaccgtggcagaagatgccttccaggatagtccaggtaaccgccatcactgtggcagtcaggattggtccggattaagtcacagcggtcagagccattcagggcacacaccttgcggcagtctaaacacgggagtctggttcacaccttaagctggaaactgggggccactgtgggataacacgttcgggagga

SEQ ID NO: 588773 - DNA, 509 bp, Homo sapiens
tgagtcagtctagaggactccccggtctggcggtacggaatgtcgattttcattccacaactatctgctggctgcgcgtgtggaatgactgcggagacgcaagtaggacggggagtatgtgggcaggggaaggaggccggtgccactaagtgacagtggcttgacccagaaggagacagcactggagagcaacggaatccagacctacttcaatcagagggacccttggagtgacggtgcagtgaagaagtgaggatgacagccaggtttgtggcttgggagatgggagtgttggcggtgaatatactcgtgacaggaaaggaagagatttctggtgggataagacagccggagccccattttagaccaaatgaatctcagctgcttaatgaatagccacgtaaagaccgccagtggcaaactccccaggtgggagggcgggggacagatctgtggagtcagcaggctacagacagatgtggagccggggaggggcaggtgagacgggc

SEQ ID NO: 588774 - DNA, 281 bp, Homo sapiens
ccgtattcgctcctagacggagagagaaaacaaaacattttcatgaaaggaagaattttacaaattttaaaactaagtaagccaatgaaacaagtctgttgggataaagtggtagctcagaaggggaggcgacagggaataagttttctgaagctgagagaattccaggactgaagggaaaaagcagaagaaccctggacactgataggaatgaactctggacgaagatcaggtgtcgtgctccagtagcggcaagctggcttgccgtctaggagcgtaat

SEQ ID NO: 588775 - DNA, 383 bp, Homo sapiens
tacttttccacaggccacctaaactattgccacgttcttccttgctctttggacgccccttagtttgctagttgggtctcgaaatcatggtctttacgttaattaatggccggcacagtgtttgggagaaaaacagaatctgcagctttacatctcatcactttccatgggctgagcttgtctcccatcgcctgagtcgatatttccactttttcatgtttccaaagtgtcctgtcatcctggtcttctcagtgatggctgagacagtgcgaagaccgcttgcacgccctggatgtccaagggctgtctaagtacagctgtcatagctgtccatctgcagatccagacctgggatggctagagcagagatacctgtgctctaa

SEQ ID NO: 588776 - DNA, 683 bp, Homo sapiens
  misc_feature (109)..(109): n is a, c, g, or t
  misc_feature (155)..(155): n is a, c, g, or t
  misc_feature (201)..(201): n is a, c, g, or t
  misc_feature (208)..(208): n is a, c, g, or t
  misc_feature (217)..(217): n is a, c, g, or t
  misc_feature (231)..(231): n is a, c, g, or t
  misc_feature (268)..(269): n is a, c, g, or t
  misc_feature (280)..(280): n is a, c, g, or t
  misc_feature (331)..(331): n is a, c, g, or t
  misc_feature (339)..(339): n is a, c, g, or t
ggagtatatctcacaccatatgattaggaatgtctcatggttcatattcacacgcaatcacattaagaagattatccagctcctctgcacaccacattgcgggaagagnaccatatggaccatatcttcattagagaataccataatcacttaanaggttattagtgcctattctaaatccagagatccatgtagagagantatgtgnctcctcagngaatggaaatgttntgtaggacattccttcacagttggcatgactgtttgnnggactgactanatgctatatcacacatctgcatttacaaggtcttcactgttaatcacagancacatttntgttccttccagattgctcttgcttctgtagacaattatatgctaattattattcaacataccagtgagagcaaaagtgacaatactgcacacacaaccgcaatctaaggagccataaagaaatatgctggcaagctaaatgcttacacacaaaaaagttagacttataaagtgtgtgagaaactctgaaaaaaatatttcaagttcttcaatcctcctatctcatactgtttataagtatgagatacttttgacaaactcactctgtcgatcatgctactgcactccagcctgggtgacagagcgagtttgtcataagtatctcactcgtgccgaattcctgc

SEQ ID NO: 588777 - DNA, 272 bp, Homo sapiens
acaccagcagcgggcgcaggcgcttgcccccgccaatcgcggcgtgacgcatcgcccgatacagattggcgcgcgggtcttccggaatcgccagaaactggtccagccgccggtcgatatcggcaccgacgtccgacaaggccgcagcaagcgataggggtgcagcggtcatgccctcaacccgcggcaaagggctgcgtgccgatggcgcgcccctcgctatcggcgcggatcgcttcgatccgcgcctgtgcggcattgagccgatcatc

SEQ ID NO: 588778 - DNA, 301 bp, Homo sapiens
gggccgcgcgccggggagggtcgcgccggcccgccctggtctccgcatcgcccggggcgcattgcgcgctcctctggccgccctccctccgcgcggggacccctggcgggcggaggaggacatggccaggaggccgtgcagagtgagcctcgcagctggtccctgcatagagcagctgggcctggcctggggcagacctggaggaccaccggggtacagcagcagctggagctggagcgggagcggctgcaggcgggaaatccgcaaaggagctgaagctgaaggagggtgatgagaacct

SEQ ID NO: 588779 - DNA, 206 bp, Homo sapiens
ttattaggcgcgttacagcgtgcccgccccgatcaagaagaagagctgcttcacctgcttgcctcacacagctcggtggtccatggcctgtatctggcacactggtgtatgtaaaatgtagctcagcttgttgcaggactggaggtcatgtgtgtagccgtcacgtgtcgtactatagctacgaggatgcgcttcctggacagcct

SEQ ID NO: 588780 - DNA, 564 bp, Homo sapiens
ttttttttttgggtctgaatttttttggcttattattatgcctgagataatctatttggtgtatttagcagtgtttcattatttgggattgtcctttagtatctattgtacaatttaacaaaatttatttaatgtaatgtacatatataaatgtacatatatatgtatcagagtaataaatgcatacacaaacacacacacacatcactcagagcattatgactacaggtcattatgagaactactactaattcaagatcataaattcctcatgagatcttttctgcaaataacatctggttggaacaacaacaaaattactggcccctctatgtgaagtttattggctaatataagtttactcttgggggttcaagctacatatggcataggcaacgggtgcacaccgggggctttccccttgggccagaccactttcttgctacccacaatgggaaggttaattcctgggccatccagcaggtttccaagacccatttccagtggggaaccccacttatcctccaagggccctggcccttaccttggcctccctacccaccc

SEQ ID NO: 588781 - DNA, 333 bp, Homo sapiens
  misc_feature (14)..(14): n is a, c, g, or t
  misc_feature (120)..(120): n is a, c, g, or t
  misc_feature (225)..(225): n is a, c, g, or t
taaaattccacatnttaacggccgtgagccaccatgcctggccggaatttcttgaacttaaggcaacactgaaatttgctgcatcagtcgactcttccttccaggaacgatttctctgtngcatgcagtgttgtttgatagctttttacccacagtagaacttctttaaaaaatggaatcaattctcttaaactttgctgctgctttatcaactaagtttatgtnatattgtaaatcttgtcatttcaacagtgtcacagcatctgcatgaggagtagattccatctcaacaaatgactttctttgcttatgcataagaagcaactccatatc

SEQ ID NO: 588782 - DNA, 526 bp, Homo sapiens
  misc_feature (18)..(18): n is a, c, g, or t
  misc_feature (20)..(20): n is a, c, g, or t
cgaccgccaggagccgantntgcaatcatttgaggtcaggatttggagaccacttgaccacttgttgaaccccgtctctactaaaatacaaaattagccgggttggcgcatgcctgtaatcccagctaaccgttaggagaatgccggaactgggagatagaggctgcagtgagctgagatcatgtcctgcactccagcctgggagacagagcaagactctgtctcaaaaaaagaagaaaaatacaagagagtccgggcaaggtgctcacgcctgtaatcccagcactttgggaggctgaggtgggcggattgcctgaggtcgggagttcgagaccagcctggccagcttggtgaaaccccgtctctactaaaaatacaaaaattagccaggcgtgatggcgcatgcctgtaatcccagctactcaggaagctgaggcaggagacttgcttgaacccgggaggcagaagttacggtgagcagagatcgcgccattgcactccagcctgggcaacaggaatgcgtctc

SEQ ID NO: 588783 - DNA, 282 bp, Homo sapiens
ctcaaaaagtagaatctaaaatcaacacagatgtacaactagattctcaagagaaaattggagttaaagaagaatcgcattctgattttccatatggatcatttccctatgttgctagaccagtacactggcaacctggtcatacagggtctcactttgtcacccaggctggagtgcagtggcgtgatcttggctcaactgtagcctcaacctcctgggtttgagatcctcccacctcagccccccagatagctgggactacaggcggcaggcacacgtgga

SEQ ID NO: 588784 - DNA, 295 bp, Homo sapiens
ttcagtctctggacggatgtgtctgtggtttgtaaccactacggtttaaaccacggtttaagaatttccccaactaacagaaattctgctcgggaagcgataaactagctccaccctaccgagcccgtttttgagttttagatactttctctctcaacaacttaaaaccgctctcctgaaaccgtgcattcctctacttccttcctttcactgaaattgctaacacgccactctctttttcgcactgcgattttaaccatttattacatcaaaattttgttaaagaaaaaaaaaa

SEQ ID NO: 588785 - DNA, 225 bp, Homo sapiens
atacacttatagacagctaaaacagttgctatatgtcgcttccaagatagccatataggaacagctctggtctacagctcctagtgagattgacgcagaagatgggtgatttctgcatttccaactgaggagcctggttcatctcactgggactagtacgacagtgggtgcagcccaccgagggcaagccgatgcagggtggggtgtagcctcacccaggaactg

SEQ ID NO: 588786 - DNA, 196 bp, Homo sapiens
tactttcccagtgggagtattacagcgaactagtttgagttgacagtatgtgggagctagcctggtgattgtgaagatacctgtcatcaagaacccgagtggtggtcatgtcacactatggctatgaggtggaagaggtgaaaatcctatgaaaggatcgttacttggtgtgtcacacatcacaaacactgttggt

SEQ ID NO: 588787 - DNA, 1143 bp, Homo sapiens
cccacgcgtccggtgatgaactgtgttgcacacagacatggctgacatcaccagaacctacctgagttctcactcctcctgcttctgggtagctgagtctagaggtcagacagtgggcatggtggctgctcggccagtgaaggaccccctcctgcagaagaagcaactgcagactacttcacctctctgtgtcatgcagcaccgaagagaaggcctagggaaagctatggtcaggactgtcctccaatttgcacagatgcagggcttcagtgaagtggtcctttccaccagcatgctgcagtacgcagccctggctctctaccagggcatgggcttccagaagactggcgagaccttctacacctatttgtccagactaaggaaatctccaatgataaacttaaagtatagcctcacttctcgggaaggggacctgtgatctctctcctctgggcgtcaatcaggatctgatggcttctgtaatagtaacaagcagacccagctacttcaggtgcaaaccactaaccctcactctcaagcacatctgagtaacgtgtaacgagggtgggcttggggcaatggttactctgatgtatctagggctttctgaggtatcctttagctaacataaacgccatgtataccaagtaccacaatatgaactaagcaagtacccggaactctggatcctagcaggatatcgtatcaagcatggacaactcggaaggccatggacttgacaagatatatggcccagtacagggaatgccagggcacacaatggcacatggtcagagaagaaggagacggacacgacgcggcacagagggcaagcccgggacaggggtccacgccacacaagcccatcacaaaaaggcagggcaagacaaacagcggagaccagaatggacaatgcaacagacggggaacccgggcaccaacagtgatgcgagccaagatcagctcaaaacacgagggagaaacgaacaaacaacagtgggtcaaagacacagtcagcaaacaacacaacctgaaagactccacagctggaagcagagctaacatctgcgaacacacggcccatacatgagacggtcaattcatctgacgcgctctcgatagctcacaacggacgaggtgagc

SEQ ID NO: 588788 - DNA, 256 bp, Homo sapiens
  misc_feature (104)..(104): n is a, c, g, or t
cagcaccaaccaaccgcctgccccgcctccttgggttcgacggacgggccggaaggccaataaaaacccccggtaaacccctgtcggccaatcccaggggccgnttaggcaaaactgactttaaaacccgccccttttaaggacggaaaaatgcgccaatcattatagtgtttgggtccccggctgagcctatcaaaaaaaatttaaataaaggcttataaataggccctataaatataacctcctttttttcgga

SEQ ID NO: 588789 - DNA, 82 bp, Homo sapiens
agggcagggcttttggttttgttctctgatgtgtggcagtatctagcccatcatatactctcaatggatccttgttgaattc

SEQ ID NO: 588790 - DNA, 188 bp, Homo sapiens
cgtctacaaacagagtactgcggcaagtactattgacccagctctgattcgtactccttgaccttactgtgaacataagtggagtccgtaaagagatatctttactataaaagctattgtgtaagctagtcatattaagttgttggctcaggagtatgatagttcttgggcagacaggtgcagcgtag

SEQ ID NO: 588791 - DNA, 383 bp, Homo sapiens
aggatcccgctgaccgcttaagctgttggtgtatagcagagctactgatttgtgtacattaattttgtatcctgaaactttgctgaatacatttatcagttctaggagctttttggattagtcttaggcttttctaggtatatgatcatatcattggtgaacagtgacagtttgacttactctttacagatttggatgctcttcatttctttctcttgtctgattgctctggctaggacttcaggtactattttgaatgtaagtggtaaaagtggacatccttgtcttgtcccagttcttggggaatgctttcaacattttcctgttcagtataatgttggctgtgggattttcatggattgcttttcttaccttaagcggat

SEQ ID NO: 588792 - DNA, 431 bp, Homo sapiens
  misc_feature (399)..(399): n is a, c, g, or t
cgggcgtgcacttactctgtgctgcttgccagccttgcagttgttgttttaagcagaggtgacatcttgttgacgcctgaggtgaaaatctgggtgaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccacacatggngctgaggctccctgctgcaatgcaattaaagc

SEQ ID NO: 588793 - DNA, 329 bp, Homo sapiens
  misc_feature (18)..(18): n is a, c, g, or t
  misc_feature (272)..(272): n is a, c, g, or t
  misc_feature (279)..(279): n is a, c, g, or t
tttttttttcagataggntcttgctcagcccaggcagcagtgcagtggtgcaatcatagctcactgcagcctcaacctctctagctcaagcgatcctcccacttcagcctcccaagtagctgggaccacagacgcaccccacccacgcccagcctttttttttttttttttttttttgtagagaaaaggtctggctttgtcgcctaggctgatcttgaactcctgtgtttcagtgatcctcctgcctcagcctcccaaagtgttgggcttanaggcctngagccaccacgcccggccaaaaattgggttcctaagcagaattctatacg

SEQ ID NO: 588794 - DNA, 412 bp, Homo sapiens
gccttggagattccaggacccaagaacctgccagtatgtatagccagtgtgaccttggggtattaagtgtctcagacagccgcgcttgaagttggtctgccctcagggtccaattcccagactctcagagaccttgtccttaccggtgctccagtagtctttcagggacctgaagccttcggtcacacagccctgtggcttgttggcccacttggaattcttgcacgtgtgctcagtgcatccttgccggtcttggtggcgtgcttcatgtaaccgtgcataactctgagaaggaaggcatcctcggcctctagagctcggacagagcacaagagcgacagagagggccaccacaaagagtacccgggtgtgcatggcacctgtgtttctagaacatctgccctcgtgccgt

SEQ ID NO: 588795 - DNA, 114 bp, Homo sapiens
ccagatctttaacttgactgttgtgtcatccaggcagacagtctgtgtgagaaaggccgctcaattgtgctctcctggtactcgcgaaactgtcccttgacaaagcggaggacg

SEQ ID NO: 588796 - DNA, 450 bp, Homo sapiens
gtaaagaacaacaggggctgagactgttttgaaacaaagatattttgcgatttaccatttccttttttccccctatgttacgtttcgtttaaagtgcctgcttgctactttaacatgttatttttctgtttctttttcagattattcttggagaaaccctgtctgtttactgtaaccttttgcactcaaattcctttatcaggaataactacatagccactatctacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgt

SEQ ID NO: 588797 - DNA, 571 bp, Homo sapiens
gctcggctccctgcaactctgcctcctgggttcaagcaattatctggcctcagctacagttagctgggattacatgtgtgcgccacgggcccggctaatttttttatttttagtagaggcggggtttcaccatgttgaccaggctggtctcaagactactgacctcaagtgatcccccccccccccgctcggccttcccaaagtgctgggattacacgacgtgagccaccgttgcccagcggtttggcattttccaattgtggggcacggtgacgaaaagacttgacggaaagcaacggcgagtgagatccatggaaatgtacggggggaaccttgccaggccatatggaacagccagttgcaaacgggcctggggttgggagctgcctcagggtagccaaggatggcacggacggcatcaggctcggccgagatgggaatgcatgggcgcccaggtccttgcaacggtctcaaaggcgcccattggcctacttcctgcaacaccttgggccagggttttgagcctagagaatgtgacatctgactctttaagttttctccaagagaatcc

SEQ ID NO: 588798 - DNA, 923 bp, Homo sapiens
  misc_feature (37)..(37): n is a, c, g, or t
  misc_feature (83)..(83): n is a, c, g, or t
  misc_feature (106)..(106): n is a, c, g, or t
  misc_feature (166)..(166): n is a, c, g, or t
  misc_feature (194)..(194): n is a, c, g, or t
  misc_feature (255)..(255): n is a, c, g, or t
  misc_feature (312)..(312): n is a, c, g, or t
  misc_feature (401)..(401): n is a, c, g, or t
  misc_feature (417)..(417): n is a, c, g, or t
  misc_feature (421)..(421): n is a, c, g, or t
  misc_feature (525)..(525): n is a, c, g, or t
  misc_feature (529)..(529): n is a, c, g, or t
  misc_feature (598)..(598): n is a, c, g, or t
  misc_feature (600)..(600): n is a, c, g, or t
  misc_feature (785)..(785): n is a, c, g, or t
  misc_feature (912)..(912): n is a, c, g, or t
ttttttggtgatatattgattttttgcggatctgatnggttgtgctttcaaaactgtgcagtttcctttttggttctgaatangttagtaagagttccaagaggcntcaggtctccaacaacaaaggcagagaagttagcctcagaaagatgacagtctgaaggtngggaggctgagagtgcttggtgtttganagatgagtgttgtggtgggaggagtatggagtcacacagaggctccacccagcaaggcctntggccaggggctatgtttaaggctggggtcaggcagaggtgggagccgcagggtganagaagtctggccggtaagctccaagggaaggacaaagtgcattggtggcagatgtgatccgtggatcaaccgcagtgcaggcagggctnctacaacgttatagcnagcnaggccgtctatgaagctccctgagctacattctaacagaatgtggatgtggggctgggttagcatgtggccccaccatctttagcttagtggcagttttgatancttnggtggcaaggaatcccatttaccctgtagcggtagtctccgctggtgtctcctgggtccccagggcttnanttgtctggtccttggtgatccagcagatctcggtgtggcagacggtgcagcggatccagtcgcagccgtccttcttctgtaccacgatctggcactgggggcaggcatggcctcgccctgctgcagcatcaccttcagcatctctgtcgtctgccgggcagccacatcgttctgagcccgcagcnaggctcctcctgatactccttgcagttcatctgctcatggatggccttgcagagcaggcagttgacgtggaaacacacagggcaggtgaactcattgacatcatcctcaaagaagcaccatcccttncaatctggggt

SEQ ID NO: 588799 - DNA, 302 bp, Homo sapiens
ggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaactgcccccatgattcattacctcctcccaggtccctccatgacacatggagattatgggacctacattcaaatgagatttgggtagagacacagcctttcagtgcttacgttctgcttgcttctgcagtctctttaggg

SEQ ID NO: 588800 - DNA, 1264 bp, Homo sapiens
  misc_feature (967)..(967): n is a, c, g, or t
gctgaggctgcatctgtgtaaagtccttgtgcgattgagctctttatgagatcattcatcgtggtctatcttgctcatccccttataaatgtgctttgcctgtccatcgaagacctcaatggctcagacgtcgagtggagactgagatgccctgttctgcacgattctagttgtccggaagaaagcctagcgttctggggctcaggtccgagatgcacctggggtattctgtttctcttgactgtgggcgaccttgctttggtctcttgcttaggagtgccccactgcccggtcaccatgcatggcatgctgtgcttggttccccataagacgatccttctttgaggtgcacggtgtcaaagtgtggcgcaggagtggagagctggctgcccttcaggaggagagcagatgcattgtccatcaggctccagcagagctcgacgagctcacaagtccttgaggaatgcttgtgaccctttacgggcttctgggagaggaggaacttctctctgaccctgggagcgctagaagtgtacagtgctccgcaggcaaacaagctgtggcccgacaaatcgtgactgactcgccgctcttgccattcctctgattgccagagtgtccagagcttgaagcgtcacctttgagatactttactgtgtgcccaagacgttaacacttgcttcgtcccagtgacactggggtcacatgaccttcgaggcacaccacccgaattgcttattgcctctgaggccgtgggctgccttgaccttgagcgtccaagcgcaacggtgtgccacagactgcacgacttttctgacgaaatggcgtccctcccaagaggcgcctggtagattcgcctaaggtaagcttcaccacaggtgtggcctccttcggtgtttggcccccaagtcagacccgagggcaggtaatgggcttcaacgctttgccactctgggttatagttgcncaattttgggcaccgtgctcatggttcagaagacatctcagaagacgattgtcgacttaacccccactagcacggcacgtggtcaactggtacaatcccgttgttcacccacttgcaagccgtcgcttgccaaaagaacgttccaggggccccgcgtggaattgtcctccaaggacgaagcccctaatggtgcacagggtggaaacgggtcctccgggtaccttggacacgtcgctacttcttggggtgcactcacatgcgggagttgaattgcgcggagctgcccttggccgaaca

SEQ ID NO: 588801 - DNA, 122 bp, Homo sapiens
  misc_feature (18)..(18): n is a, c, g, or t
tttaaaacatgcccagtnggccgggcatggtggctcacacctgtaatcctttgggaagctgaggcaggagcattgtttacgctcatgagttcaagaccagcctggccaacagagtgaaacct

SEQ ID NO: 588802 - DNA, 448 bp, Homo sapiens
gtactcatcgttggtatcatacacgaggagtctgcagggagcatataccggtacgagaaaagaaggatatttccctatggagggtgaaagagcccaaaggaaaaaggatggctcattagactatagtgatgaggacaacgagtccttgcaggtcattcagacgatctctgtacgggtgcatcaagcagcatgagtagtgacgacagcctggtggactatggcgagggtggcgagggtcagttcaatgaagacggctccttcatcggccagtacacggtcaaaaaggacaaggaggaaacagagggcaatgaaagctcagaggccacgtcacctgtcaatgctatctactctctggcctaacggagcccacccaggcacagccacctacttagcaagtgaaaggaggggagaaggagagacaaaaccactgcagacctaccacgaagcc

SEQ ID NO: 588803 - DNA, 311 bp, Homo sapiens
tcgagtgttggccagtcatgattcaagtatgggtatcgtggtgtaagccattgataaccggaaaaaaagggcgacactcgagggtcgcgcctcagtatgatggggcaatggttctaggacctccaggatttggtatccgaggttgctcatatccctgataaaaaatggtgtaggatttacatataacctatgcatatcttcccctataatataaatcatctctggattacatataatactcaatacaatgtaaatattatgtaaatagttgttataatgtattattaagagaatgacaagggggagacact

SEQ ID NO: 588804 - DNA, 207 bp, Homo sapiens
ttctagcaggatcccctgttgtacccatgctgtctttgaatggtcatcaccacgttctacagcctatttgatttctgtgaaattccaagaacattgtgcttatcacgcaactcatgctgagccctgaagacctttacgacaagcatcttgtaatgtctggccacttctggacttttatagaaactaggtgcagaccattcactggct

SEQ ID NO: 588805 - DNA, 171 bp, Homo sapiens
ccacggctccccgctgacgctgcctggtctctggttcgtgtgttggttacgtggcctagtctgcggagcgttctggacgtggcagtgaaatcacatggctaggccggaggtccattaagagggctgagaaggcccctgtcaagggtcatgggctgggttttactatatgat

SEQ ID NO: 588806 - DNA, 325 bp, Homo sapiens
agctgaattatcagctaagcttgtggcgataatggatagcttatttgacaagctgttatctaagtatgaagtgaaggctcctttttccttcttcctttttcagggatttttttaaggaaattacaaaaatgcacggaggtatatttgatctcttccaggaggacaaacacagtttttattttttgggattaatgcaggtataaactcacttgaaagagcagttatctcacttaaatgtgataaatgatggaggactcacatgggttggtcacagcagatgtagctttttacactggaaatcttcaggccttaccgggccttacga

SEQ ID NO: 588807 - DNA, 113 bp, Homo sapiens
agtggtgaatacactctctaccaggctgcagggtgaacgagctttggaggtcagcgcggtgcttacgtgtcgacggaacttgtccagggaggcgtgcgcgggggtggtgaatc

SEQ ID NO: 588808 - DNA, 162 bp, Homo sapiens
accatggattttttttccccggggaaagggtttccccctccccatttctgaagagagagaaaaaagactggcggccaaaaagagcagtgggtgaaatgggtccctgggtgacatttcaaatctttttacgtaattaaaaatattgtggcggggttttttgca

SEQ ID NO: 588809 - DNA, 297 bp, Homo sapiens
ggcaaccccaacgccacttatccagtgaaccactatcacgaaaaaaatctactctctatataatctccctacaaatctccttaattataacattcacagcacagaactaatcatatttatatcttcttcgaaacacattatccccaccttgtgtatcatcaccgatgaggcaaccagcagaactgcctgaactgcaggcacatacttcctaatcctacaccctagtaggctcccttcccctaactcatcgcacttgatttaacatcaaaaaaccctaggctcactaaaacattctat

SEQ ID NO: 588810 - DNA, 879 bp, Homo sapiens
  misc_feature (44)..(44): n is a, c, g, or t
  misc_feature (48)..(48): n is a, c, g, or t
  misc_feature (59)..(59): n is a, c, g, or t
  misc_feature (64)..(65): n is a, c, g, or t
  misc_feature (67)..(67): n is a, c, g, or t
  misc_feature (72)..(72): n is a, c, g, or t
  misc_feature (74)..(74): n is a, c, g, or t
  misc_feature (76)..(76): n is a, c, g, or t
  misc_feature (78)..(79): n is a, c, g, or t
  misc_feature (82)..(82): n is a, c, g, or t
  misc_feature (84)..(84): n is a, c, g, or t
  misc_feature (87)..(87): n is a, c, g, or t
  misc_feature (89)..(89): n is a, c, g, or t
  misc_feature (101)..(101): n is a, c, g, or t
  misc_feature (105)..(105): n is a, c, g, or t
  misc_feature (110)..(112): n is a, c, g, or t
  misc_feature (118)..(119): n is a, c, g, or t
  misc_feature (121)..(121): n is a, c, g, or t
  misc_feature (123)..(123): n is a, c, g, or t
  misc_feature (125)..(126): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (138)..(138): n is a, c, g, or t
  misc_feature (148)..(148): n is a, c, g, or t
  misc_feature (183)..(183): n is a, c, g, or t
  misc_feature (197)..(197): n is a, c, g, or t
  misc_feature (203)..(203): n is a, c, g, or t
  misc_feature (224)..(224): n is a, c, g, or t
  misc_feature (227)..(227): n is a, c, g, or t
  misc_feature (233)..(233): n is a, c, g, or t
  misc_feature (239)..(239): n is a, c, g, or t
  misc_feature (252)..(252): n is a, c, g, or t
  misc_feature (254)..(254): n is a, c, g, or t
  misc_feature (266)..(267): n is a, c, g, or t
  misc_feature (273)..(273): n is a, c, g, or t
  misc_feature (340)..(340): n is a, c, g, or t
  misc_feature (353)..(353): n is a, c, g, or t
  misc_feature (372)..(372): n is a, c, g, or t
  misc_feature (437)..(437): n is a, c, g, or t
  misc_feature (442)..(442): n is a, c, g, or t
  misc_feature (446)..(446): n is a, c, g, or t
  misc_feature (450)..(452): n is a, c, g, or t
  misc_feature (460)..(460): n is a, c, g, or t
  misc_feature (462)..(462): n is a, c, g, or t
  misc_feature (464)..(464): n is a, c, g, or t
  misc_feature (466)..(466): n is a, c, g, or t
  misc_feature (472)..(472): n is a, c, g, or t
  misc_feature (476)..(476): n is a, c, g, or t
  misc_feature (487)..(487): n is a, c, g, or t
  misc_feature (492)..(492): n is a, c, g, or t
  misc_feature (503)..(503): n is a, c, g, or t
  misc_feature (517)..(517): n is a, c, g, or t
  misc_feature (556)..(557): n is a, c, g, or t
  misc_feature (560)..(560): n is a, c, g, or t
  misc_feature (563)..(563): n is a, c, g, or t
  misc_feature (572)..(572): n is a, c, g, or t
  misc_feature (579)..(579): n is a, c, g, or t
  misc_feature (588)..(588): n is a, c, g, or t
  misc_feature (597)..(597): n is a, c, g, or t
  misc_feature (619)..(619): n is a, c, g, or t
  misc_feature (625)..(625): n is a, c, g, or t
  misc_feature (628)..(629): n is a, c, g, or t
  misc_feature (636)..(636): n is a, c, g, or t
  misc_feature (675)..(675): n is a, c, g, or t
  misc_feature (689)..(690): n is a, c, g, or t
  misc_feature (692)..(692): n is a, c, g, or t
  misc_feature (699)..(699): n is a, c, g, or t
  misc_feature (701)..(701): n is a, c, g, or t
  misc_feature (737)..(737): n is a, c, g, or t
  misc_feature (799)..(799): n is a, c, g, or t
taaggtaatggataaggacagagcttgaagggtcagcaattcantttntattggggtanttttnncntgttntntntnntananttntntcggattttttngggnttttnnnttttanntntntnntangtnttnttntgttcagatnttttgtcacctttagagtatttcacaggggccccngggggggggggggngggggngggggagggactttatggtgnggngggtgnccacgntgatgttcattangnccagcaccaggnncagggnacagagcaaagtctccgttgtctcaggcatctggattggctcttgggcctcccagtgcttgaggagnggctggtccaagncccagtggtccaccctggngtcatagacgtcctctgctgagggcacaaaggtcaggtaatggaacttgtggaagctgtattttnttttnggcnggtnnnggtttttngngncnccctcngtgnccgggtccccnttgcngagggatgtgngattgaggactggngggaagaacctgtcaatgtggcagatgagggtgttgggnnggnccngctcgcacnggggtcnttgggaaanaccgtcacntcagggggattattgggggggngggggnggnnggggggnggggtcaaggtattcaagttgttgttcaatatagcaatnttatctatcttgcnntnttttttnanggaaaaggctcggccaaactcctccagatgccaganggtctccttcttgtccagatccacatagaactgctcatcttcatcaaattcaaacataaacnctcctgttggtctatgggtctgtacaaacatggcataagttgacacatggtccgccttgatggcccagctcctcggagac

SEQ ID NO: 588811 - DNA, 174 bp, Homo sapiens
gtagattctgtaaggtgatgagtgggtatgcagccttcgaaggttattcataagcgtcttcagaccgaagatgtgctgcgagtagctttctgctggccaattcaatatatctgcagactatgagtcgtgcgatcatccttattactaaatattactttcccggttatctcaggc

SEQ ID NO: 588812 - DNA, 117 bp, Homo sapiens
tcactggggatcctgcagtcagtgactttgtgtctgcacgctgtgtccctgtggaaacaatctacaactcgcagctccaccaaactcactcagagtcacaaaattatctatcacgtg

SEQ ID NO: 588813 - DNA, 399 bp, Homo sapiens
tcgtctctgcgctctgtgaccccactctctggggtcctagagggttcttctgcgtcagcctcccaagtagctgggattacaggatgcaacaccaatcccggctactttttgtattttccgtagagacatggtttccgcatgttgggcaggctggtctcgagctccgtacttcaagtgatctgcctgcctcagactcgcaaagttctgggattcacaggcatgagccaccgtgcccggccacaagtgttgtggtaactctcatacctcaaaccaggcaataaggagagatccttgttctaatagctaggcttaacatcatgagtatggtcacatgggtcttctagtacgaaggtacctacagcaaaaaaccacattactataatactaatatttaatctc

SEQ ID NO: 588814 - DNA, 310 bp, Homo sapiens
atttagtttgggtggtctttttttaaaatgctggatcggtcagtctcttgtggcaatagcccttttaaaaaaataaagaatttaatatatggtgattgggatatgtagccttccaaaaaatgaattgcccaaaaactggtgtcatgtaaattccccctttacataaaaacccctcagggcagaatgatgctccatattttaaaattttaaaaatagggtgggatttttccttgtctctactttataattatccaaacttattttgtattgctactccccttaattgaaataaaatgtttataccttcgga

SEQ ID NO: 588815 - DNA, 367 bp, Homo sapiens
caggatggttggaacagtgtgtggaatgatgctcagtgttccataacacaatattgggaatagtaagggccaattgcatttaacattcagcctaatacattttctcaaactaattctgtgtgtaaaagttgccacctatcaaatggagatagctgaaacagcaaaaatattctttaacagtgatggttataatggaaatgctgacagatcattaaccacagcagtcctttagagaaaaaactgctgtaacgaaatcctgcagctaaaatttaatgaataccctaatcacacatttgctaatgcctctgaaatgtctacatcggtcaaattaataaaaatcagtgctatctattaagtctgactattg

SEQ ID NO: 588816 - DNA, 109 bp, Homo sapiens
ctgcattaccggggggatggaagaagtacatatagctcaggtagcactttatactcaggcatgatctcagccctctactgagtccctttgccagcagtatctttcaaag

SEQ ID NO: 588817 - DNA, 633 bp, Homo sapiens
aaactgtaaacacgaaattagaggaagagtccagcacctgccatttggccactgtccagacctactgtgtgcttcttggggaaaaactttacagctttgaatggctgagaggtttggaaagaaacagctcagtccccatggcccggatggagagaggatccctgcaggcaggtccccatgctgccaccagattggagccactccttgcttcctttagtcacagtacctgaatgtgcccgcctcctggagagcgtcctggttgcaggcttcccttgccaaccactccagagggtgaaactggctctcttcttgcttctttaaaaagacactgaggcgcatcttggatacccgcaagaaagaggctgtacaaaggcagaaacagacgttcagcatggccgtggctgagctgttggctccggagtgcttctgtcccacctcccccaggaagggaagtccgttggccaggccaattctagagcaaaatctgagagatgctcttagattcccactgtgtcactgcttctgctgagccatggaaacctgagagggtgtccccaacacacagtgaaatgatgccactcctcaggaagagcccacgtgggggcagggggcaagaggggtggggaggctcat

SEQ ID NO: 588818 - DNA, 392 bp, Homo sapiens
ctggatctgctgagccggtgagtggccacgcatgtcctcctgagtcgcgcgtcaggcccaaccgcatcaggacctcacgggccttccggatgccatccttctccctgggaaacagaaagacagcatgtgggcctgtgtctgacccactgtggccagtgtgtgtgtcggggggtggcaaggaagccctttagttccagcaaattcaccacccagtggggacagaatccctcttcattgcttagtccacctgtgcaggggcaggaggaggaggaagggggtgcaaaatatagcacagccaccctgaggctcctctcccagacaccacacacacacgcacacgcatgtgcgtgcgcacacacacacacacacacacacacagagacacacggagt

SEQ ID NO: 588819 - DNA, 253 bp, Homo sapiens
gccttttccaaggggtaaaaatttggccaaagtgggagcctactaacctctccctgagaaagtcctttggttagccttttttctttccatgttaatttgggggaaaaaaattttgtgaagccccttaattttgtgtagtaaaaaaatatttttgcccccccaatgaattggggggtttcctgttcccctttggaatttataaacagcctttttttagttgttaaaccttccaataaaacttccactgggttta

SEQ ID NO: 588820 - DNA, 495 bp, Homo sapiens
  misc_feature (3)..(3): n is a, c, g, or t
  misc_feature (26)..(26): n is a, c, g, or t
  misc_feature (43)..(43): n is a, c, g, or t
  misc_feature (70)..(70): n is a, c, g, or t
  misc_feature (274)..(274): n is a, c, g, or t
agngcctatggggggcccttttggcntcccctccctagtgtgntcagagaggggagatgcctaaaggtanccccctatagtttgccctcccaagcaatcctgtaccttcgaggttgataaataaggcatcaagaataggctgtaggtgggagaggtggcacgggcctgtagtcccagctacttgggagcctgaggcgggaggatcccttgagcccaagagttcaaggccagctggggcaacatagcgagaacttgactgtatttaaaaaaaganaaagaggcttcagcatcttcagaggaatctgtttaagaaggctgagaagggtgtgttcaggaagagttccacttgaaatgctgaaaattgaagaaaagattaaatactgaaaagtgggaaacattccagctcccaggaaacttacccattaagagaactcatttcttgaggattttggatagcaaagtctccctgtattccaatttccagcctgtattacc

SEQ ID NO: 588821 - DNA, 217 bp, Homo sapiens
  misc_feature (124)..(124): n is a, c, g, or t
ggataaaatagaaagcagaaatgtgcatctgacaatttgggagaacctttaatatctaactgtataatttattattcattaattattattgaggagatagggtcttgtttgttgcctaggctgnagtgcagtggtacgatcatggctcactgcagcctcgacctctcaggctcacgcagtacttctgcctcaacctcccagggtaccggagctcgaa

SEQ ID NO: 588822 - DNA, 99 bp, Homo sapiens
gcttccaccgacggggtgggtggagatggaagtgttagggcctgggtctcagtaccccgtggtcagaccccatgatgccccaaatggcactttggtagc

SEQ ID NO: 588823 - DNA, 1013 bp, Homo sapiens
  misc_feature (1013)..(1013): n is a, c, g, or t
agaccctgtgtcaaaaaaaaaaacaagaaagaaagaaagaaaaaatgctttatggcccagtgcaggggctcacacctataatcctagcatttggggaggctaaggcaggaggatgggcttgaggccaagagttcaaaacaagccggggcaacatggcaagaccccaattctacaaaaaacgaaaaattagccgggagcggtgatgtgtgcctgtagtcccagctactcaggagactgaggtgggagaatcacttgagccttgggaggttgaggctgcagtgagctgtgtttataccactgcactccagcctgctggggtaacagagcaagactccatctcaaaaagaaaagaaaaaatgcttggcttacataatgaggccaggcaaaaaaaaaaaaaaaaacaaacaaacaaacaacacaaaaaaaaaacaaaaaaacaacacaaacacaacaaacacaacgaaaggggcgggcgcgccctacacaaataacccccggaagggggaaccaaagagtcgacagcacgcagagctttttgacagacaaagtgagcgcccaccaacgaggcggacatacaaaacacaaaccagcagcgccgccgagaaacaccccaatcgcaagcagggaaaaccatcgcgacacgggcatacaggcaaaaaccccactctgggtgcgggagcctacgagggaacccacccccacaggaggctcaccagcccagggagacacaaccaacacgaggggtcatgagtggagcacccccaaccagtagtgtgcgggcgaagaacaaactggccacatgacatagatccaggaaaccatccgggcggctaggcaactgcacgaacgaacagcagcaacaagcaaccaaccaagtaaacaggcacagagaccagacagacacacgacgcacacagaccagaagcaacgcgacacagacaagacacccaacaaggagcaacacacactaaacacacaacgcgagcacagacacaggaaaacgtactcagtgn

SEQ ID NO: 588824 - DNA, 183 bp, Homo sapiens
cacgaggcgggccggttaccgtgccccagccgtcgatctcggtgatcttgttcttcttcatcaggtagtggacgcccttgacgatcccggcgctgacctggtgcgaacgcgcgtgggtcgggccgtaggacatcgtcgcgtcaccctcgatgccgtacttgggcttgtcgtgggtcaacgtcg

SEQ ID NO: 588825 - DNA, 103 bp, Homo sapiens
  misc_feature (39)..(39): n is a, c, g, or t
agattgttgaaattttatatgtttattgatatattttanaattttttattatgtatgttttgtaaaggttataagtttgtataataaaaatgtttaatggtta

SEQ ID NO: 588826 - DNA, 149 bp, Homo sapiens
tgcccaggttacatcctctctatcttgtgatcagctcattaacatttctcttgtgttcctgatccttcccaatgaacacctctctgcacccaagctctgtctcctcctctgtgagctctgggcttcccagttgtgtttacccgggaaag

SEQ ID NO: 588827 - DNA, 250 bp, Homo sapiens
attttaaaaaattattaatctggtgctgactcttaattcctatttcaatatgggtttccttgaagaattcaggatacaactttttgggtatgacagctttccttccccccctatttttgtggggggggatatatttgatttgggaagaatttaaaaaacccatagctttttaatttgtttgaaacagactttctgcctggtacatttttgcttttaacccattaaagaagcccatggccttttagtttta

SEQ ID NO: 588828 - DNA, 261 bp, Homo sapiens
  misc_feature (26)..(26): n is a, c, g, or t
  misc_feature (41)..(41): n is a, c, g, or t
  misc_feature (45)..(45): n is a, c, g, or t
  misc_feature (90)..(90): n is a, c, g, or t
gccgggaggggccgccaggccccgcncggtccagtctttgncggngtttcgatagagaatcgcttgtcggccagctggaatgcatggcgncgtctcgctcatgaaatttgcccctgattcaatctcctccccctcacctcccagtagctgggattacaggcacatcaccaccactcccggctaatagcgtcagttttttaattgcattaaactgcctgtaatttaaagtttcttattttatattaattccgtttttttttg

SEQ ID NO: 588829 - DNA, 1003 bp, Homo sapiens
  misc_feature (283)..(283): n is a, c, g, or t
  misc_feature (354)..(354): n is a, c, g, or t
  misc_feature (384)..(384): n is a, c, g, or t
  misc_feature (386)..(387): n is a, c, g, or t
  misc_feature (395)..(395): n is a, c, g, or t
  misc_feature (400)..(400): n is a, c, g, or t
  misc_feature (412)..(413): n is a, c, g, or t
cagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggggtggccccaggcaggatgcccagtctttgagctgaanattggaaggcagtgaggctgagggtgccaagatttccccagggtttcacccagaaggggaaggggctacantgcccccagctgtgtgcagggaggacactntnnagcccatnaccgntgccaacaccanntgcctaaaactgtgtttcatacatggggggttactatatattccagctggcggaaaacgcttacattttaccctttgtgaaacaaattaaatacgtgattagcctcaactaaacatttgctgacctatacaagacagtatatttcacccatgtcgctggcaattatgtcatggcgtaacaccaaataaccccccagaaagtagccagaaggccagttggaacttcacaattctaagtgttaagtaacctattctggagtgagtcaccagatccctgtcaaatagagtcacatatggtaggggagacgttttccagctataggaggaggggaactattacacacccagtagattcctatacaaagggtaataaaacttagttgtccctgggtttggaaacttaattgcccattacgagcctgcggaaggggttcccggactatatgaagatgagcctactttacgttatacaaggtgctgccttaacatgataccctggtaaagcgactcctgggacaaccattcatatagaactaaatcagatatggtactcacacaacaaagcggaggccataaaatacctcgaggcca

SEQ ID NO: 588830 - DNA, 848 bp, Homo sapiens
agattgtttttcctcaaaggagaatttaaaggtatttgttaaaattctaataagaggatcagccgggtgcaatgactcatgcctgtaatcccagcacgtgggaggccaagtcgggcggatcacaaggtcaggagatcaaggccatcctggccaacatggtgaaaccccgacgtctactaaaaatacaaataaattagccgggcgtgtttggtgacgacgaaccgtgttagttcccggctactcgggaggctgaggcaggagaatcgcttgaacccgggagacggaggttgcagtgagctgagatcgtgccactgcactccagcctgggtgacagagcaagactccgtctcaaaaaagatggccatgcttggccaaggctgggctcataggacaatatctgtagtaggaactgaaaggaatctggcctagggagccccggacttcggtttacctaccccgttacttcatcccattcatctgttctaaccctagtgtccatcattgccctggcttgaatccgtagggtgggagggaccagaaagccaagaaacaccaatggcacacgagaggttgggagacgaaaattgggcaggggaagccccaagggtggaattccccctttttgggacaaagtggggagttgggatcccttcttcccccttggtggggacactggaccagcggtttataccccttggacttaaagcccaaccttggggggctttgcctacattttcattggaaagcccattttgtgaaacccgacacggggagaggcattgactattcgccattggcagggcaacactgttaatatttgggaaaggctttggtggccccctccgtct

SEQ ID NO: 588831 - DNA, 380 bp, Homo sapiens
  misc_feature (167)..(167): n is a, c, g, or t
  misc_feature (195)..(195): n is a, c, g, or t
  misc_feature (282)..(282): n is a, c, g, or t
  misc_feature (303)..(303): n is a, c, g, or t
  misc_feature (323)..(323): n is a, c, g, or t
  misc_feature (371)..(371): n is a, c, g, or t
  misc_feature (378)..(378): n is a, c, g, or t
ttgtttttttcttggtcgagacagagtcttgccatgctgcccaggctggagtgcagtggtgtgatctcggctcactgcagcctccacctcctgggctccagcagtcctcccacctcaacctccctaagagctgagactacaggtgtgagccaccatggcctgggctnaatttttaggagacagggttttcacctnctttgcccagggtgggtccccaaactcctggggggttcaaggcagttccttcctggccttcaggccttcccaggagtatttgggggnttataagggtgttgaggccantggccaggaaaaacgttttncttaaggacaagggcaggtttttacattatattttaaatttttttttnaatggangt

SEQ ID NO: 588832 - DNA, 991 bp, Homo sapiens
  misc_feature (283)..(283): n is a, c, g, or t
  misc_feature (354)..(354): n is a, c, g, or t
  misc_feature (384)..(384): n is a, c, g, or t
  misc_feature (386)..(387): n is a, c, g, or t
  misc_feature (395)..(395): n is a, c, g, or t
  misc_feature (400)..(400): n is a, c, g, or t
  misc_feature (412)..(413): n is a, c, g, or t
  misc_feature (639)..(639): n is a, c, g, or t
cagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggggtggccccaggcaggatgcccagtctttgagctgaanattggaaggcagtgaggctgagggtgccaagatttccccagggtttcacccagaaggggaaggggctacantgcccccagctgtgtgcagggaggacactntnnagcccatnaccgntgccaacaccanntgcctaaaacttctggttccctatcactattgggggtgtttatcttatatattatttccaagtctggtggaaaagcgtcttcactttatacactcttttggaaaaaatataatatacactgtgtattaacgcctcccactctcaaactattggctggaccttaataaaagcacatgttattattccaccaatgtccgctgggcaattttgttcattgtggcgatanacccaccaaattaaccccccagaagagttagcccagaaggcccagtttgtgaaactctcacaaatttctaagttgtttccacagataaaccctacttctccgggcgcgtgatgtctcaaaccagaattccgttgtttggagtacacagctcacaatcaattggtcgggctgcgacgtttttaccaggctaaatagggagagcggcaaacttttaaacactcccttgtgtcgtcaattccaacaggggtaataaacacttgggttggccccgtggggttggggaaacctttaaatgcccattacagccctggggaacggtttcatccctaatggaaggactcttagctttaga

SEQ ID NO: 588833 - DNA, 1009 bp, Homo sapiens
  misc_feature (534)..(534): n is a, c, g, or t
ggaggccgcaggcgttggcgggcagcggcacggccggcagggttcggggtccacaccaggacgcagaggacggccgaggcgtgtctgggaccggacaagccgctggtgatggcatggcggtgggaatgaggtcaggagaggcgatcgctcacgctgagaggccgctgctgtcagagccccaccggcgataccgactaggagaacactggacagtaagatgttcttgatatgagactttttccttccacggtactgcgttccgcatgctcctgggtggggtgcagagtgtgatcagctcaagccagaacattctggtcgtaagagatgctgtctcgtcttcatgtttctcaaatggacttggcttcggcaaatcacttctgctacatgaaagccagcagcctgtgcagctctgggcggggggcatgcctgctatccagctcccggcattgttgcacatggctttgaaacgcacggcacagctcgtgtggcccaggtgcacctcgctgccaccctgcctgctgacctccatcccanatgccggtcctcgctgctctctgtggacctctcccggacgtggcgtccacctcctcctcgagggtcaccgtccagggctgtattgaactagcgcctccaagtccttgcattaccgtgcctcctgttttgggtgagacttgtgacgctatctctattaacttagtttggtagctccggtcacctgtcgagtcaccatggggcccagaggggacgcacagagggagaaccggctgcctgggatcccttctggttgcctcaccatcaggttgcggactgagggagcctcaacacctcagcccaccaggcggcggccaagggctggacaaagtcaatgaatcccctcggcacattcctccgaagccaaggcaagtgcctgccggggaattctaatcgcgcacgcttaccaaaagatcatactatcccaaggtactccgcacggggaacgcgagacccttagtaccgctggaacgacctg

SEQ ID NO: 588834 - DNA, 422 bp, Homo sapiens
gtcgacagggaagcagtggtaagagggagatagcccacacccaagaagccactggtacccctagcaggaccttcgggactgttgaacaacaaatcagaactacaaagggcctggttaagatcaaatgcctgccccacacctgcctctatagttcactcacaaaccagctgtaggtttcttcttccccattgtcagtgcctcaacgaagatctcataggagaagggagctccagcagtcaggtagcatcctggcctttatcctcaacccactctggctggtgaagcagctaaatcccaaagctactcctacctatcctagacactgtgattctactcctgcagtaaagggggcccaaggaagcaccatccagggtctctgcggccaccagtgagaagcagacacacatactccaaagttgctg

SEQ ID NO: 588835 - DNA, 434 bp, Homo sapiens
ctttccaaaacgcctaattctgtgctaggttgtgagggcacaagacttcaagaccacttgccctgcctgccagtggctcatagtccagtctaatgctagccaacctgtctcaccatcttcccactttatgttctatctaaggcaactcatttattcccacagctttacttccatctgttgatgactctcaacttttcatatctccaacctagacctttcttcagcttccacagctgtatatccaactatctactggatatctcttgtatgtttcacaaatccccaaggcttaccatatttaaatttaactttttcattgtctacccacacctcaacaacagaaaaaacaaatgttggatgtaattattatctttcctaaattccgtatcttgttaaatggattaaaccattctcactcttggcttccaaaaaaa

SEQ ID NO: 588836 - DNA, 319 bp, Homo sapiens
tttaaagttataactttttaaataatttttatgagttacatatctacttaatccattccctcatgatctctgcaaacattttcatttctggatgaatcattttttctctgcaagtcttcagttgagaagctgtgttattgagctcacaagtggctttctacttactgaacccataacttgattcagttttcttagtctcattgcacgcactctctgtcaccttaattttaccggctcaaatgggagcagacaccagtgtctcccatgcagatgccatttcttcatactttcctccttcaacatcacagcctaggaattg

SEQ ID NO: 588837 - DNA, 1277 bp, Homo sapiens
taccagggggaaaatacctttaattggaaaccccaccaagtggcaaaatctggtccctgggctattaagctcctctttcttcctctgttggcaattccgggttcttttcttccatgtggtgcccctatggatatggcttttctttctccctcccatgggtctggagaagcgggcctatgggcacaaatttgggaggtgggtgtgccaatggactcttaagggtacaattctttctcccaagaggcccggccggattcggttctggacaccaagacaaggagatttggcggagaaagggtgaaaagcacccgagtttctagggtctcccacccaacaacaggctctttacaagacttgtgaacaaaagtgtccctcttgggtgcacactcttcacaccccattagtgtggagacacacatagtcgcccaccccccagagaggtgtgtgagagaatagcgctctctgtgtgtgccaaagacataagggtacaataagagtaccagagtagagaagagagacgctatatgggtgtctcatgatggggactaccaaacagtctttaggacgccgtggtacatcctgatgagaataacaaagggtgtagaacgcccctcttgtgggggccacataatctctttttaatacaccaaatagtcttctccctatgggtggaggagaatatctcaacaaaagtgtcgacgagagagaggaatgagtgtaaaacggcgcttatatttcgtaggggcgccacgcaaaagagctgcgggttgtggcaccaaacaaagaagacaagaaagaggggttaataaacagagaagagacgacaagaagggaatgtagccacaatatggggcgccccacaaaatataaacaaaaggggggcgaccaaccccttgttgggcgacaccagaggaggcccatcatcgagaggaggggaggaggaccattaatgggggaggaagaggagacacaaaggaaatatacttatagagggattgcggttgtgcgacaccaacaagaaaaatctggtgtggatgtggacaaccccccctcattatttttggtgtataacaacgccaccttattcagaggaggccccattttggtgtggattcaacacaaacccccccgagagtaaaataagagaaaacgagtatgcaggaaaataccaacaataacgtacaacaattcaccatgctgtggggacgcccacaaaaagacaacacattggttgtggtggtattctcccaccacaaggggggtacaacaccccatag

SEQ ID NO: 588838 - DNA, 824 bp, Homo sapiens
gtgccactgcactccatcctggacgacagagtgagactctgtctcaaaccaatcaactcaatcaatcaatcactgtcctggccagttgcagtggctcacgcctatggtcccaacacttcgggaggccaaggtgagaggataacttgaaactaggagttcgagaccagccagggcaacatagtgaggccccatctttacaaaaatacaaaaattagctggcacgctgctagctcccagctacttagcgcagcgctgtagcgggcatggcactctgccttgaagcgctgcagagattgacgccctggcagtgacctcatgcacgaatgccacatcgcctgctttaacaagcctcctaccgacctgacccgcacgccagcatccctgctcctcctgcgccataccatacctacccctgccttccccgccattctcacctgttgccctccctcactcacaccacctctccgaccggccggggccactccgctgcgctctctgccctgcttcctcctcaccccacctctctgcgccacgcgccctccgcgcacggctgcggcctccccctgcgcgggctcaccgcaacggcctccgcagcaccctacctgcccgtgtactccaactagtggcccgacaaacccccgactccctccttacccttaccaccaaccctccgcacacacaactcccgcccagacctgacacccctgcctcgccagccccctacgcaactccccaaaacacctcccaacgcagcgccaaacgcaccccacacccctcgtcccgacccctgcgcaacgccccccgccggcaccacccaccacccg

SEQ ID NO: 588839 - DNA, 417 bp, Homo sapiens
gctgtttaatcatgattgctacgacggtagcgttatgattcagagtcagaaatgatagtggtgtcatataaccagagattgtccacataggtggctgagatagtgaaaccctgtctctactaaaaatacaaaaattagccaggtgtggtggcatgtgcctgtagtcccagctacttgggaggctgaggaaggagaattgcttgaatctgggagccagaggttgcagtgagccaagactgcgccattgcactccagcctgagcaacagagtgaaactccctctcgaaaaaataaaaataaaaataaagaatatatatatattataaaatactattttcaggctatgtgtgtaatgtgtatacaaagcataaatgaatttggtgttattattaagtcccatcccaagtattccagagta

SEQ ID NO: 588840 - DNA, 112 bp, Homo sapiens
gcatcccactagtaagcctgatatcagccagcaattaagataacgttcaagctcaaatcccactacctaaaaaatcccaaacatataactgatctcctcagcacaacctgga

SEQ ID NO: 588841 - DNA, 763 bp, Homo sapiens
tagggtacctccctttactctggagctccagtgtaccacctctaaggatgaagcaggtgtctcagaacaccctgagtgcccctgcgagagaacctttgagaatggacaacccctcagcaaggagccagtggcccagtggaggtcacactgtgtggccaacaaagcacaaggtgctatggagcctggcagggcctgcgcagaccttccatcttgcctgagggctcttcagattcaagatggtctcagccgtggagaaacatcctgtggcccctcagacactgttgtttttcgggagaaacaaaccaaaggaggtgatgggagtgctatatcaagaagctgctccaacatcatcaactcctcccagctgctataaccaggagtatagtgatgttgtcctgaataaggagataccagagccagcagcggctgggagagcctgtcctgatgacacaccgggcctaactctcctggagggcacgcctcgtgaagtgccctggttcttccataccgagtacgtagcctgcagatgtgcctctccatgtgctccagcggatccctctggccagggaaattcccgatgggtgctgcaacagacaccgtgctagtctcacatgacccatgaaaaccacacaagcttgaacacgtccaaattatgacccaagattgcagtacaaaggcctcctctaactggccacgactaacatagttgtggaataatcatcacatttaaattcactacggccacactaacacacagaacaac

SEQ ID NO: 588842 - DNA, 415 bp, Homo sapiens
gctccaaggccgccgcgtatactcaagtactctagttggccttgcagaacctgtgtatatgacaagtcagccctctgtttatgtgagttttgcatcccacaaatactgtattttccacccacgtctggctgagaaaacccgcatatgagtggacctgcacaggtcaaacctatgtagttcgaggggtgactgtattcagaaatctgaagaaatcccaaatctttttaaaacacttacggtcccaagcacttgggaaaagggatacgcaatctgtagagtaccgtgtagagacgagtatcgagtgggtgtggttgacctgatgctcactcccactggaataaaaataacagcatttatctctgttgtgttttttaactggctttcatccatagatttattgatttgcttgattcaa

SEQ ID NO: 588843 - DNA, 318 bp, Homo sapiens
  misc_feature (140)..(140): n is a, c, g, or t
  misc_feature (177)..(177): n is a, c, g, or t
  misc_feature (186)..(187): n is a, c, g, or t
  misc_feature (278)..(278): n is a, c, g, or t
  misc_feature (295)..(295): n is a, c, g, or t
ctgtgatcttggtgtgtgtgcccactccagcctggggaccacttcagaaggtaggggcgtgtccgcggtgctgactgaggcctgcttccccctccccctcctgctgtgctggaattccacagggaccagggccaccgcanggggactgtctcagtaagacttgatttttccgtcccntttttctcnncacactcacactgacaaacgtccctcagcgggtttccaacttgtgtggcttcagtgtgttttcagagcacaacccaaccacaacaagcaangtgcattttcagtcgtntgtgctttttttgttttgtgcta

SEQ ID NO: 588844 - DNA, 108 bp, Homo sapiens
atatcgagctcgtacctacactgaatcaccccactgaaaaagatgagttctgcctgtgtgaaccatgtgactttgtcacagcccaagatagttaagtgggatctgaga

SEQ ID NO: 588845 - DNA, 942 bp, Homo sapiens
gcaggacacacggggtgctgtagcagcaaaccataatactgctgccgcgggattgtccatttacatattgtcgtgccatccgtttctctgccggccgcattaccggggccacaaaaatgggccggccattgctatacaaggttagtagaacggcctctcatgcatctgcggatctttatggcgtccacacgggcgggttgggcaaaaaccccttatggggccacaaccacatcctcctcatgttgccggttcatggctctgttccgtccatggacaggggcaagaccattactgagtcccggttcagcgcctcggcatactgccgcctgttatctctgtggtggagagggccttacttccgcggtgctcccccccggggctggattgttcccgccccctatccagtggtagccctgcgcgtgaccccctgctcccaggcctttggcacctatgcgttcccagcccctggggaaactctgcttcgggcgccgaggaccattttcagcccccttgtcaagcacaccccgccactggccctttgtggtttttgcaacacaacgcgacccctgtatggggccactagggaatagcattcagggtcattttcctgcccttcctctcccgctctccttgggcagagcacccacgcccagtacacgcggccaccatcatgcgagcaacccccctttctggcagcacccaccgaagggggccgccccgtggaacacacccagggaagggcggggccctcaccacgccgagcacacgagccggtcgtctgcatccacggtcggaacaccaacgcccgcgggctcccccgcggtcgccgccacgatggcagcacaccactctcccgggggcagggcaaagtagtctgtccgcacaaaagcaaaaggtcttctggggccgcttccggccggcgattccaccacaacaaaaaca

SEQ ID NO: 588846 - DNA, 936 bp, Homo sapiens
tgttgtcgtggtccgattcactgcctccagggttcttgcccaccgtggcgctatccctggcttataagcatggctttattatctagcgccgggctttgcccgtgcttggccataacccccgtggccgtgtttccccaattccgcacggtgtctctcattgccgcctcgcgcccgcccagtggccgtttcctccgggcctctcttaccagaatgccttgcgcctcttcggaccccggctttcttgcgcttctcaaccccagggttgccactccccctcttcccggagcgcgttgtttgttagccacccccgcccgtgctagggtgacacaccagtacgccttcccgcgtagttgggcgctgccccatcccctgggaatcacaaagggagcaccccccctgggctcttctttggtgtgacctggagtcctgggtatttttgcccccccgtggtggaccccttcccccgtaccccccctctggcgggtccccgctgcatgtgttcttctcacaccgggttttctccagtagtttctgaacgagtagtcccgcgtggccttctgtcgagaggtcctcgacccccagcggtttcttcgccgggtgacccggcagtgtccctccggtcctcgggttgcctcttgtgatttcacggactcactagagtgtccaccaccgggttcgtaaggatagactgtgctccctcccagtgtgcaattttccgcaccattgccctcccatcataaagctgtggggttcccttgccggccccgcccgcgaaagatctggtcctgccgtgcgttggcccctcgcagcggccccctgtgattggcggggcgccccccccacggtcccgtttgagaccggttcgtgacactacggttctaaaccccatggacaaaattgtcagtggcaaaaaaaaacccacttctcttcaaaaca

SEQ ID NO: 588847 - DNA, 309 bp, Homo sapiens
  misc_feature (148)..(148): n is a, c, g, or t
taattcaataataaagttcttattctgggcaggcaacggggcgtcacgcctgttagggtcagcactttggggaggccaggggggtagatcgcttgagtccaggagcttgagaccagtctggggcacatgaagcaatcccatgtctacnacaaaatttaaaaaaatatttgccaagcgtggtggcgcatgcctgttgttcccagccacctgggaggctaaggtgggaggatcagagcccggaagattgaggctacagtgagccgtgattgtgccactgcactccagcctaggtgacagagtaagaacctg

SEQ ID NO: 588848 - DNA, 545 bp, Homo sapiens
cctacctgaacaaaatgtgtatatacatacaattacgtcagccataagaatccatctttaatatatgttgatgacatgtgattagattcttagaaagacttatatgcttccaggcacggtggctcacgcctaccatcccaccaccctgggaggtcgaggtgggcagataacaaggtcaggagatcgagaccatcctggtcaacatggtgaaatcctattctccaccaaaaacacaataaattatgccggacattctggcacatgcccgtagtctcagccactcaggaggtcgatgtaggagattcgcacgaacccgggaggcagaggttgcagtgaaccaataccacgccattgtactccagcctgtgtgacatgagttccctccagtctaagagaacaataaaaaaaaactttatgcttagtgaaataagccagaaccggaagggcatatatgttataatttcacttttatgaggtacctagaataagtaaattcagagacaggaagtagaacagacattaccaaagggtgatgtctgggttca

SEQ ID NO: 588849 - DNA, 662 bp, Homo sapiens
ggacgagtagctgagttaggaggactgcttgaatccagaagtttgagggcagcctggaaaacatagtgacaccctgttctctgtaaaaaaaatcaaaaaattagccgggcgtggtagcacacgcctgtggtcccagctacttgggaggctgaggtaggaggattgcttggatccaggagatcacggctgcagtgggcctggagtgacagagcaagaccctgtctcaaaaaaagaaagaaagaaagaaagaaagaaaaagaaacaggtgtagggctggacacatggctcatgtctcatgatccgcccacctcgggctcccaaagtgctgggattacaggcgtgagcccaccgtacccggccgtacttgttgatagtaaacttgaagcccaggaaagattggggataagaataaaaattaccccaaatttccaaatcaagaagtaatcatggttcaggtttgggcagatgtactttctaggcatgaacacacgttatctcattgtttacttaacaccgggttataaacatttacccatagcatttgaaaggtagctatagatagaaaagaatcagagaagttctaaaacagctcttgcgcgttgtttcaacattctctgcaggaaagatgaggtcgtcagccctttttttaactcggacaaatc

SEQ ID NO: 588850 - DNA, 283 bp, Homo sapiens
cgtgagtaatggccttagctgtttcctgaccataaaactacgaattgttaaacattagcaggctttgggggggtcataggggataaacgctgctctcatgctatctttcaaagtgaagatgggtttgtcaagagataaaaagccttgtaagagatgctgggccagagataggagtttgtaggaatactagattctctcctggcggagttgggcaggggaggtgagcacttgagtttgagtggcatgtacagggtttgtggtaggccccacagatgacccccag

SEQ ID NO: 588851 - DNA, 388 bp, Homo sapiens
gagggcgatctgctatcccacctgtagcagaactgttacatcgtgggtatcggttctgcatctcctgctccatgcattggtggaggtggcaggtggttcatgtggtctagtactaataccctttcctcagctctagtcagaagctcactcatcttactcaatggctatgctgaaagtgtgttacatccatccatataatccacgtttgtctgacgtcttgtttcaaaatgagaggctgggccattcgctacttcgttatgcttatgttcgagattagcatcatcttcagtccagctctggtccttgggccagcttctgccattctcgccgcctgtcatgaggtgctctttgccctttgtctggttcatgaggtccatctagatttttc

SEQ ID NO: 588852 - DNA, 100 bp, Homo sapiens
ggaaagaggtcaccaacgggcagaaggtgtccagggcgcagccagcgagccccacctgttggggatgcttggtctgcaagtagtggcggccccaaagaac

SEQ ID NO: 588853 - DNA, 120 bp, Homo sapiens
gaaaaggggggggccaaggggttttgtaaaaggggggggggggggaaaccccaaaggggggggggggggaaaaaaaagttcaaaggggggggggcccccccccccccaaaagggagtata

SEQ ID NO: 588854 - DNA, 795 bp, Homo sapiens
  misc_feature (20)..(23): n is a, c, g, or t
  misc_feature (279)..(279): n is a, c, g, or t
  misc_feature (508)..(508): n is a, c, g, or t
  misc_feature (549)..(549): n is a, c, g, or t
  misc_feature (557)..(557): n is a, c, g, or t
  misc_feature (574)..(574): n is a, c, g, or t
  misc_feature (610)..(610): n is a, c, g, or t
  misc_feature (656)..(656): n is a, c, g, or t
  misc_feature (773)..(774): n is a, c, g, or t
gaagtcgaggcgggagtgannnngcttccgtttctggttttgctctagtgttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagtntttaaagccaaaagaggatgtatgagcagcagcgggacaatcttgcccaacagtcattcaacatggaacaagccaattataccatccagtctttgaaggacaccaagaccacggttgatgctatgaaactgggagtacaaggaaactgacagaaggcatacaagcaagtgaagatcgaccagattgaggatttacaaagaccagctagaggatatgatggaagatgcanaatgaaatccaagaagcactgagtcgcagttatggcacccnagaactgnatgaagatgatttaganagcagagttggatgcactaggtgatgagcttctggntgatgaagacagttcttatattggatgaggcagcatctgcacctgnaattccaagaaggtgttcccacttgatacaaaaaaccaggatggagttctggtgggactgaatcttgatttggcacagatccctgcttcatagatttgcatcattcaagcatattgnnaaacaacactttttgggatgg

SEQ ID NO: 588855 - DNA, 205 bp, Homo sapiens
tcccaaacctcttcaccttactaccagacaaccttagccaaaccatttaccagattaaagtataggcgatagagattgaaactcgcgcatagatattagtaccgcaaggaaagttgaaaattttaccagcattatttagcaaggcttaaccctattacctcctgcataatgaattaactagaataactttgcaaggagggccaag

SEQ ID NO: 588856 - DNA, 824 bp, Homo sapiens
  misc_feature (20)..(23): n is a, c, g, or t
  misc_feature (279)..(279): n is a, c, g, or t
  misc_feature (537)..(537): n is a, c, g, or t
  misc_feature (578)..(578): n is a, c, g, or t
  misc_feature (586)..(586): n is a, c, g, or t
  misc_feature (603)..(603): n is a, c, g, or t
  misc_feature (639)..(639): n is a, c, g, or t
  misc_feature (685)..(685): n is a, c, g, or t
  misc_feature (802)..(803): n is a, c, g, or t
gaagtcgaggcgggagtgannnngcttccgtttctggttttgctctagtgttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagtntttaaagccaaaagaggattttctttcctctggcttctgccatacgtggtatgagcagcagcgggacaatcttgcccaacagtcattcaacatggaacaagccaattataccatccagtctttgaaggacaccaagaccacggttgatgctatgaaactgggagtacaaggaaactgacagaaggcatacaagcaagtgaagatcgaccagattgaggatttacaaagaccagctagaggatatgatggaagatgcanaatgaaatccaagaagcactgagtcgcagttatggcacccnagaactgnatgaagatgatttaganagcagagttggatgcactaggtgatgagcttctggntgatgaagacagttcttatattggatgaggcagcatctgcacctgnaattccaagaaggtgttcccacttgatacaaaaaaccaggatggagttctggtgggactgaatcttgatttggcacagatccctgcttcatagatttgcatcattcaagcatattgnnaaacaacactttttgggatgg

SEQ ID NO: 588857 - DNA, 330 bp, Homo sapiens
gcttagttgacatgctcagtctgaggcgtctaagacacacctggtagttagctaggagaggataccaatgataatcagctcaccaatgttatcttaggctacagtgtccaggcacaggaacacaatgatcaaactgacgaggtcctgcccttgtggtgcttgtcgtgggtgggtcctgagctcagaacagagaccaagactggggacagatgtgcgcatcgtcaataggcgacacctgaattggcaaagtggctgcaatcactcaaggacacactaaacataaggggaccagagatgacagcaattccccaggtggccccggtaccgagc

SEQ ID NO: 588858 - DNA, 342 bp, Homo sapiens
  misc_feature (342)..(342): n is a, c, g, or t
ggagaatctatcgaatccaggaggaagaagttgcagtgaaccaagattgcaccactgcactccagcctgggcaacacagcgaaactctgactcaaaaccgaaagggaaagatgaaggaaacgaaagcgataattagggactgggaaagacaaagactgaaggattggtggcaatgagttatggggaataatacgaatgctcaccaaactattatcaggaaggttatcaaatagatatgagggtatgcaatctttttgaccatgcactacattgcttgctcagaaggctaatatacagcaacattggaggtagcagcagagaatacacataggtttagcctgn

SEQ ID NO: 588859 - DNA, 553 bp, Homo sapiens
tagtccacgctcgggagccatgccgtccaaggtgcccgctgcagtctgtgcaggtcttcggacgcaagaagacagcgacatgctgtggcgcattgcaaacgcggcaatggtccactcaaggtgaacgggcgggcccgggagatgatttgagccgcgcacgctacagtacaagactgtctggagtccagttctgcttctcgtgccaagggagcgactttgctgggtgtatacactccgtgtccgctgtaaagggtggtggtcacgtggcccagagtttatgctatccggtcaggtccatctccaaagccctggtggcctattaccagaaatatgtggatgaggcttccaagacaggagatcaaggacatcctcatccagtatgacgcggaccctgctggtagctgacccgtcgtcgctgcgagtccaaagagttgggaggccctgtgtgcccgctgctcgttaccatgaaatcctagccgataagcccatcgtgactcaaaagtcacttgtataataagacagttcgttggagggatttctaacagtcttccaa

SEQ ID NO: 588860 - DNA, 934 bp, Homo sapiens
cgtgcactgcccccacaccttcacccgttggtgtcccgagaaggaaagagataacgttccacctgagaaagcggaagctcctggctctgcagcggggagaggacccaggaaaccggaagaggtcagaagaggacggaggaagaggacgacaacaacgaacggtgatcgctcgatgaagaggggagaaaatgaggaggaaggaaggaagactgcagaggctggttcagaaaaggacggaagaggcccggctggcagccctggaagagcagtagcgatggacggcgaagaagtcccagggtgatggcaggcacctcgaagctggaggataagcagcggctggcccaggaggaggagagtgacggccaagcgcctggccattatcgatgactgaagaagacgggagaagtacctgtaccagaagatcatgtttggcaagaggcgaaaaatccgagatggccaacaagctgcgcggagaagcggaaagcccacgatgagcgcggctagaggtctgagaagaaggaccaagaaggtcaaggccggagtagagctagcactgatggcccctcacagggcaagaggccagcccgctagacagctaggatgtggcaagaggcaggcctagaggacataagtgtgatggatcaagagtcaacttctcactcagtcctttctccagccagccactgacccctaatgctctctggcatgggccagagggcagcccatcgcttcctcattggatcggagctgccatgctggtgcctggtcagagaagaggcctctgtgctgagcttgatataatctgctccaagagagccagtgacatgaggcgcagaggccaacgcagcaccctactactagcatcaattcatcatggctataacagccacctccaacacagtggacccggattacggcgggtgatgagtggagg

SEQ ID NO: 588861 - DNA, 136 bp, Homo sapiens
caaagagttggaattacaggcctgagtcaccacgcctgactggaaaaagtcatttgtaacccttccaccagaggtgactgctattaagatttttagcatatttgtttccagatttttctctccaaaagttaacttc

SEQ ID NO: 588862 - DNA, 458 bp, Homo sapiens
  misc_feature (82)..(82): n is a, c, g, or t
  misc_feature (88)..(88): n is a, c, g, or t
tgctagcggaatattcgtgcagcgacgcgtctttcgtagtactcattcatcaaatggagtctatttactcgtcgtataaaanagggtngtggagatagtgtgtgaaaacactatgcgtcttttgagctcattatatctgtgcacacacatatatatcacacacagtgtccccgcgaagtcgtgtgtgagatatatgtctcgggtgtgtggtgtctgtgacacgtagacccgcgttttgggttataggacacagcacacactgggctgtgccgacatttttctgggcccttcttaccaaaccaagggaggggagaaggacccaattctttttcttttggcacgcgaaccggaaccggttttgacacagggccaaggagagaaacactgtggtgtgcagagatgaaacctgggtgatggggaggtctttgagcaaccttgtttatgagactattgattgc

SEQ ID NO: 588863 - DNA, 1448 bp, Homo sapiens
  misc_feature (1208)..(1208): n is a, c, g, or t
  misc_feature (1236)..(1236): n is a, c, g, or t
ggtatgcatacacggtgtgttaccacaagtatgtctgcccccgcacgcagcaacaaccacgaatgtggaatgaacactactctgtggggggggtactgggctcacactacacacacactgtctgcgactttactggtttgatgtgtgcccaccacccctttcttttaattgacccccgacgaaggagaagagcgttcttttcctgcagagaaaaggaattttaccccacacaaaggggcgcctttagatacccccacggggggaaaatacacgagcgaagaaagggtgtgttgaaaagttattaccctggttttgaaatagtcgcgggtgttaaatgttgccgtgggtgaaccccgttgttgataaaaagcccacgtgttgctgaaaaagccccctcgtgggagccccaccccccccctcgtagaaaagaagaaagttggtcacccaccgggttgtggtgcttaaccggagattttgtccttgcccataaactccgcgggaagggagaccacacaaggggagaaattttggggcccacacatagaattcaaatggccttcgtagatatgcccacaacttgtagaaacaaaaagggttttggggagaaagaaaaaaaagggggtggttccacttccacccaccgcttataacagggagatggcgagaaaaaccccccctggagacttggagtgcagagatttatgagaattctatattggaaaagcgcacatggaaaagtttttgagatccgcagagcgccccaacatatatgtttgccccccaaacaaactctttaatttaatagatctattccccacaaagagtgtctcagagaaattgtgggagatatgtcccacaggaaatggccctcacaggtgtgtctcgtgtgtgagagtgtgagaaaagagaaaatagtttctaacgtgatacccacggtgcccactttgggtacacctgcctccttgaaaaatttccccacatgcggctccccgtaaagcccctcttgggtctaataagatcccctgagaagaatagtgttgaatgtgaggagaagcgtcttaaagtgacacccctcgtctttgagaataagggtataaaggttggttcttcacaggtttgtggcacatcacaaggctcccacagggtgtttggtggaccacacatatagaaaagaacccacagcttataaagaataattggctatattngctatacttggtgggtcgcacgctgttntggagaaagaagggagttgaccccctgaaattcttgaaaaacgcttcacgcctcactgagcttatggagaaaagttggaagaaggtcacttgtgagccacaaagacgaatgccacatgcttctttaaaaggaaaaggtgacacaggctccaaattgaaaaacgtattccagaaatccttgagcagttacccccccccaactagtgaatatga

SEQ ID NO: 588864 - DNA, 943 bp, Homo sapiens
  misc_feature (64)..(64): n is a, c, g, or t
ggcgccgaccgaaaggacgattcaaaggacgcagaaggacaacgccttgcagggactcccaggnatgatgatcctcctgtgacccgggctacctgtagccaaaatgcaactaggatccagttaatcgctctcatttaatgacccactcttttcctttggaaaatacaataaggacgtcccccatacacggagtagaatggtaaaaaaaaacacagagacaggaaagagagcaagacgaggaaggaacacggaaggcgagcaccccaccaccaaggagtcggaagaacccggggaagcgccgaaacctgggagaagggggcgcaatgaacacgaagcgacaaaagacgaaaactaagcacgtgccacgcgccaacccgagtagcgtgtgaagcctcaaacaactcatcgacataacgaaggagagtatcagaagtaacgccaagatcaacccccaagaacaatagaggcacggagggtaaggtagcagcgattccagaccctggcccaggccctccgcgcgacccgatgtcacgacgcgggcggcggggcacgacaagggagaagcagaacagagtgtgaggggcagggaccacgatggcgcaagcaccggcaagacacgcgtgagcacgacgaagaggacgcgacgcccacgacgacagccgacgatacagcaacaaagcgaatgaatcaaacacctattctcgtccccggccagccctcgcacgacacctctcgagctcgccacacgtgatgagtgaagcacctgacgagaggggcggccatacgggatggacagcgacaaaaaataaagcaaaccagacgccaccggagacaacgatggacggacgagaacggatagccgagttaagataaccaccaacaacaaagagaaaacgtcgtaactaccatggcaaaaacggagaagagaccgcatcgagctgag

SEQ ID NO: 588865 - DNA, 1562 bp, Homo sapiens
  misc_feature (1210)..(1210): n is a, c, g, or t
  misc_feature (1257)..(1257): n is a, c, g, or t
  misc_feature (1354)..(1354): n is a, c, g, or t
cttgtgggctccgcttccgacaaaagatggcgtcagaaggatatagtgtgtggttctcttgctttcacaagacaggagatatgtttcttctgttttgcttgtgggccgcgcaacaacgattgttgtcgctggtggttgttgtgctaccatcgcccctactgatttatgtgttgcctcccctccccccccctcgttgtgggggagcccaccaacgcttggtgggctgtgttcacacgctgggtctccccagaggggggggagtttattcttcgctcttggtgatccaccctttctcctcaggggcgcctcctctaatttgttagtgcgccctctctcggcggcgttaatattgtgtcccccccccccggtgtcatatttgtgggagaatttttggcccgcaacacacaaccccgcgggcgtgtcaacaccaccgtgtggtggccaacaacggccaacaaagttgttgtgtggtctcggaagagcttttcgtgagagaaggggtgaaataaagagtttttggatttttcccccccgctcttttcttgtggggtgtaataatagaagtcttctggcgaagatagtattttgggcccccctcaagaaaagtgttctctgttgatgagtagtgttctgcttgggtgtggaagaatcgtctctgcccccacaacttgtctggttgtattgaagatattagtgggggggtcttcttctcctggtgggccaacaacaggaccccccccacacatggtggttggtgtggttttatgatgaggaagaagacggcttttcttcttctacaggaagactcatatagttctccacaaccccgcctctttgtgggtttctctctcttgtgtgtgctctggttttttctgctgtgaggataatatgtagagaccacacgcagccactactactttgttcttctggcagtgtggtgggggttgtcgttctactattccacacagagcacacagctgtgggagcaccacacagcagcagagtgggctgtgttcctgtgtggagagccctctgtgcgcaagaggtgtcacccacaaacgtttgctcgcgccccacagcgaacggcgctctcacgcagagagggtctataaagtgagagatatattttatctcctctctatatatcaccgtcgtccccaccgcgccctctctctctatatatccacagctcgggtgtgagacagaaccnactgtgtctccacagagactctctgctttttgtgttctcacacattngcggccacatcttataagtgttatcagtgatgagtatatacaagagactcggtgtgtataatagagattataccacacattgcactctctgtgtaanacacctctctcatcgagaaggaaaagagagaaatatttttgttggggacccctcttggtgttttcttttttggcgctgtgcgccgcatttttaagatgttatattagtgtttttacaaacaccaggacttttttaatagggacaccacttggaccccaaatattgtccacagagattttgagaccccctttaaaaagatttaatgaga

SEQ ID NO: 588866 - DNA, 103 bp, Homo sapiens
tcccacaccgtgcacctgcgtcaaatgtatttatgctagagtcgccacactccacggaaggcaatcatgaacatgatcttgctgcagttggtacctgagctcg

SEQ ID NO: 588867 - DNA, 80 bp, Homo sapiens
gcggccgcctactactactactgctcgaattcaagcttctaacgatgtacggggacatgatgggattaatgcccttatgg

SEQ ID NO: 588868 - DNA, 221 bp, Homo sapiens
tacaaaagaactgtgtattccagcaaatatccagccttgcattactgtatcataaacattctgtatgctttttttttggtagtaaagtttggtagggggtaatgaatgcctggagggggttggttagaagtgagcaaatgcttccggaaggagatgaatggttatgtgagtttggaaagagaagtgaaagccagacaagggtagaggtgggaggagaggaa

SEQ ID NO: 588869 - DNA, 245 bp, Homo sapiens
cgagaggtaacctcacacgattatttaccttccacttcatctgccttcattatgcagttctagcaggactccacctcctattcttgcacgaaacgggatcaaacaaccccctaggaatcacctcccattccgataaaatcaccgtcccaccctcacacgattctttaccttccacttcatctagcccttcattattgcagccctagcagcactccacctcctattcttgcacaaacccggaagga

SEQ ID NO: 588870 - DNA, 408 bp, Homo sapiens
  misc_feature (106)..(106): n is a, c, g, or t
gggacgccttccccggggccccccgggggaaatattcttttttttctcgagggcccccccccttttgtggtgtggcccaccccccctttgaggggggccccccccnttttggtttttgggccccccccctttgggcccccccttggggccccgggggtttcccggggtttccccccccccaatggggaaattggttccccccggaatggggggtgggttttttcaccccccgggggcgccccccctccaaatttttccaatttttccccccggccccggggggcccccttttttgggggggggggttttttccccccccccccccccaaagacccccctttttttccccccggggggggggggggggcccccggggggggtttttttttaaaacccggttttccccca

SEQ ID NO: 588871 - DNA, 229 bp, Homo sapiens
aaaccaggggggaaaaaattttagggtccgtttaaggttttattaaaaaaccccatttggattttttccgggaaaaaatttgccaatttggttttcccccaaggaggtaaaacctgagggaaaatccccccttttttccctttttggggtaaaaaaaatccttttttccggaagaaatttttttactaaatgttccccgggtttaaaaaaaaaggccctttaattttta

SEQ ID NO: 588872 - DNA, 84 bp, Homo sapiens
gcacacacacacacacagacacagaggacatacctttcattctcaaatgtttcactgatactcacccccttctgtcgtcttctc

SEQ ID NO: 588873 - DNA, 778 bp, Homo sapiens
ctggccagcatcggcgtttattggttggatataaaaaagtcaaacttatacaagcataaggtgtgttgctcaagtactcctgtgggggtggggcaatgatgaaatgagggaactggcgcctcaccctatactctgttccgtatttctgtagatatgatatccaccacagagactaattcacaagagacagaggagtgtctgtgcacgatgattacacaaaggagcctaagtgactgtactagatttcttactatagaggcgtgttaggttttttatttagagagcgcggggagtatatttcgagactgttatctcttacgtccccctggaccacgccttaaccgcacatagacgccggggcgcgagccgcgtcggacgcagccctggctccccaccccccgcgactccgccacccctctcaccctcacaattcacacctcctcttccccaccacacccgacacccccgggctcccctacagtctcatttagccgtcgtcaccccacaaacaaaggttgagatgatctaactcaatgcgactcgttgtttttgtttgaaaatatcttatatttcatactcacttactctatctttcgatctaagttaaggcctaggtctaactgtgttgattaactttatatgccgtcatgtttccccatatgtagccccctccctacatcatcaccacatccaccgccctctttctcgtctccatgtacgttgtccgccctcaccatcctatgcctgcggcattgcccgagtattcccttaatgtctg

SEQ ID NO: 588874 - DNA, 906 bp, Homo sapiens
  misc_feature (392)..(392): n is a, c, g, or t
gagcgggctcggcggcattctacgctgcagtctcagctgcaggtgcaggacatgagccgtgcacccggaggagacccccggaggaggcgagcgaaagcttcgcagtagcacgtgaccaatcccacgagacccctgggttatgctctgcagctaggtggcactcatggcgtgttctctgctccgccatggccatggcatgcgccgtggtgcctggctccgaggctcctggcagcgtttagcacgatagttcgtggaaggagacagctcagaaggaccgcgcttttcgtcgtgcggcatcagtgtggcagactggcagcacacatgtcgggggacgttgctccggcgggcagtccctcaacgcaattcccgttgcccatcggtccaactaaccntgcggggccagcccggctcgaattgccgcgcggggctgtgcctggggcttgctccgctggggtcagagtggacttttccctggtcccggggggcccgggaggccagacggtggctggagtgagcgcgggggaggttgccgcgttcaaggtgaagcgaagagcgctagcacgagttaccgagttggacactagacctggcgtaccccacgccgttcgctacaacccgaccagtactccacctgggcagcttagcagccggagagctaggcggcctccactaaactgaaatcttcaagggggttattcgtaatcaaggcgtagtgaaagggttcgcgagagctactaggtcacattctggatgggacaaggtcgatgacagaacagccttggttgggtaacgcgatcaaaaggggttccgaacacggggaggttccgtactttttcttcttaaccctggagaaagggggctcattgccgctgcatatttcctttttcggtcccattttacttgggg

SEQ ID NO: 588875 - DNA, 880 bp, Homo sapiens
  misc_feature (880)..(880): n is a, c, g, or t
gacacccaggccggcaaagagcaggtatcagcactgcaagcaccaagtgtgtcttgagctcagtgagtactggtatgtgtcacattgccaaatcccggatcacaagtctccatgaactgctggtgagctaggataataaaaccctgacatcaccattccagaagcttcacaagactgcatatataaggggctggcttgtagctgcaagttgaaggagctgaccagccagtgacccctcaaactcacctagccaccatggacatcgccatcccaccacccttggatccgccgcccttctttcctttccattcccccagccgcctctttgaccagttcttcggaggagcacctgtgggagtctggatcttttcccgaaggtctacttccctgagtcccttctaccttcggccaccctccttcctgcgggcacccagcgtgttgtgacactgactctcagaggatgcgcctggagaaggacaggttctctgtcaacctggattgtgaagcaattctccccagagggaactcaaaagtaaggtgtgggaaagatgtgctgaggtgcatggaaaaacatgaagagcgcaggatgaacattggttccatctccaggagtccacaggaataccggatccagctgatgtagacctctcacattatttatcctgtcatctgatggggtcctcactgtgaatgaccagcacaggtctttggcctgagcgacatccattaccgtaagaaagctgtggacgaagccaaaagaaaaaaaaaacattgggggcgcgggcggaatttaacaccttgggggcagataatagacaggcagatgcgcaggggtcacaaccgggcgggaacaggtggtgtcacctctcctcgcgggagn

SEQ ID NO: 588876 - DNA, 152 bp, Homo sapiens
  misc_feature (5)..(5): n is a, c, g, or t
  misc_feature (8)..(8): n is a, c, g, or t
  misc_feature (86)..(86): n is a, c, g, or t
  misc_feature (108)..(108): n is a, c, g, or t
gtgtnctngggccggaaacatgctgccgccagatccatccggtacaggccaagaagcatgccgggccttgatcccccctctttgtnatttcattggtaactggagctnactggagcaacactgtaatctcttgcgtctggccattgttcatc

SEQ ID NO: 588877 - DNA, 148 bp, Homo sapiens
cggaggcggagattgcagtgagccgagattgcgccactcactgcactccagcctgggccagcaagactctgtctcaaaaaaaaagaaaaaagtgtgggtatatgtgtgtataagtgtgtgtgcatgggcatgagaaggtccaggtatg

SEQ ID NO: 588878 - DNA, 424 bp, Homo sapiens
tctctagtaacgtggttcattgcgatccaaccatggccagccgaattcgagacttgatcacccagcgggaggtaaccagagcgctcctgggcggcctcaatgagtgcgacactctagaactgacacctagagtccagacgcttagaggtggccaagcccaattcgaaggattcatacaatgcgaacggattatgcctgcccgttggttccacagtgcggtacctgtaccttcgcggcggcgctgaagatgcctccatgaccaagatctatggcggccgtcaagagcgctcttatgcccagccacttcagctgagctttcaagagcgggaccctgtaggctcctgcacgcattgtggggtcctgtacccgttctgcctcttacccaagttggccgatctatctgcgacccgcaggttcaccttgc

SEQ ID NO: 588879 - DNA, 248 bp, Homo sapiens
ggactgacagaagacaaagaaagtgcttttgaatatctttcctctggctgactagaccatgatgttactacaatgcttcaaagctgaagaatctaaatgtcgtctttgactccagtaccacataataataatgctatacttaaattacttgtgaaaaaaaacacattttaaagattacgtgcttcttggtacaggtctgtgaatgacagtttatcgtcatgctgtaaatgtgcattctccataaatat

SEQ ID NO: 588880 - DNA, 224 bp, Homo sapiens
gtaattgtgataagtagtgcttgaattatttgttttcgattattttctattaggctgtgatgggctcaggtaattgaaacccctgatgcaagtaatacagatgtattcgggaggagtacttccagagggtcaaggggagaaatgcctgttaggggtcggtgtcctcctagttctagagttggggctaggctagaatggtagaatgccaagaagaacccagcaaa

SEQ ID NO: 588881 - DNA, 130 bp, Homo sapiens
  misc_feature (1)..(1): n is a, c, g, or t
nctcgggccgttatcgcagctcattgtatcctcgatcacccaggactaagcgatcctcccaccttgtagctgggactacatgctcacagcacacctggctaagaattttttttcttatttgagtcagagt

SEQ ID NO: 588882 - DNA, 931 bp, Homo sapiens
  misc_feature (63)..(63): n is a, c, g, or t
  misc_feature (75)..(75): n is a, c, g, or t
  misc_feature (87)..(87): n is a, c, g, or t
  misc_feature (93)..(93): n is a, c, g, or t
  misc_feature (124)..(124): n is a, c, g, or t
  misc_feature (135)..(135): n is a, c, g, or t
  misc_feature (148)..(148): n is a, c, g, or t
  misc_feature (234)..(234): n is a, c, g, or t
  misc_feature (237)..(237): n is a, c, g, or t
  misc_feature (303)..(303): n is a, c, g, or t
  misc_feature (312)..(312): n is a, c, g, or t
  misc_feature (330)..(330): n is a, c, g, or t
  misc_feature (364)..(364): n is a, c, g, or t
  misc_feature (408)..(408): n is a, c, g, or t
  misc_feature (630)..(630): n is a, c, g, or t
  misc_feature (646)..(647): n is a, c, g, or t
  misc_feature (654)..(654): n is a, c, g, or t
  misc_feature (689)..(689): n is a, c, g, or t
  misc_feature (698)..(698): n is a, c, g, or t
  misc_feature (717)..(717): n is a, c, g, or t
  misc_feature (722)..(722): n is a, c, g, or t
  misc_feature (737)..(737): n is a, c, g, or t
  misc_feature (830)..(830): n is a, c, g, or t
  misc_feature (845)..(845): n is a, c, g, or t
  misc_feature (849)..(849): n is a, c, g, or t
  misc_feature (918)..(918): n is a, c, g, or t
ttaataacaaaagttatgcaaagattaacttcatttttagtagagaaaatgttttgtaaaggnatttcttcaaantatttctcccgngggggnttaaccatcaatctcaattttattaaacatnctcctgaagancctatttcaagangtagaaaaaaactgtattcacaatctttgcaaacccaaagagtatgcaaaagatcacggatccacgggaaacatcagtaacagcanggnggctttccacctgaggggggttcccacagcgcctggatccgggagccgcccggggcggggaacctngggaggggngtgcccgggcaagggctnaacttacatcccccgacccgaacacagggcagancaccttatacggcgtcttgcctcccggggccccgggcgggggcncgaggcaggccggagaggcggaccggggcaggcggcggcgggccaccagcacgacaaggggcccaagggcggcgaggaaggagaggggacgcaaggcgggggccaccagggttcccggcgggccggcattaaaaaccgggagccgcgggggggaaaggaagaggcccacccccgccagcgtcggggcaccccccccagaattctggacccggcggacggccnccggcgcgtgcatcanncggaggnttttggaagggtgccggccggagagcagcggggtngacccaggnaattggcagcaaagatgancccgncgatgaggtcttctngttcgcagggccctggaacagccacaaaacttggaaatgatgccaccttctttgtctctggaatgttgttattgtcaacaggtccattgagancagagcgctgcggcntccntggctgcgccagaccattgcaaacctgctcgtggggccacttcagcctctcttctggggtcctggtctngggcttgaagccc

SEQ ID NO: 588883 - DNA, 868 bp, Homo sapiens
gtttccgggaggcgcgtgggcttgaggccgaagaacggccttgtgccaccaaatggagactttgtaccgtgtcccgctctagtgctcgaatgtcccaactgaagctgaagaagccgcccttgttgcacatgccgtcgccatgcatgtgtatgctctggtggtgtgtctaacttcctcatacaccggagacaatacttaatgatgtcattgtggaccctccaagtgtcgggtctatgatgatgaacaattgggccatcagaggccagtagctttcttgtggcctacagagtaattggccatattatttctggaccggctggcatccaggtttcctattaaccaatgggaggtacaggttacaataattcgttgaccgattccgattgcgcaaaattatccaaaaatcaaataggattctttcttctgtccatgtgatcggtctgtgtctatggagtttacatggttagagtatcatgacgaatgaaactgcgggtatctgatgggtaagaggtgctctgagagaatcaggggttagtggaattggccctgtcaatgacgtttaagggttgtaccaatccttatatgattgtggaaagaattgaagagcgcgttcaaggaatatctagtgaaaaccgggagcgtatgtaagctggctaacatttctctgggtttacagcgaccacgtatcacaggatttttccgtggcatggtaacaagcttgagtgcatgctatagtcaaaaaatttcatttacgatttataaagggtttgtaacccttaattgggagacttgtcaaaaaaaccacgtgtggtgactgggatatagtgtgaggggggacattgtgcgggggggtaaaaagcggtgggta

SEQ ID NO: 588884 - DNA, 130 bp, Homo sapiens
aatactcttatgccgttgtccaggttttggcaaattacaaataaagatgctgttagcattcatgtgcaggttttcgtacggaagggaagtttttaactcctttgggtaaatacccatggagtgtgattgc

SEQ ID NO: 588885 - DNA, 178 bp, Homo sapiens
ctctttactcgtcgtcccatccctttccgccccacaaagccatcatcttccctcaacctccccagtagctgggactacaggtgtgcggcaccacacctggctttttttttttttttgtttttttttttgggaaaaaaaggatttgggttttcccccttttggtttccaatttctgggc

SEQ ID NO: 588886 - DNA, 183 bp, Homo sapiens
ccttcgatagtcgtggcacttagcagggacagtggacgtgcacctgactgctgacctggactggctcagtctagaagcaggccagagagcagaggacgtggatcccagggcgacctcagacggccagcggtttagctagttctgctgttcgttcacgagttctgagcattctctgctagccta

SEQ ID NO: 588887 - DNA, 114 bp, Homo sapiens
aggatcgcgccgtcggtggactatggtcgtgacttgcgaaaacctcttgcggtgctcccaggaggctgcagttggctttgaggcccacagcagggtgctgagcagagcactgtg

SEQ ID NO: 588888 - DNA, 234 bp, Homo sapiens
  misc_feature (19)..(19): n is a, c, g, or t
tagctgactcatctcccanggtccaagtatcttctacctcagcctcccaagtagctgggaccgcaggtgtgtgccaccatacccagttaatttttaaattttttgtagagacagggtctccctatgttgcccaggctggttttgaacttctgaagcgatcctctcacctcagcctccaaaagtcctgggataacaggcgtgagccactgtgcctggccatgcgtggattgccag

SEQ ID NO: 588889 - DNA, 167 bp, Homo sapiens
ggcagtgcagctgctgctgtgatcgatctagaggatcccggatatgtattaggggtgtgtgttttggatgcgtacatatatagacacgtgcttacatgatgaggacaaattggagaaatctaccattaggcaatttgtcttagtgtgaacatcatagattgtactca

SEQ ID NO: 588890 - DNA, 311 bp, Homo sapiens
aaggacccgtctgaggcactgcttcagaggaacagggcactggctgttcctccagccccacgcgccaaatctctgcttctccatcaggcagcaaaacaaagactggaaggacgtgagggctgcctgggggttggggcaagggaggacctttgttcaacgcgcttccactgtttgtactgatgtctttcagcgaccgtgtccaacatgtatgtcgtgtacactatagtactggtattcccctagtcgtgaacaatgtgttccgcttcctgctgcctcactggacgtgctgttccccagcttgctccagacgt

SEQ ID NO: 588891 - DNA, 784 bp, Homo sapiens
  misc_feature (92)..(92): n is a, c, g, or t
  misc_feature (156)..(156): n is a, c, g, or t
ttgtgtaaatcgcggcgagtatatgcaaaagattctttaatggtgattgggtgccggcccactcatgaggatttcaactgttcagcggtgtngtagagtggtaacatggagtctccatgtgtgaacaacagcacaaatgagtatatgcccgcctcnttgatagttaaatgcaatatggcgatgaggcacatcttagactcaggcatcgtctatgtaagcatcacagtattgcagacagccaccaatagatggagacagtcaagcatgcatcatcttgtagagccctttgagagagcagagtcatgtcaacactatggtttcagacctgtggtctctcagtctaaaggaggatactcctttatgccattcaacactgtgttaaatctttgcaaggtctcttgcaccaggtggtgtcagtccaacacaggtgcacatgcggtaagacatccgaggtatctacacatgcctacatagcaggaattagcagatggaagttgtgttcagtgtgtagggtgtggtattacattattaaagcagcagcaaagtagcacatgtatgcttatctctgtctaggtgcagggtttttttacatattgaaaggcggcttatctgtagtgttcactcttcacatgtggacatagccacatagttcgtctcgtataatagaatccattctttgtgacaatagtagagccgtggtatttccaatgggagagagcatcgtgtgttttaccttgtgacatgcacaacaacgaatgatcttatcacccatgtctgttttgag

SEQ ID NO: 588892 - DNA, 100 bp, Homo sapiens
agaggatcccgacgtgtctctagaaaacaaaacaagtcagagaaagaaaaattacctatatacctcattggcacatttctggttacgtcaagtcgtgggc

SEQ ID NO: 588893 - DNA, 327 bp, Homo sapiens
cacgaggggatcgttgaactcgatggttacctgcgcctgcaggttgggatcagtgggcggcggccccaccacctctgcggcactgatgagcccgttgccagtgttgccgcttgcggcagcggtggtgatgggggcggctgcggcaagcttggccggatcagccacggcgaggaccaggtcacgggccccgtccaccgtaggttggatgaggaagctgtcgcccgctgccgcgacgccagaagacaacgtcagggtaaacccgtccacggtctgggggaaggtgctgaaagtggtcacgctgccgtcgctcagacgcgtgagggtata

SEQ ID NO: 588894 - DNA, 137 bp, Homo sapiens
ctgtaccggtgactctcaatggcaggtgtttgagaagtccccctgcgggtaagaacttcgggatctggctgcgctatgactcccggagctggaccacaacatgtacctgggaatacctgggacctggccaccggggt

SEQ ID NO: 588895 - DNA, 140 bp, Homo sapiens
cgagcatcaccgtgtctgttcactgaccaaagtcacaattgtcgaggttgacagttgggcagaagctctggttcctctttaatgtggtaatgcttcataccaacgtttcccaaagtagcctgaatggtccgtcgaagtgg

SEQ ID NO: 588896 - DNA, 91 bp, Homo sapiens
tcacacaaccattaagggaattggtcttcacccaccagtgtgggccttgaagcaaagggcacagccctggtgggttggaaaaaaaagtttg

SEQ ID NO: 588897 - DNA, 845 bp, Homo sapiens
  misc_feature (25)..(25): n is a, c, g, or t
  misc_feature (82)..(82): n is a, c, g, or t
  misc_feature (93)..(93): n is a, c, g, or t
  misc_feature (107)..(107): n is a, c, g, or t
  misc_feature (109)..(109): n is a, c, g, or t
  misc_feature (111)..(111): n is a, c, g, or t
  misc_feature (144)..(145): n is a, c, g, or t
  misc_feature (157)..(157): n is a, c, g, or t
  misc_feature (160)..(161): n is a, c, g, or t
  misc_feature (163)..(163): n is a, c, g, or t
  misc_feature (165)..(166): n is a, c, g, or t
  misc_feature (168)..(168): n is a, c, g, or t
  misc_feature (181)..(181): n is a, c, g, or t
  misc_feature (196)..(196): n is a, c, g, or t
  misc_feature (202)..(202): n is a, c, g, or t
  misc_feature (207)..(207): n is a, c, g, or t
  misc_feature (214)..(214): n is a, c, g, or t
  misc_feature (216)..(216): n is a, c, g, or t
  misc_feature (224)..(224): n is a, c, g, or t
  misc_feature (252)..(252): n is a, c, g, or t
  misc_feature (434)..(434): n is a, c, g, or t
  misc_feature (445)..(446): n is a, c, g, or t
  misc_feature (448)..(448): n is a, c, g, or t
  misc_feature (451)..(452): n is a, c, g, or t
  misc_feature (479)..(479): n is a, c, g, or t
  misc_feature (510)..(510): n is a, c, g, or t
  misc_feature (519)..(519): n is a, c, g, or t
  misc_feature (538)..(538): n is a, c, g, or t
  misc_feature (554)..(554): n is a, c, g, or t
  misc_feature (557)..(557): n is a, c, g, or t
  misc_feature (561)..(562): n is a, c, g, or t
  misc_feature (566)..(566): n is a, c, g, or t
  misc_feature (581)..(581): n is a, c, g, or t
  misc_feature (591)..(593): n is a, c, g, or t
  misc_feature (598)..(599): n is a, c, g, or t
  misc_feature (610)..(610): n is a, c, g, or t
  misc_feature (616)..(616): n is a, c, g, or t
  misc_feature (624)..(624): n is a, c, g, or t
  misc_feature (654)..(654): n is a, c, g, or t
  misc_feature (669)..(669): n is a, c, g, or t
  misc_feature (677)..(677): n is a, c, g, or t
  misc_feature (682)..(682): n is a, c, g, or t
  misc_feature (685)..(686): n is a, c, g, or t
  misc_feature (695)..(695): n is a, c, g, or t
  misc_feature (699)..(699): n is a, c, g, or t
  misc_feature (719)..(719): n is a, c, g, or t
  misc_feature (738)..(738): n is a, c, g, or t
  misc_feature (745)..(745): n is a, c, g, or t
  misc_feature (774)..(774): n is a, c, g, or t
  misc_feature (779)..(779): n is a, c, g, or t
  misc_feature (819)..(819): n is a, c, g, or t
ggggtttcatccccagagactgacngaaggcgttacagccctcctctccaaggactcagggctgagaacggattcgaatctngaatgatcagnaaaaacatgcaaangngngaaggaaagggaaaaaggtgcattcccctaagnngagggggatggnatnncngnncngagggggcagggnggacaagtaccaggnggctcntcccntttcccncntggtgttncgttcgaaaacagtccaagcttggaganagcaatgagctccacctactcagcagaacccacggctcgtcccccgtggacgtgactgagcagtgaccttgcctgccccgttcctcagccgcccatcccactgccttgactgaggggaccctgcttgtgctcctggggggcaggactgggggtcctagctccttgcttctttggttcgcacncagagaacagnngngcnngacggactcatccccactccccaaacncaagctccctgctgggtgggcggaaggcacngacagagtncctgggacacccccaggtngccaccttctcttttnctnatgnnggtncctccctggcacatngtccattctnnnctcannccccagggtcnggaatngggacgcnaagaaagtgtaccctcaagaaaaagcttcnaggacttttctaatntgcagatncttcnaannccatgccgnccgnccccacagccccatcccttncacagggccttaaattcanggcttcncaaacggtccttccccttggctgccggtncactntgggcccaggctttgcaggccagcttcagacagtgggacnagaaacacttgcagcatgtctctcct

SEQ ID NO: 588898 - DNA, 141 bp, Homo sapiens
ctcgccgcctcctcccgccgctgcgggcccccctcgccggggaacgagcgcgctcgctccggcgccggcctcgcctcctcgcagcagcgccatggatgagttccacccgttcatcgaggccctgctgcctcacgtccgcgc

SEQ ID NO: 588899 - DNA, 290 bp, Homo sapiens
  misc_feature (40)..(40): n is a, c, g, or t
acataatacaacacgacctaacaccacagaatgtatgtanttcattacagaaatgtccacagtaggtaaatccacagaaacgaaaagtagcttactggttgcctagggctggaaggattgtggggaaatgagacatgactgctaatgggtatggggtttccttcaggggtgatgaaaatgttctaaacttgattgtggtaaaggctgtacaactgtgattatactaaaaaccattgaaatgggttacattttaaatgggtgaattgtatggtttgtaactgcattttata

SEQ ID NO: 588900 - DNA, 1789 bp, Homo sapiens
  misc_feature (286)..(286): n is a, c, g, or t
agcggaaggcccgggaagatctgcgggaggcggcagggcccagggcgttgaatgcccggccacaagatcagcctcctcccattggcgaaaggagccccgaagagcttgtgttcaggagggaggcctcggcctggtcaagtcatctagcaggaagagtcccggacagtgcaaagcaaatgcaagaagaccccctccctagccgatgggaaatgccccagccgttgaaggcggaaataacggcctgtaggcaacggaactcccagcgttcgcaaaggagcggaggagncggaaactcagggcgcgaggcctgtgggcccagcggtgaggcagcagctgggggcggggggagggcggacctagcttcccagggcaggtgattcgtcggccccggtggcggcggcgcgtgcgacggtcacctcggtttggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 588901 - DNA, 640 bp, Homo sapiens
  misc_feature (25)..(25): n is a, c, g, or t
caggctgcgtacggtccgagggttngatggcgaacttgggctgcaggaccgtcccgggcccggatgaggacatttttctgtacttcgcctacggtagcaaccggctgacgagagtatccacctccgaaacccctcggcggcgggcttctgtgtggcccgcatgcagatccagaccgtcctggccaacatggtgaaaccccgtctctactaaaaatacaaaacagctgggcgtcgtggcgggcgcctgtagtcccagccacccaggaggctgaggcaggagaattgcttgaacccggaaggcggagcttgcagtgagccgagattgcgccactgcactccagcctggcgacagagcgagactccgtctcaaaaaagaaaaaaaaaaaaagggaccattttgttggtaatcagaagttaaaggtttccaatctccaaggaagggaagacgaaactaacctggtcaaagattatcctggatggacaaattacagaaaggtggcgtcctccggtcttcacaggtattaaaaggaattattgggcattgggggccaaaaattaaaaagtgggttgtgccgcgtgggagtatcaagaagaaagtttaaaagccaattagaaaccaaagtgaactattacggggaag

SEQ ID NO: 588902 - DNA, 1866 bp, Homo sapiens
ggcgacggtcacctcggtttgggtgagtccctgggttcgagcccgggccccgccagctgccgagttgcctctcggtgccggactgtgactccctctggccggccctgcactctggcctcctgggacgtcatctggagggatagagccaggcctgggactccttttgggagagtttccgttcttctattccgtgctgtccggccaggacccctcagggacttctgtggggcaggggcgaatcatgcatggcctagatgaccccatgcctagaaaaaggcagtgcggggcggtggcggcgcgcacggccgagtgaagcagatagcgtccccggggctggagcccggtagcagggggtccacctaaagtgggaagtctgttttcaaaatgacatctactccatgcctgtcttgtttccctaatgtactttatggaagttcttcacactactggagcattgacgttacttgttaagcagccttccacatcctagctcttttccaaggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 588903 - DNA, 820 bp, Homo sapiens
ggaattacacccatgcttgagcctactactgaccccttgttccctctgtggttgtactagtttatattatccacaggtgatgcttgggcgtatgcttatcgcccagggatgctatggtctaaatactgagttagtaagctgaatgtctgttaagaaaatcatgtttgacatcttttctatctgctgcgttaaccagttccctgtgagctcgtctagcgttactgggtgcgagaagccctggcgtatgactttgccgattgtgtacacttctacactgtcagtggacttgacagttgagttgtattcttcttatcttccattttggtctatgcttatgttttcgttcgaaatttgtgtgtttccgatatgcgttcctgcttctgcaccgtacagaatgtgttgaaaggttctactaacagccagctcacatttggtatatgttagctcttatctgttgtcacttggacgtttcattcttgaaagttaagcaattgttatgtttcacatatagttttatacaaagtagccagtcccggtaatgaaatgctgtattgccatagtggtcacacccaatgtggtccagtatctcaatggtgaggcagccagatctggtacagggctgctttgttgaaatgtgatgattttcatatgctttttttgttgtctttttttttttttttcctatggtggcaaaatgaggaagatgtagaatcggtagttattaaagtaactggtaataaaatttatttgtatacataagtttgtattgataggtgactagtggacttcaaacagtaagtatacggggacttataatgtg

SEQ ID NO: 588904 - DNA, 378 bp, Homo sapiens
ggccagcgaccgttccggcggccattgcgaaaacttgcccacggctactgcgtacacgtcgcggtcgcgttgggacttccttaaagcaagacggcaaggcgcccggaggtcgtaagtcaagtcttcccggcttaatccatgccgggttggagcctgctacacgcaggtcgcgcgcccaggtgctgggtcgactcgggacacggcctgggtgctgccctgggcccggggacacagaacacacatctgcgctttttgttgagaggtctacatagagagagtggtacatagtgggatgagcatctctctcaggacaatgtccaattcattaagcagttggtctcttatgagataaagcccatttagcaagtcactgtgtcc

SEQ ID NO: 588905 - DNA, 107 bp, Homo sapiens
acagtgtgtgccctgtcagctccgcaaattggcagtcactacgtttgtgccccctgtaaccttgtgatcttcactgccactagcgatgaagtcttcattatggcctc

SEQ ID NO: 588906 - DNA, 1715 bp, Homo sapiens
ggcgacggtcacctcggtttgggtgagtccctgggttcgagcccgggccccgccagctgccgagttgcctctcggtgccggactgtgactccctctggccggccctgcactctggcctcctgggacgtcatctggagggatagagccaggcctgggactccttttgggagagtttccgttcttctattccgtgctgtccggccaggacccctcagggacttctgtggggcaggggcgaatcatgcatggcctagatgaccccatgcctagaaaaaggcagtgcggggcggtggcggcgcgcacggccgagtgaagcagatagcgtccccggggctggagcccggtagcagggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 588907 - DNA, 1127 bp, Homo sapiens
agcggcagtcgggccgtgacttcgcgcgccgccagggtgtatcggtgtagctgcgcagcgtcgcgcgcgctacccgcgcccaggttcggcccccgtatgcgcgtactggacagcccggcgcccatctttcatcgcagtcgccatgggccgcgagcctgcgagtgccggtgccgcggccgggtactgcttgctcctcgcgcttgcgctgtgctctctgctgaccacggcgccctgtccctgggctgcgaaggagccttgacagcacactgtggctgcgggactgtacaacagctcttagcctccacttatgaaccgtctaatacacatctcctcgcagcgctggcatcccatccccgaccagcttcgaacatgctgtatcggcagtgcacccggcctgtgctccgctggatgtcctgtgcatatcgcgcccacacacaagtcgactatccaggttgctccaggaaagccccaagcgcctgcgtgacatgcggctgatgcaattgtgtacaagcctggggacactgctaacgcaccgctgacgctccagtgactaattgctggtcacgaccccctctctgtgcacaccacacaacctcggttggcgtcttggagcgccgctgatccgcaacacggggcctacactgcgcaacggccttcccgtttccttggcacacggtaacccccaacgctcatctagcttaaccccttaacacggccaacggggctttgccttaccggcctgggggccccttctcgcgggcaccgcctaacttcacaccttgtgtacgacgcaactttcggacgtttaaccccaacgcacaatcaagcgtctcaggctgccgcccctgggccccagcgacaacaaaaaccccctggcggagagggcggccagccttacactacgggctcagagagccaaagcgcacaagcttcgcgacgcgcggcgcacgtcctaagcgtcgtcctcccattagtggtcccttacccttgaccaactggtgaactctctcaactagcatttccacaacgcacttgcgcgctccaccttccgcaagcccgcaggtcactacgcgccatgtggctcacacgtcacgatcggccacagcttgggcgtgtactaaggacta

SEQ ID NO: 588908 - DNA, 1687 bp, Homo sapiens
  misc_feature (286)..(286): n is a, c, g, or t
agcggaaggcccgggaagatctgcgggaggcggcagggcccagggcgttgaatgcccggccacaagatcagcctcctcccattggcgaaaggagccccgaagagcttgtgttcaggagggaggcctcggcctggtcaagtcatctagcaggaagagtcccggacagtgcaaagcaaatgcaagaagaccccctccctagccgatgggaaatgccccagccgttgaaggcggaaataacggcctgtaggcaacggaactcccagcgttcgcaaaggagcggaggagncggaaactcagggcgcgaggcctgtgggcccagcggggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 588909 - DNA, 1405 bp, Homo sapiens
actctagaggttcccctcgaattcgacggtttctcgtgttggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 588910 - DNA, 152 bp, Homo sapiens
aggagggctacacgcgctggaccaggaagaaaggcagacttaacagtttatctgctttttctttctgctttcccctgctcctgccagcctgactccacttcccttgttaggaccacacacatagtgaccttgaagtcccagcaacctcacca

SEQ ID NO: 588911 - DNA, 1078 bp, Homo sapiens
ggtgtgttgttagccgggttgttcctgctgtggcgcgcgtgggcgctcccgggtgggcctgccgcgttgtagatcttgggggcattgggtttcggggaccccgccgcggggagtattccttggggcttgtatctgcggcgggagggttctctggtaggttgtcggggcacctccatgtggcgaggcctgctggtggcgtcggtgctcaccgcggtgtgcagggctctctccggcatggccgtggccgtgggcgtctctctgcgcctacagctgcgcggcgtcttgtgttggcccgcgcgtgtctgcagtggaggagtatgcatcctattctggctgcggtggttctagttgctctcgtccgaacagtccatctggggctacataagcttgcgggggggcgcgtttcaacttgtcggccgggaagcttctcttgctcgcagcagtaagtagcatggcgtagcgcttttgcaggttctaagacgcgggagcaacggccttaggtactcctcgaaactcttggggggttgcagtgccgtcccgcggtcgttgctcctcagatggatactagaatgggggcgacgctgcctgttgaccatcgcgggaagttcgcatgtgcgtcttatcgtgtagatgtgccacatcaacgacacggtctgagcggagagttttcgagcatctctgtacggagcacatcgcagtcttatctttgtctcgccctttctcagcgatgaaggatgtcttgatgcgcgacagcgtgtggtgagtatagatgcgctgctccgaggctagacattcctgcctggagggacacgcgccctcctcgtccctcttgatgaatttagaccccagctttctctccaccctacttgggccagattgcgcttgttacctcaccacacacacacacacacacacacacacacagacacacagacacatacgcacatacgtgcacacatgtacaacatcggatacacacacatacacaccacacacacactgcatatctgtgccgcgcccctcgcactggtctcacttggcaccttcttcaggattttatattgaagagttttactat

SEQ ID NO: 588912 - DNA, 705 bp, Homo sapiens
ggcgcatgcgcgtgaaggctgccgtggaccagaacatgtcctgtccttgtagagtaaaagcttccatgggagccttccttcctaatcaagatgcaaataatagggcactcgcgaaacagacacgtaaaaacgagctctcatctccaaagaaacccagtgctgtgtatcaccagtattgaggacaattagatgctggggaacaacgtttaaatgacatggaaggccttccaggccagccagtggatctcttgtggacccattacctttgcatttcttccatcagatgggatcacctcccacccctgagggtccccaaagacttggaaccagttcttcagtgatccttaccagaaagacaccctctccaaacaaaggcagcatttatatacagtccatgggctctctaggaaacaccagaattatcagtgacagacatatttcaattggctcacgggcctacttgtaaaagcatatttctatggcttgagagtaaaacctctagaaaccgagtcctgttttctggtacacaaggatggtccctttagagtcattgagaacacacaaaactacaatatttcatgcagggggactatcctgaaagttcttgaaaaaagaagaaaccctgaaagatgccttctggtgtggtgggaataaccaatgattgatctttaccccaagagaactcgtggcaatttggtctttgga

SEQ ID NO: 588913 - DNA, 800 bp, Homo sapiens
atagccggggcgtgtcccgaaattcgggactccccgggcaatgtatttgagaaacaaactttgcgttataggtcggggccacccccccaaacaccacgctgtcccttaggggagaattttacagggcaggttcccacaaggaaaaaactcagggaacgggccaccgatgacgaaaagctgggtggagctggcccatcctttctagagaacccccctctcccacggtaggggcgcccctggtgccgggtcgcatggacgcaagaccgtcctgttcgcgacagccacaagtggagaagccccccacctgccggcgaagaaggtgcgacagcgcgtggacccggaccacggacccagatatgtgttataaaagccctctgcccccacctttctctcaaacaaatgtcgagatacacttccagttaaatattcaggtagtcgcccttgtcaaactacccggagagttctcccccgagcactttttttaaagggctttctcccccgcggatttcagtaaaaacgggcagctccacggttgctgacgaggccgaagattccccaggagtgtgtccagcgtacagtgagagccagcgacgacatcttctgctgtgatcttcaacgctcaagcgatgtcgtgactgtctttcggcgatgccgctccagcgagtctctctattctatgtctgcgcggaataagatctaactgtgcgcccgctccaatcgagatcgaggtctgagacccatgcctcttggtaacaagaagaaccacgaggagatatgtttctacaaacaaacataacaca

SEQ ID NO: 588914 - DNA, 1468 bp, Homo sapiens
ggactctggctacttaaataggaatcaagccaggtccctaccattgctcagcccgcagccgagtgggaaagaagctcgcaaaagcagcaaacaggcagtaatcggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 588915 - DNA, 1962 bp, Homo sapiens
  misc_feature (286)..(286): n is a, c, g, or t
  misc_feature (1805)..(1805): n is a, c, g, or t
agcggaaggcccgggaagatctgcgggaggcggcagggcccagggcgttgaatgcccggccacaagatcagcctcctcccattggcgaaaggagccccgaagagcttgtgttcaggagggaggcctcggcctggtcaagtcatctagcaggaagagtcccggacagtgcaaagcaaatgcaagaagaccccctccctagccgatgggaaatgccccagccgttgaaggcggaaataacggcctgtaggcaacggaactcccagcgttcgcaaaggagcggaggagncggaaactcagggcgcgaggcctgtgggcccagcggtgaggcagcagctgggggcggggggagggcggacctagcttcccagggcaggtgattcgtcggccccggtggcggcggcgcgtgcgacggtcacctcggtttggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaaaaaaaaaaaaaaaaanaagtcgtttccgatgtcggggcgatcatgaattaattaagattgtcaccccccggaaatttcggaaccggggccggcggggggcggcccacttcctcattttatggaagggcggatttaaacattttggggtagtacatggggacaaaaccgggttc

SEQ ID NO: 588916 - DNA, 612 bp, Homo sapiens
  misc_feature (388)..(388): n is a, c, g, or t
  misc_feature (395)..(395): n is a, c, g, or t
gcagtaatccctcaattttaaaaaaggattgaaaattgctaaatgtctttctgtgcatatttttggtgtgaggagtcaaaagtattttatgaaaaggagaaagaacagccgtcgatttttagatgtagtcctgttggattttttatgcctcctcagataaccatgaaatgttgtataaaaaactaatgtgtttgatggatgttcaaggctagactattatacatggctctgaaatatctgacacaaagtgtaagacgagttgcatggcgacgctgcatgtttcatggttattgtatttttcagacaaatggtggactgaatttggaagagcttttcatgggaattttctggagctggtgccccctggcgaatttgcaaccggaagttnggaattngagtcagtatcaaaatcaggtttataattgtttgtaaatttggtactttcagaagtctagtatgttcaagggcgcacattgttctgcgactactatgttgtaatgacattaaaggactaagataatcttgtcagagatgctggaaacaaatgcattggtgtgatatggtttcgttgagaatagcaatgaagcatagaatggaaaattagtgatagta

SEQ ID NO: 588917 - DNA, 165 bp, Homo sapiens
acaagcctgcgactgagtttgagggggtagactctgagctcagctcacagcccctccttaagaagccattgctgtccatgctgagctcacacacactgaagctggcacgtatggagtctttgacagtgtctttgatctcctgcacatggctgctcaggaagctgt

SEQ ID NO: 588918 - DNA, 2489 bp, Homo sapiens
  misc_feature (286)..(286): n is a, c, g, or t
agcggaaggcccgggaagatctgcgggaggcggcagggcccagggcgttgaatgcccggccacaagatcagcctcctcccattggcgaaaggagccccgaagagcttgtgttcaggagggaggcctcggcctggtcaagtcatctagcaggaagagtcccggacagtgcaaagcaaatgcaagaagaccccctccctagccgatgggaaatgccccagccgttgaaggcggaaataacggcctgtaggcaacggaactcccagcgttcgcaaaggagcggaggagncggaaactcagggcgcgaggcctgtgggcccagcggtgaggcagcagctgggggcggggggagggcggacctagcttcccagggcaggtgattcgtcggccccggtggcggcggcgcgtgcgacggtcacctcggtttggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaactggttgtggttcttaagctttagatagccatgaatctccccttcccatctcagtcccctgggctacttcaaccatggctgttcaagtcttggcccatttcactctttttagtactcaaagattctgctgagtttccagttgctgctgccgccgaaaggttttaccaggaactgcaattctgggtatttgaatatgttccctcttctgagaagacaagtgtgattttcttggtttagacattgccagagataaaatgcaaatgtagttcattcactccttcagcaaacatttgtgcctaccaggagataagcttgtcctaggcccctgccaagtagaggggttatggaggtggacagtacttagtccctgcccttgaggagctcacactcctgtgagaaaagaagcccaccaggacagttgggagaagaggctggagagagatagcaggttttagatttgtgtcatggatgaaaggagctaagaaagaactttgagcaggcaaggtctcttgagattgtgaactggaggtctttggcagctgtgagaatggcagatgtgttggaaactgactaattagtttctgcttgtattcaggacatggatcccacttcctgtgggttcagtcaggtccaatattgcttcccatcttctaggactctgtcctggtacacagtacttacaattcctccagagctagtt

SEQ ID NO: 588919 - DNA, 533 bp, Homo sapiens
  misc_feature (33)..(33): n is a, c, g, or t
  misc_feature (57)..(57): n is a, c, g, or t
  misc_feature (295)..(295): n is a, c, g, or t
  misc_feature (461)..(461): n is a, c, g, or t
tggggttgggccttcgggcccaaggttgggggnaggctctgggcccgtttatttgcngtgtggggagccggttcccccgttgcattgccgggccctgtgggtgggtcggtgggccctagatttttggggggtcgcaagccactctgggcgcagggcccatttcttctttttttgggggcgttttaatgattccccttcccccaaactccagggaatggaggggggacccgccagccaaaacattccccccattcccgacccccctctcctcttctagcccatgcccttccccggnggagggagggagcagggagccctcactctccacgccccttgcttgcatctgtatatagtgtgagcagcaagtaacccttctcctccctcccccctcccccctcctcaatgtagtggccttggatatcctgtttgttaataaagacaattcaaccagctcccaccangcaggccgcatgtccttgctttctgtcagtactgtagactaggcagagagagcccccagggtggggaaaaaa

SEQ ID NO: 588920 - DNA, 961 bp, Homo sapiens
gctattctctacaaatcactgagacattcggaacacatatagctattatagcggcgcatgagctggagttctaggcatagctctaagcctgcttattcgaaccgagctgggccagacaggcaatcttctaggtaagcgaccatcgtctacaacgttatcgtccacagcccagtgcattgtaataatcttcttcataatagtagccatcataatcggaggcttggcaacgtgagtagttccgctaataatcggtgccccgatatggcgtttgccccgcataagacgaacataagcttctgactcttacctccctctctcctactcctggctcgcatctgctatagtggaggccggagcaggaacaggttgatgcagtctacgccatcccgttagcaggaacatactcacaaacctggagcctccgtagacctaaccatcttctccttacacctagcaggatgtctcctcgttatcttaggggccatcaattgtcatcaccaacgagattatcaatataaaacccccgtgacataagccaataccaaacgccccctcttcgtctgatccgtcctagtcacagcagtgctacgttctccgtatctctcccagtcctagctgctgtcatcactatactactaaaagaacggaaacttaaaacaacttgttcgacccgcccggaagagagaacccatttatagcaaacctattctgatgttccgctcacctggaagtaaatcttatactacagggttggataattcccatatggacttacgactcggaaaaaagaacatgtgtactagttgggcgaccatgaatcatgctccaggttgggggcacaccattttggtgatatagtaacggattccccacaataaggtcccggggagatatgggcacgaaaaatatggggtgaagaaacttcggggggtgaaaccaacacaagacacagggaggaaac

SEQ ID NO: 588921 - DNA, 697 bp, Homo sapiens
atattctagagcatccccttaacaggctgatgcagcatgacatggttcaaggtgtcgcagactatcaagcctatcatgcagtgccaggtcacgggtggaccagcatgtaccggatacccaatggagtggaccaagaaggtcatcacgaacatcgcctggtcgggctacgtctccagtgatcggaccatcacgaagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggtatagagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagcacctgctgggctccccagaactttgcacacatcttgctatgtatagccgatgtcttagtgttagcctctgaatctgggtctggccagtggcatagtgaagctgggaatagtgttctgcagctctggctgccgcacggga

SEQ ID NO: 588922 - DNA, 1525 bp, Homo sapiens
  misc_feature (286)..(286): n is a, c, g, or t
agcggaaggcccgggaagatctgcgggaggcggcagggcccagggcgttgaatgcccggccacaagatcagcctcctcccattggcgaaaggagccccgaagagcttgtgttcaggagggaggcctcggcctggtcaagtcatctagcaggaagagtcccggacagtgcaaagcaaatgcaagaagaccccctccctagccgatgggaaatgccccagccgttgaaggcggaaataacggcctgtaggcaacggaactcccagcgttcgcaaaggagcggaggagncggaaactcagggcgcgaggcctgtgggcccagcggtgaggcagcagctgggggcggggggagggcggacctagcttcccagggcaggtgattcgtcggccccggtggcggcggcgcgtgcgacggtcacctcggtttggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatcctgtaaggcctggtgttaggatcactgagttccttatggggagtagtgtggattggtctgttatctaaatataatcattatgtatgaaatgatcttttttgaggcagcatggtataaagggaagagtatcaatcatgtagatctgaattccatttttggcttttattattactaatttaacatcctatgttctcactcataattgggagctaagctatgaggatataaaggcataagaatgacacaatggactttgggaactctggggaagggtaagggggatgagggataattgggtgcagtgtacgctgcttgggtggtgggtgcaccaaatctcagaaatcaccacaaaagaacttattcatgtaaccaaacactacctcttccccaaaaacctattgaagtaataataactaaa

SEQ ID NO: 588923 - DNA, 533 bp, Homo sapiens
  misc_feature (33)..(33): n is a, c, g, or t
  misc_feature (57)..(57): n is a, c, g, or t
  misc_feature (295)..(295): n is a, c, g, or t
  misc_feature (461)..(461): n is a, c, g, or t
tggggttgggccttcgggcccaaggttgggggnaggctctgggcccgtttatttgcngtgtggggagccggttcccccgttgcattgccgggccctgtgggtgggtcggtgggccctagatttttggggggtcgcaagccactctgggcgcagggcccatttcttctttttttgggggcgttttaatgattccccttcccccaaactccagggaatggaggggggacccgccagccaaaacattccccccattcccgacccccctctcctcttctagcccatgcccttccccggnggagggagggagcagggagccctcactctccacgccccttgcttgcatctgtatatagtgtgagcagcaagtaacccttatcggggaggagaaaagaaaataaagcaatgtagtggccttggatatcctgtttgttaataaagacaattcaaccagctcccaccangcaggccgcatgtccttgctttctgtcagtactgtagactaggcagagagagcccccagggtggggaaaaaa

SEQ ID NO: 588924 - DNA, 900 bp, Homo sapiens
gtagtaaaatctgatggatatgcgtgagctggaacctcttcgagaatactagagaaacttggatcagaagaacagataagtgtatcttctagaacatgagttatgcccttgcttcatgtattgctagaagtattttcatggctattggtgatagaatagtgtatacaaattttaaatgaatgacaggatatgaagagataactcgctatggcgcatgtgtgctactggataaagttatcccaagaggtaagggtaggtgtgatagtgctccgaatgtaaggaatcttaaggataaggcgaatctttaagtattgtgtgacccactctggtggttatcacatagtacatacttggtatgtccatatgtgatggttagcctgtcagctctataaatttactgtattattcttttactcatttactcagtcatttctttacaagaaaatgattggaatcgtgtttaggtgacagcacaggtggacataaagaaatttccatcaataatcatgaataagtttccagaacaaattttcctaataacacaatccagatggttcaactctttgatgtaccgaataaaaaatgtatttgccagtatccttgagatttagaacatctgtgtcagttcagatacaatttagttcaagttgatggagcgtgatagataagatacgtctatttgacaaattatgatgggtaaaataatatatgacgtggggtggagcaccaggtatttaggactaatttggcttattggatggtaattattcacataaggggggggatacaaaatatgtttaggggccagaaagaacataaaaagtggggagacaacatatagtcgaaaaaaaaaatgcacgaagaaatggggagatagagaaaaaaagggatagaagcaaa

SEQ ID NO: 588925 - DNA, 259 bp, Homo sapiens
aatttgtgtgggttatgcctaacaatggaatatatgccggaggtattaacgctatcggctaactgctctttcgtgtttcttcctgacgtatggacggagtatgcccgacggtgtaaacccttattaccaaaccaaacaagctaatgaataagcatagtctttcaaagtaaatctcatacggggtttcttctaaaaagaatgtttgaggatatagctctgttcttaaatacagtatagtaccataacaccacacaattcc

SEQ ID NO: 588926 - DNA, 333 bp, Homo sapiens
cctcccttattcgaccaggcaactacaaacgcacgcgctatcgattgagctttgaagcaacgctgacagcctgctacttttgcactactactcttcttcactaagctgaaccaccaaccagcacgcaacaacgcaggcctttgcagcatctcatggcaatgcactcccaccattgccaacagcacttacaccagctttgacctgtgctacgctaaaacgcacaaactttaacggggacgctccttcaacacttacagcgcagtatgaatatcaatgccttggcttttctctttcttccttttgcgtcccagggcacatgcgcacgaactggct

SEQ ID NO: 588927 - DNA, 182 bp, Homo sapiens
gtgtgactccagaggattccatgttatcgcccaacactaggaacacccaaatgtctgtaatggtgaatggttaaagaacctatgggacatccataccatggaatacgatccagccataaaatggaacaaacctttcacacaggcaacaacttggaagaacctcaaggaaattatgctgagtg

SEQ ID NO: 588928 - DNA, 418 bp, Homo sapiens
ctggccccacctgtcggttgtctgtagaactgctattattcatcctatgtggcgtattgtggagtatgctaatcattttgcgtagctcgcggtttggtgggggtagtggaggggatgagttgtcctgctggctgtgatgtcccttgttaaatataagggggtagtgcgtggacaggtggtacttacccacgattctgtgccctgattatgcctggactttgatgctacacatgaccatgcttgggatgtctctagctggtctggggatagctggagcacttactcaagtggctggtgaaatgacacctcagaaggaatgagtgctatagagaggagagaggagtgtactgcccaggtctttgaccgatgtaattctcattcaattaaagttgccgtgttctggtcaagtggaatactc

SEQ ID NO: 588929 - DNA, 500 bp, Homo sapiens
cgacctagagatcctcagcactgagctggtcaggcactgagctctctccggaagtatccacgtaatgtctaactggcttaataaatgttgagctgggggaaggtaataaatacttacatgccttgcatttttaaattgactggattcatcattttaaattaattcacaagaaacctttcaaaattttatctttttaagtgtttcttccaaaacaacatttagtcattaattctgggcttttggcctattggaagcattgaaaagctgaatggaatccagaaaaagttctggagaatagaagcttccagcctttagggttcggtgacccgcctgtgggaaggatgcctgccatccctcccctctgtaggctcacactcctcttacttcttcctcttcctctttctcccacacacaaatgcgtgccatgctcctctgcccaggccttgggttaaaggcagcactaggccttccaccaagagacatgagtgaatgatcaggcc

SEQ ID NO: 588930 - DNA, 277 bp, Homo sapiens
gggctttatggaagagtggccaaaaaaagcctattcttaaagaagaaataagctaacatgtttggggttcgctcaaaaggcatgagggaggcttcccaaacatatgtaagaaggtactctggtcagatgagaccaaaattgagctttttggccatcaagaaaaatgctatgtctggtgcaaacccaacacctcatcaccccgagaacaccatccccatggagcatggagatggcagtatcatgctgtggggatgcttttcatcgacagggactggga

SEQ ID NO: 588931 - DNA, 289 bp, Homo sapiens
gatgtggaggggtcactgtggtcaagagcataggttctgaggcatatttcggtaaaatatataacaacatttttgattttgaccatttgtaagtatacagatcagtggcattggttacattcataatgcaatataacccactgtgcccggctgtggatttctgttgatgtggaaatatagttgttccagttccatttgttgaacagactcttctttctctgttgaatggatttgccttctgtgtcgatttttgacctaaggtctcttttgtctgatattagcagagcca

SEQ ID NO: 588932 - DNA, 438 bp, Homo sapiens
gcagtaggaggttttgacggcacaacatacttgaagaccattgaagttttcgatcctgatgcaaacacgtggaggttatatggcgggatgaactaccgtcggctagggggcggtgtaggagtgattaaaatgacacattgtgaatcccatatatggtgaccatgtagaagacagccttgtatacgctctgtattctggagagctttgactttggagctttgtacagcttgagaagacattagaacaaattttattctttgctggtgcctcaacatatggaaatacaaatccaatgaaaatacttcacctgcaagacgccacctttgcacaagaattttcagttctgtgcagaatatttatttggggttttaatttatctttttttgttgttgtttttgatcagtttgtaagtttgtatttttttttactatgcttcct

SEQ ID NO: 588933 - DNA, 428 bp, Homo sapiens
caggtattagtttatgaggatggtgaaaagaccaaaggaaaggactcactcacaattctgtccaacaataaatagagttgactgagatggcagtgtttttttccagctgaagttgctacctggctgggtgtggtggctcacgtctgtaagcctagcactttgggaggctgaggcaggtggatcacttgaggtcagaagctcgagaccaggctggccaacatgatgcaaccctgtctctactggaaatacaaaaaaaaaaaaagaaagaaaaaaattagctgggcgtggtggcagacacctgtaatcccagctacttgggaggctcaggcgggagaatcaatcgcttgaatccaggaggcataggttgcagtgagccgagattgcaccattgcactccagcctgggcaacaagagtgaaactctgtctc

SEQ ID NO: 588934 - DNA, 152 bp, Homo sapiens
ggtgactgcgggggcgcgatcactggatgtagcattcattagtgtactcctcgagagcgctcaggaagctgaccttgaagctctccagcacggccagcaggccttggtgaaggtcctcgagcgcgggcttggccttctccggtggacgtggt

SEQ ID NO: 588935 - DNA, 465 bp, Homo sapiens
  misc_feature (10)..(10): n is a, c, g, or t
caatgccaanggacactgaaagcttgtgtgcatatgcctattgaaggcattgtgtccagtgtttgccagagtgcattctaggtaccaaaactgtagattcagtgtgactgagattataaggagaaaggattacagttgctttgaagtgtcaatgccactgcactctgtaaacaagcatatagatgagagtggtgcctggtggcttgtagcagaccatatgctatcatgttgtaaggtactcagacgggcatttgcctagagtgggatgtatagatcagcatttaaaaagctgttaccaggttctcaattgtctcaaaagctgctatatgttgctacttagttgggttttactcatttgccccctatagactttatagaattaaaagtggttggtaatcatcaaacaccttacgttctacgataatcaaactcacagtggctgttcacacaaatagatatttcagc

SEQ ID NO: 588936 - DNA, 439 bp, Homo sapiens
  misc_feature (218)..(218): n is a, c, g, or t
  misc_feature (235)..(235): n is a, c, g, or t
  misc_feature (240)..(244): n is a, c, g, or t
  misc_feature (246)..(246): n is a, c, g, or t
  misc_feature (249)..(249): n is a, c, g, or t
  misc_feature (251)..(251): n is a, c, g, or t
  misc_feature (254)..(254): n is a, c, g, or t
  misc_feature (256)..(257): n is a, c, g, or t
  misc_feature (262)..(262): n is a, c, g, or t
  misc_feature (279)..(279): n is a, c, g, or t
  misc_feature (290)..(290): n is a, c, g, or t
  misc_feature (293)..(293): n is a, c, g, or t
  misc_feature (297)..(297): n is a, c, g, or t
  misc_feature (299)..(299): n is a, c, g, or t
  misc_feature (306)..(306): n is a, c, g, or t
  misc_feature (310)..(310): n is a, c, g, or t
  misc_feature (312)..(312): n is a, c, g, or t
  misc_feature (314)..(314): n is a, c, g, or t
  misc_feature (316)..(316): n is a, c, g, or t
  misc_feature (323)..(323): n is a, c, g, or t
  misc_feature (325)..(325): n is a, c, g, or t
  misc_feature (328)..(328): n is a, c, g, or t
  misc_feature (330)..(331): n is a, c, g, or t
  misc_feature (341)..(342): n is a, c, g, or t
  misc_feature (348)..(348): n is a, c, g, or t
  misc_feature (353)..(355): n is a, c, g, or t
  misc_feature (382)..(382): n is a, c, g, or t
  misc_feature (394)..(394): n is a, c, g, or t
  misc_feature (396)..(396): n is a, c, g, or t
  misc_feature (404)..(404): n is a, c, g, or t
  misc_feature (419)..(419): n is a, c, g, or t
  misc_feature (432)..(432): n is a, c, g, or t
aacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatntttagccaaatttattntcatnnnnncnacnanaananncattnaaaacaattttcaacanccaaatccttnttnacananaattcanatanancnanatttcantnatnannaaatttcacnnttttantacannnaattatttactttttattccttataancattcacttaancnatatcacnttaatccttaatacnatattccgcatcnatacatc

SEQ ID NO: 588937 - DNA, 118 bp, Homo sapiens
accctgtctgcagtgcctgtgggctctactacaagcttcacaagtattaagcagacccctggactatgaagaaggaaggcatccagaccagaaaccgaaaaatgtctagcacatccaa

SEQ ID NO: 588938 - DNA, 102 bp, Homo sapiens
tgtgtgattgaggatcggaaccgtaggcgggtggggtgttagtcagtatggaggtgaggtgagatgtgggtacgagtcgaatcgtatatgcatagctgttct

SEQ ID NO: 588939 - DNA, 392 bp, Homo sapiens
  misc_feature (3)..(3): n is a, c, g, or t
  misc_feature (5)..(5): n is a, c, g, or t
  misc_feature (16)..(20): n is a, c, g, or t
  misc_feature (27)..(28): n is a, c, g, or t
  misc_feature (30)..(31): n is a, c, g, or t
  misc_feature (35)..(37): n is a, c, g, or t
  misc_feature (40)..(40): n is a, c, g, or t
  misc_feature (47)..(47): n is a, c, g, or t
  misc_feature (60)..(60): n is a, c, g, or t
  misc_feature (64)..(64): n is a, c, g, or t
  misc_feature (69)..(69): n is a, c, g, or t
  misc_feature (74)..(74): n is a, c, g, or t
  misc_feature (78)..(78): n is a, c, g, or t
  misc_feature (81)..(81): n is a, c, g, or t
  misc_feature (85)..(86): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (107)..(107): n is a, c, g, or t
  misc_feature (110)..(110): n is a, c, g, or t
  misc_feature (112)..(113): n is a, c, g, or t
  misc_feature (121)..(121): n is a, c, g, or t
  misc_feature (133)..(133): n is a, c, g, or t
  misc_feature (151)..(152): n is a, c, g, or t
  misc_feature (154)..(154): n is a, c, g, or t
  misc_feature (159)..(159): n is a, c, g, or t
  misc_feature (179)..(179): n is a, c, g, or t
  misc_feature (183)..(184): n is a, c, g, or t
  misc_feature (193)..(193): n is a, c, g, or t
  misc_feature (205)..(205): n is a, c, g, or t
  misc_feature (239)..(239): n is a, c, g, or t
  misc_feature (252)..(252): n is a, c, g, or t
  misc_feature (261)..(261): n is a, c, g, or t
  misc_feature (265)..(265): n is a, c, g, or t
  misc_feature (268)..(268): n is a, c, g, or t
  misc_feature (276)..(276): n is a, c, g, or t
  misc_feature (278)..(278): n is a, c, g, or t
  misc_feature (283)..(283): n is a, c, g, or t
  misc_feature (300)..(300): n is a, c, g, or t
  misc_feature (313)..(313): n is a, c, g, or t
  misc_feature (317)..(317): n is a, c, g, or t
  misc_feature (320)..(320): n is a, c, g, or t
  misc_feature (323)..(324): n is a, c, g, or t
  misc_feature (326)..(327): n is a, c, g, or t
  misc_feature (352)..(352): n is a, c, g, or t
tananaaaaaaaaaannnnnggggggnnannaggnnnaantcaaganctacaaggggggncttngggcnccggngggnaanaggnngggnananggggggggggggnagngnngggggggnaaccagaaaggnacagacccagccgcccgnngnccagncccccagacggggggggcanaggnnagaccccgnggggccccgggnaccggccaccagcccttgggcgcccccgaaaaanaaaaaaaccaggnctgtggggncctnggncccaacangncaganaaaggggcccccaaggnccccggggggggnaganagnggnngnngccagggggggggggggaagggggngggggggcgggggggggggggggggggggggcggggcccg

SEQ ID NO: 588940 - DNA, 193 bp, Homo sapiens
catttatttaatcttctggccatgctcctgaggaaagctggtggccatcacactccccgtctgttaccgtgggccctgggccaaggcactgggacaagcgggcgatttgatatgttctggcacatggtgcagggcttgtcttgccaacggtgtcctggccctgtattacttggccagcttggcaatttccttt

SEQ ID NO: 588941 - DNA, 132 bp, Homo sapiens
atagagtggtcatgtgacgtgccgtccgtgtatgctgtggctacaaaaaatgttgagccgaagatgccgtcggaaatggtgaagggagactcgaagtactctcgagtgcttgtaggagggtaaatagcagac

SEQ ID NO: 588942 - DNA, 307 bp, Homo sapiens
  misc_feature (7)..(7): n is a, c, g, or t
  misc_feature (23)..(23): n is a, c, g, or t
  misc_feature (199)..(199): n is a, c, g, or t
gtttaangtaagttcatgatacnttgcattgtaggtagaaacaagtgactaaagggtgggcatagtggctcacagttataatcccagcactttgggaggctaaggcaggaggatcacttgagccctggagttcaagaccagtctgggctacatggtgagacctcgtctctacaaaaaatttaaaaattagctgggtgtngtggtttgcacctgtagtctcagctacttgggaggctgaggcaggaggtttgcctaagcctgggtggtcaaggctgcagtgaaccatggtcacgacagtgataactcc

SEQ ID NO: 588943 - DNA, 231 bp, Homo sapiens
  misc_feature (195)..(195): n is a, c, g, or t
cacgaggcggcacgaggcccgtcggccccccgtatcaccgcgatgccctcggccacctggggcgggctcaggatcacggtgccgatggccgcggtccagtggggcttgccgtcttgcccgtaggccagcacttccccgtcccgggtccccaccagcaccaggtcccccccggcgccgaccccgccggtgagcggntttccggtgtccacccgccacacggtttgcccactg

SEQ ID NO: 588944 - DNA, 335 bp, Homo sapiens
attgagcactcactttcctacaacttaaacgtatttaatgtgtgatataacacctcaaatattttactgcgggaatttctcagttcttcacttggggcacagataaaagtacttgggacctcattaagtataacagatgaaacagccagggttaggaatcaaacccccagtccctgaggattttgtaggatagagttgggatttaatgcattgttagtttggatggggaactttggtgattattttgaagatagccacaatgttgccttgaaagcgtgccggggttcattatgaatatgcattcctgctcaagttcatgggctctctgtggattg

SEQ ID NO: 588945 - DNA, 141 bp, Homo sapiens
gatcctgggcgcctttttttagtaggagtactacggccaggcaggtacagtggctcacctggctcactcttgtaatcccagcacgttgagagggtgaggcaggcagattgcttgaagccccaaagggagctttttgaagga

SEQ ID NO: 588946 - DNA, 256 bp, Homo sapiens
catctatcagatgcatggatatgcatcatgtctgacactccaataggtcacgtaaaggagaaacaatatgtaggggacaaagtgagttatgctgggtaatgaatatctacagtgtaaaatgaatacattgttcgaggaaaactcaatacataattcgcatagagataaatcatagttattatcaaattcaaattcaggctgggggcagtggctcatgcctgtaataccagcacattgggagtccaagtgcgtgtga

SEQ ID NO: 588947 - DNA, 321 bp, Homo sapiens
gcctgaacatttgggccctgattttgggcatcttcatgaccattttgctcatcatcatcccagtgttggttgtccaggcccaacgatagatcaggaggcatcatttaggccaggagcttctgcccgtgacctgtatcccacgtactctattttccattcctcgccctgcccccaaaggccaggagctttgcccttgacctgtattccacttactcccccttccattcctcgccctgtccccacaaccgagtcctgcatcagccctttatcctcacacgcttttttacaatggcattcaataaagtgtatatgtttttggaa

SEQ ID NO: 588948 - DNA, 361 bp, Homo sapiens
agcactcccactcgagattattagatctcaaccgtagagaatcacattaccccataaagcactcggctttaggcagagggaacccggctcatacgaaatagtatcgtatgagaaggataagttattatgaccacacgtagcatatggaggattatacgactataacttgtgcatagtggattaactactctgacctggttaaagctgacacgcgtacatgtcagttagcatatgtgaagagccatgtggtagcaggacagaatctagcgcgcctagcgatatgtggatgaacctgatagactagtaccaggactcttgcttgtccagagcaccctgtggataccctggcattcacctagtc

SEQ ID NO: 588949 - DNA, 430 bp, Homo sapiens
  misc_feature (412)..(412): n is a, c, g, or t
gcgggcacctgtaatcccagcctccacctcctgggttcaatcaattcttctgccaccacgcctggctaatttttttgtatttttagtagagacggggtttcaccatgctggccaggctggtctcgaactcctgacctcgtgacctgcctgcctcggcctcccaaagtgctggaattacagatatgagccaccgtgcctggcactaataatttttttttttttttttggagacagagttttgctctgtcgccaggctggagtgcagtggtgcgatctgggctcactgcaacctctgcctcccgggttcaagcgattctcctgcctcagcctaccgaaaagcagggattacaggcgcctgctgccatgcccggctaaatttttttggtatttttagtagagatgggggtttcancatgttgggccagcatgg

SEQ ID NO: 588950 - DNA, 1354 bp, Homo sapiens
  misc_feature (1354)..(1354): n is a, c, g, or t
agcggtgctgggtcgggccgacgtgtccacccacccggagtccggtgagtgcagccgcccgccctccgtgtagatctgcgtgccttggctggagaagttcgggaggggacaggaagggatggtgctgggccccgggcccgtcctccgtctcagtcgcctgcggaggtgctgcctcacgcctggaggcccccatctgaaccttcagataccgcgtcttgctgccccgtcatccccgtgacctccgaggcatgagttcgggagaacgcggttggttcttaggacacccactcacgctcgaggtcacttcggacacgagaagcggctggagcagaaccccatcactcgttccctggtctgggcgcaggccgcccatgactccgagctcctcagtgtggcccgccggggcccgtggacgggcctgcaaggcgttgtggccgctggccatcttacagctgacttcttctgtcagtccctttccagtgtttctagtctttcaacggcatgttggcgaatgagggccgcgttatgctttccccgaccttgttcaatcatcccatatacataaagtccactacatctgaaacatggtgcgcacaaagtgtctcgtgaggactctaccagggacctatgtgtgcaatttctactaagaatgggaaaagggcctctcatcccccacgaatagagcttccctacagtagcgagagcgaccggactccaagtgcacttcccttaccatgggttcaacgcgggacttgcccacgcactgtgggcctggttccgtgttgacagagcacttttaaccaatttcgggattcctcagcggtctgagggaggtccagggcacgggctgggtccccagaactagcggggggcatgcgcgtgcagagaaaggctacacggacccagccgcagcttgcgcagcgcctaggcgggaacacgcggaccggccagaggagccggtggacgagcactggcgatccctaggaattggtagacccgaacggagaaagagtcgggggcgcccccgtggaaaatttcgcgaaaccacaaaacccccacgcaacagaaactgtagcacacgcaaaagggatcgggggcacaacaccagatcgggggtgcccagcgggagaaacacctgagatcgagcacacagaggcagacgaatgaccccaaggggggcagcacagcaaccagcacaccccgcagaacacagacagaagagacaaaatagaagagagaaaggaaccacaaaacagaaacgagaggagaacgaccaagcagacgagcagagcaaccactagcccaagacaagcagacaaaaaagtgcgcagtcagtgccctgcaccagcagaan

SEQ ID NO: 588951 - DNA, 958 bp, Homo sapiens
cggcaaatgcttttttatgtaactgcatttgatcgggaccgagcaattgcaaagattacttgataccaacccagaaattcaaccagtctgattctcaagatagcagagtcgcacctagactgggctagaaaaaaacgtactgtgaaccgagaggagctgctgaaacaggcggagtctgtgatgcaggacctcggcagctcacgggccattgtacgaaatccagtatgaacaatgagcgttggtacaggtctcgggcctacactggcgtttaatgcgcttgtatctcaggaactacagagagctgacttgggtcttgggagcaggtgaagcaagtaactcttagcaatccacaagggagccaatgaagggaccaagtactattcaaaacctccagggcctgtcatgcgcttcccttgggtaggacagcaacagccaagctcatatcgcacagcgttcaagatgaagtttcgcttctaagcgaaaattcaatggcaaggctatcatggatctcagattggtggaccttccccttggcattacccttgtataaatgcgatgctacgcgcagaaacttcacctggcatcacacgaattggtcgacattcgaccagttgtagccagatcagttatcacctacgagacttggcagacctaacgcaaacagacttgcacaagattacattccaatgaaccacaagcgaagtttacagtctgccttaacacacctgtgctatataaatgggatggccaactttgaacatctagcagcggtatttacacacttgccaagggtattcccaacattcgacctctcatcacggccggcgaagcgataaacacaggacatttattccccagtctaagccgggctacttataccacggctgtaattcctgggaccaacaactcagctctctcaccaatctcataggtccaacgtaggcattactataccgtc

SEQ ID NO: 588952 - DNA, 248 bp, Homo sapiens
tggagagtggaggggattccgggaatatatctgtcgacgatgacatcctcagcgatcctcattctctctgttcattcagaaactctcccatcggcggtagacagtgaagtagttgttcaacaattacagttgcctagtaactacactaagaactataatttaaaatccgtgtcaaggacgcccctgtggggcctatggtgcagtgactcacgtcctgttaatccctagcacttacaggaggccgtagg

SEQ ID NO: 588953 - DNA, 422 bp, Homo sapiens
ttatgatgagatgactttactctcagaatacgtctcatgctcctatgttctgcattccctgcagcaaacacttcctatgctgtctgcttccctgtccactcatacaggaaagggcttcgatgttatagagtcactcttattgctcctgctaactgctgtcctgataacaatgggtcttttgcatgggaaaagcattatagagtgaaaggatcactgatagcagtcaaaaaaacacattttactatgtcttttaaaatctgtgggatcttagacaagtgacctatcccatgtgagcctgttttctcatctgattaaatggggttgttacttgctcggtgaatgcttgtgttgtcacccagtgaaataaactccagggaagtttagttagctttcccttctcaatttacctgcagatactgttt

SEQ ID NO: 588954 - DNA, 217 bp, Homo sapiens
cgtaatatgtacacaggttacatgtctagaatagaatccttcttctaatttatggaacaatcaaaaccagctaaaataacatttgggggtgcttcataaatggcttctgaggattaccaataaaaatattctttggtaatcctttcttggccacaaggctaccattcttacttatattaatcccaaaggaaagggttttcggttaccatattacggg

SEQ ID NO: 588955 - DNA, 444 bp, Homo sapiens
ggcattggaagatccacagctaacatgccaggtcccctggcagcctagaaatggtgagagtgccgggtccgacatcccgagaaggggaaggggctgattggaaccggtgggaagtggctgtggcgggactccggcctccccgcagtcagctccacaatctgcgcctggagttctttcccatctcggcctcagtctccttcagccataagatggcgaatgcgctgactgcgggaccctgggcgacctgtctcctccatgcgctgtgactgtgccctggcctggagccctctctgggccgctctgcacaccgcatggccgcgtctctccgagattgtgcagggaccacgggaggggcgtcaggggagaatcctgatcttcggatgcgggttcatgaatgggaagagctttggtccagtgaggtttccagtccctcttttcttctgt

SEQ ID NO: 588956 - DNA, 381 bp, Homo sapiens
gatgacatgatacgatcgagctcggtcctcttgtgacacatgatatgctgaggtgatgaatactccattctccgtaatgtgattattacatatgaatacctgtatcaacatattacatgtaccccataaatatatacacctataatataccctcaaaaattaatttttttttttggagatggagtctggcggtcacccaggctggagtgcaggggtgcgatcgcaactcacggtaacctcggcctcccaagttcaagagattctccggcctcagccttctgagtagctgagattcacaggcacgtgccaccacacccagctaattttggtattttaagtagacatggggtttcatcggctatggaaacttctaaaactagg

SEQ ID NO: 588957 - DNA, 130 bp, Homo sapiens
  misc_feature (58)..(59): n is a, c, g, or t
tcgaagagacctcaatcaccgtttttcaggatgtttgatcacaatacgaagatgacgnnatccaatttcagaacaccacagggcactggcacacagaggggattattacagaaccactgagatgacattt

SEQ ID NO: 588958 - DNA, 494 bp, Homo sapiens
tgtactcgagtcgttataggcgaagatgatgaagcgggccccgggacggaggaattctaataaacggcagacctgtttagagctcatgactgttaaaattccgcaaacctgtcggctccttgtggcacatctaaaatagatttgattctaatggctaacaatcagtatacactgcttggacctggtctagtgattacgcacgctagaacggacggggaccgactggggccctccttgagacgactgtgatcagacctctcgtacgaccggactgtgaagttggacaccaacgcatcttaccctatcgtggtggaacttttggtaactgtaccactaggggaccctgaccaaccacttttgacaaccccagacttagaactactaaacgctccaccaaaactctttggtgggactgtactggcaacaacgtctcactgggagacacgttggcttattaaaacggcagtaatggactttggcaccacaagaacagt

SEQ ID NO: 588959 - DNA, 162 bp, Homo sapiens
tatagcgctagttcacgagtactgggtagtactattgaccagcgatgggggcttcgacatgggcttagggagtcatacgtggagtccgtaaagaggtatctttagctataaacagctattgtgtaagctagtcatattaagttgtcggctcaggagtttgac

SEQ ID NO: 588960 - DNA, 686 bp, Homo sapiens
taattgatgttgtattaagccacttatttgtggtgatatggttacaacaatagtggaaaataatcagttcccaaatgggagcatgaaataagagtacaaaataaaaattttccatacatgataataaaagaaatcttattttgcatctgagaaaactagaacctctactatttacaccttcttattaatgatacacaagtatggccgggctccgtggatcacacctgtaaacccagcactttggaaggctgagggaggtggatcctcctaagctcaggagtccaaaaccagcctgagcaacatggtgcaaccccatctccaccaaaaaatacaaaaaattagctgggcgtcatggcatgtgcctgtggtcccagctacttgggaagctgtggtaggaggatcacttgagcctgggaggcagaggttgcagtgagcagagattgtgcccatgcactccaaccttggtgacagtgtgaaactctgtttcaaaaaaaaaaaaaaaatattgcttgtgtttggttcctttaaaccattttccaattatcgataccacaggctaaatttgattaaccagggtgatctcacttggcccgattataaagtaattttctagggcaattataaacgattacactcccagaaaaatgtactcctcaaaggtccaccaatcatcttcatttatcaag

SEQ ID NO: 588961 - DNA, 468 bp, Homo sapiens
  misc_feature (354)..(354): n is a, c, g, or t
  misc_feature (362)..(362): n is a, c, g, or t
  misc_feature (375)..(375): n is a, c, g, or t
  misc_feature (396)..(396): n is a, c, g, or t
  misc_feature (420)..(420): n is a, c, g, or t
  misc_feature (445)..(445): n is a, c, g, or t
  misc_feature (453)..(453): n is a, c, g, or t
tgatatggagtctcaccctgtcacccaggctggagtacaatggcgtgatctcagcttactgaaacctgtctcccaggttcaagtgattctcctgcctcagcctcccaagtagctgggattacaggtgtgtaccaccatgcctggctaattttttgtatctttagtagagatgaggttttgccatgttgcccaggctggtcttgaactcctgggctcaagagatccacccactcagcctcccaaagtgctaggattacaggcatgggccactacacccagccagtaattctttttgtaagtattattctactttatgcgtactacttatggaccagaatttcagaagggcaagtnaccccctngcagcatatgctnaattaaatctttccttggatnagtgtattttttttttttttgagntaggggttttaactctgttggcccngggtggantttagtgggcaaaat

SEQ ID NO: 588962 - DNA, 236 bp, Homo sapiens
aaaccactagcaccttcaactggtaaatccagtcaagtaaggcaaactacaaggggctacgccactaactggaaggcacaggaaggatcgcagaaggaggaccaacaaggctgtccttagccttcactatagcaaaaatcattttgaaggcacctcatacagattccagtgcgttaccacgaagagcattgaagctcgaggtctagaagactgcaggctcgatcatgccttcatat

SEQ ID NO: 588963 - DNA, 183 bp, Homo sapiens
actcgcagggagctactgtagaaggtggtagatttctcactcaggcctgctgttgtggtactgccaggtaacgctgttgtttcagatgagcctgaactgatgcgtgacattgtagattctccaccacgtgctgatgttgcagagccagatgagaagagtgctgcactagcagcacctgtgctg

SEQ ID NO: 588964 - DNA, 103 bp, Homo sapiens
aacttgcttatgcggtcgatctagaggctcccctgttcagaatctaatcaacccacagactcactagaaataacaaattattgttttaagccacgaggttttg

SEQ ID NO: 588965 - DNA, 299 bp, Homo sapiens
tagaggatccgcaaacaccgcaatctgttattttttaaccccacaatccaggttaaactgagctatttttaatgcccagagtaatttctaatatttcccactgccaaacagaaattggagaaaggggactcccaagaagtcggggggcttatacagactcttcttagaagtctacttttcttccctgtggtaactattcaaggcccaaaagtggaggaaccttttaggaagtatgggggaaaagaagattaaccttctggaaatttaagaccttaacttggattccaggtggttccacc

SEQ ID NO: 588966 - DNA, 118 bp, Homo sapiens
ttttgttttttttaaaaatgaaataaagacccagggggaaaatgggtgttgtatggggaggcaagtgtggggggtccttttcccccccccctttgtccctttgcaaatatattttgga

SEQ ID NO: 588967 - DNA, 525 bp, Homo sapiens
gctctgggccttggccctgattatcatcagggggatggtacagatatgcaaaggagagtagttctggctggagccaaagaaggcattggagaacttccaggaacctgacatcggcctcgtcgcacgggctttccttcagggctccttggcctatggaggctggaactttctgaattacgtgactgaggagctggtggatccctacaagaaccttcccagagccatcttcatctccatcccacgggtcacattggtgtatgtcttggccaatgtcgcttatgtcacggcaaggtccccccaggagcggctggcatccaacgccgtcgctgtgactttgggagagaagctcctaggagtcatggccgggatcatgcccatttctgtggcccggtccacattgggaggagtaaaggggtctctcttcacctcctctcggcggttcttcgctggagcccgagagggcaccttcccagtgtgtgggccatgatccacgtgaagcgctgaccccattcccagtgtgctcag

SEQ ID NO: 588968 - DNA, 399 bp, Homo sapiens
tgcgcagcctccttccctcgtaacctcttgttatcatctaaagtaattctagttgttatttttgtatgctgttttggttaacacactcctttttaaatattctgaatcccaagtaggacgatgaccattcataagttcagtacgacacgttttagacttgcggtttatatgatggatgtgcttattctcttggcattttgttttgcaattttattgttttcttgccggttttgttttttattattattatttttttaatggataagtgtttcttctttggaaaaaagaaataagatacctgctaagacaattagctgatggccatatgtaaatgacttgctaaaaaaaggaaaaaactgcctgttaatgtcacttctattccaaacgcgcttcaaggca

SEQ ID NO: 588969 - DNA, 241 bp, Homo sapiens
tgaagtatttactgtcgttgccagctgaggaacatgatgtgtggcgagtttaggcaccgggatgccactggaaaactggttcatgctacaggatttctccaaaatgccattgtacaactttgcttgccggactagcagatcatactcttcagtttctgtcagacctacaccagtcgggcagaaccccacaggacacatacacagttacaggcgaatcccctcgggaggaatcctctagggg

SEQ ID NO: 588970 - DNA, 407 bp, Homo sapiens
tcagatatgattatcgccaactagcgaacccactgtgtgagtatagctcatgtactcggagactccacgagcgcgcagactcacgagcacgctagcatgcatgcatattcagaggaaactgttgtgacacaggagatgttgactggtcaactccttctccactgagtctgcattcctcgcccttccagcagcttgcgggaagtgggcggatctccacgtcccagggcaggcttgggtgtccatagagcccctggtactcacggcaggcagccggggccattgtcctgcttgtgctttctgcaggggcctcctccagctcgggccagcttgttcctgtgcatccttgaggggccagctccccacgctgctcggaatccgcaatggcgttctgcagattggcgcactga

SEQ ID NO: 588971 - DNA, 199 bp, Homo sapiens
cgaatctataggatcccgttcaggcatcaagccactgcttaatatttaagcaatcactttatatgtgtgtcgaagagttggtttagtatgtcatgtctgggtacaagcagatgcagtataaactcacaaacacagatttgaaaataatgcacatatggtgttcaaatttgaacctttctcatggattttcgtggtgtgg

SEQ ID NO: 588972 - DNA, 194 bp, Homo sapiens
tttgttgatggagatgaagctctcgttcaggcgtgacgagttgcggttcagcggcggcacccacatctgcaccttgaccgggtacttggtgcttgccacgaactcgaccttggcgtcgatgttccacaggtcggcgacttcatcctcggtcaccgcgaagccgatgaagaagatctgataagccgcgaccgcca

SEQ ID NO: 588973 - DNA, 348 bp, Homo sapiens
ggaatcgtgatgctgaggtgatctagaggatcccagtcgacggagactctcttcagtcctcctcagcctgctgtaagcctagcagctccttcgtctagacagagctcctctcaccctgatgcacctgtctccctaaaatagtatctgatattcatgatacccataatgtggcctcaaacggtcgtaacaatcttatctgcaactagtgctgctggatctctacctttgcagttgcgttctaagtgcgttactcgtattgatgcacccaaatcgcatttagagttctgcttcctgtggggctcgtctcatgatctgctctcttttggagggccacccccaaaagagagt

SEQ ID NO: 588974 - DNA, 626 bp, Homo sapiens
ggatgcgatgtggttgcctatggattgagtatggaaccgtgtgctatgaccttgcactcattcgcgctcacgtcaattgaagcagctggagaggggacgctgacccctggaggctcgtgcgggacagcatggagggccggcgcgacagcatgctagagatggccaagcactgttacacaatcagaagcccgctgcgagggctgatgggtgacgaggaggagtggctcatccacgtacatgcctggagcataggtgtgctgagaaagctagcagcagcctaccctatccgctttacttgctgcaatctacaggctaggctggtcactaccttgcgacgtaggagtgcatgccctgtttaccctcgaagaaagatccactatcactaagccacctgagctgggccatggtaggccctggaggtgacatccatgctggcccagggctggggaagcccgggcaggggcagcgcctggatatctgttatctccctggcgcgagtgatggctcaaggttccagtgaccgtccttcaacctgccgcaaacttatctgtgttggagcagcttcagtgtgcaattgaattgaaatacatcatttcctctcttttagagaaaagaaaagagaaaaa

SEQ ID NO: 588975 - DNA, 313 bp, Homo sapiens
  misc_feature (294)..(294): n is a, c, g, or t
gcgcctggcttattattccttttttttaaaaaaaactttttttggggggcaggaccatgggatctcgctttgtcgcccagctggggcgacagagcgagactccatctccaaaaaaaaaaaaaaaatagggccagcctggccaacatgacaaaaccaaaccctgtctctactaaaaatataaaaattagccaatcccagctactggggaggctgaggcgggggaatcccttgaacctgagaggcgaaggttgaagtgagcccagatggtgccattgtgctccagcctgggtgacncagtgagactctgtctcaa

SEQ ID NO: 588976 - DNA, 438 bp, Homo sapiens
  misc_feature (41)..(41): n is a, c, g, or t
  misc_feature (59)..(59): n is a, c, g, or t
ctgtgtgaaacctggtgaacgcctaggggccctcatgttantggaaatcaccacagttncctcccccttttgtgactggcctgaatttccatgtacccataatgtccctcaaggttcaccccacatgacatgttacatccttcccttttaaggctgaatcaggctgggtgcagtgactcatgcctgtaagccgagcactttgggaggctgagacgggtggatcatttgcgatcaggagttcgagaccagcctgggcaacatggtgaaaccccatctccactagaaatgcaaaaattagctaggcgtggtggccagcttacttccaagtaagtcccagatacttggaaggctgaggcatgagaattgcttgagccaagatcaaggcagaggttgcagtgagccgagatcgcaccactgcactccagcctgggtgacaga

SEQ ID NO: 588977 - DNA, 111 bp, Homo sapiens
tagaggatcccgaacatgttgtggctctagccaagcaatctcccacctcagcctctaaagtgttgggattacaggtgtgagccactgtgcccagctctcagaacactgtta

SEQ ID NO: 588978 - DNA, 104 bp, Homo sapiens
ggtaagtcttacaaagcaaggtgtaaagaaaaacggcctgccattcaagaaagtaatacaaagagaaaggtgctctgaagaataaaaaaaaactaaacccaaaa

SEQ ID NO: 588979 - DNA, 110 bp, Homo sapiens
tctagcctcgccagtgtcctagcctcgccagtgtctagcctcgccagtggaagctccgtcatagcctcgccagtggaaacaagtgcatagatgtgaattggtttttaggg

SEQ ID NO: 588980 - DNA, 1157 bp, Homo sapiens
gctctgaggaggccaccattgagacggttatacaccacatagatcacgttggtgaattgggaggaccacgcaagagaccagggtgcccatcatcctagatgggcaaaaagtgagacctggtgtacggggagctcaatggaggccgtgcatcccgcagtcatgagccagattacccgagatagagaacatgcgtggagctgtcggccaagaacctgaggaacatctcagcagctgtacatagctacgccgcagaaaggccgaccatgacatccgagaagacgccgcatctatgaaccctgaaggacaaggacagatgaaggccccgcaggatgcgccacagggcagcatgacggcggccattacttccaggactctcaggaatcagagaccatgaggacaagggcgcatcaagtgagagaaggatgctcaaaaagactttacccaggacaatccttgcgtgtacgggcaaacacccatgtgaacccccagcaggagccccccaatggaccgacaccgtgacaagaaacggtgatgaggtgcttgccagaggaaaccggtagagctggcgacaggagtagccaggagaacgagacccgaggcttggaacacccgttggactggggaaacccgatacaatacactgcaaaccacaggacatcaaaacaagtacaagagagacgggcaccggcactaaaagaacaccaagacaatgagaaacaccaaatagcataacacaaaagccaaacacggagataccagacagagatgaccccaagcgaagacctgaccagacaggaaccaacacgacaatcgcgacgataagaaacaccaaaggaaggaccacagccgagacatgaaacagacccaaggaaacaacaccaaaccaagcgggcaacacaaaaaacaaaagcaagaaaaaagaggtagagaagaacagcagacggaaccaaaggaaacggcggaacgagcacgcggtaacacgaccccagggtgaccagatgaagaaacgacaaagacaaaggaggtgaagcccacagcagagagagacacatgaagagcacgcacagacgcacgaacaaggacaacagatacgaacaaagaaagacgcaggggacaaggataacccctatagactgcaaaccgtcaccacacagtgg

SEQ ID NO: 588981 - DNA, 134 bp, Homo sapiens
tccagctcggtacccaatataataatgtaattttataataataataataataatgaaacatcacttaatgtagcctactttaaatgtgctcaggatgcttacactagcctgaagttgggcaaaatcatctaaca

SEQ ID NO: 588982 - DNA, 434 bp, Homo sapiens
agggcgtgcctgccaggctcgctgctctgtctcgtgttcctgactgcagcacgaacgcgtgtgccaggatcgtgctgcgatcttcaggacgttgctggaggcttgtgacaggttgcgggcgtgcgccagggtccgccccgcgcagtgtccacgctactttctgtggccggctatcccgctggtccccagcctgagcagggcgctgtcggccgtggctctcggttataatcaccagggctgttaccctgttatcaccaccgcaaagacgggccccaagttcttcctgattcttgcgccccccttgggcaattcttggtcctgttgatgcagatcccacttttccacctcatgggggtcgtccaggagctgcggcagaggtcgaggggcctgcgaggctcgagggtaccgctgcgaggtgcttctgctgaggctga

SEQ ID NO: 588983 - DNA, 270 bp, Homo sapiens
  misc_feature (26)..(26): n is a, c, g, or t
  misc_feature (37)..(37): n is a, c, g, or t
  misc_feature (40)..(41): n is a, c, g, or t
  misc_feature (81)..(81): n is a, c, g, or t
  misc_feature (87)..(87): n is a, c, g, or t
  misc_feature (93)..(93): n is a, c, g, or t
  misc_feature (97)..(97): n is a, c, g, or t
  misc_feature (136)..(137): n is a, c, g, or t
cagctgcgggccagtttgcaacgcgnatcagcatgtngannctcaacagtggaaaagtacctgatataaaagacatctttnggagtncccgtngtanctcagtggttaacgaatccgactaggaaccatgaggttnngggttcgatccctggccttgctcagtgggttaaggatccagcgttgccgtgagctgtggtgtgggtcacagacgcagctcggatcccgcgtttactcaactgcgcgtttgcgcacatggggatctctctagag

SEQ ID NO: 588984 - DNA, 733 bp, Homo sapiens
aacaaagaagttacatattggtgggaacaagagtaaatcctggccatatgggatacggccaggtcaagagagattccatgcatgggtccaatttactacagagattcacctggagcgatttagtctatgacataacagcatgaagattctttccagcacggtaacaacaatctggcgtcagacacgcaacttcacggagaaatgtctgggacatgaccgatctgttttatgtatagtcggtaataaaatagacttggcacaaggagagacatgtttccattcaagaagcagagtcgtatgcacgaatctgtgggagcaaaacattatcatacttcagccaaacagaacaaaggaattgaggaactctttcttgacctttgtccacggatgatagaaacagcacaagtggatgcagagagcaaaaggcaatggctctagatcagccgggaactgctaggcgaggttgtacagattattgctgatgaacctcaagcccagaccagtggtggagggtgcgtgtcttctggataactgttcacgcctacagaaattacacagacagaacaaaactgtggatcatttgccctcataatgaagactgccatattccaagtcacattatttaccaaatggaacttatagaatttacccgtcttttacattgacgttataacacttgcagagaagcttaagtgctaaacttagaggaggttgtgaccagagcattgggctc

SEQ ID NO: 588985 - DNA, 1334 bp, Homo sapiens
catttggcctccgtacactgttggttctttgcttgcgttgatttctcgcctctttgttccctgtttctatctctctcttttagagagtttggtcgcccttcttgctgtgtactatgatcctccttttggcccttttgcttagtctcccctggcgtccgcctttaggtgtttttacccaaggttctcccccatttccgcctctgctggagtgtgccgatctgcctggactgttgcccattgtccttcttgttgctactccagcttcactttctaggcctggccaggtttgtccagaataatggtctcatcatattgcggcattccctcctagagcaactatccgtatgggcccaaagtattccaagtaccagtttcgtatttcccaattattgtattttctcctccccacaccatctttcgcacatttatgtttcggtaccaagaacatcgtttgtcatactcgcccttacccagtaccaatcctttatgttgtaaggattacctctcggaaagatcacttttctaactttgtggttagttaaatgtttcctgtctctttcccagtagtctgtccaaggttgtataaaaggtgcttaccttaatgaccatgagccaaaaccccagatattaagttgctgagaattaaagtgggcatttagtaatcctagtaagaccatcgttcgattctcaaggagagtcttatcttaaagtagtgcgagagagtgcaatcagtgccagccacattgttagtctaatatcatgttattaacaacggcgttgtcgactaatgaaagccgtggctgttgtttaaagaaagaagttaaagatggcagcaattccagtaatacagttatagttgatatttgttagagagaactagtaatttgatgggctaaacatgagttaaagtgcttcagtttgtttagcagtcttacaacgcttcccctgtataatcacttcttaagtggtgtagatttgcctcactcctatgactctgagatcactgccgagagtgagaaaaatctccccaaaatacaactcttcaagtgcattgtggaaacccacaactttgaacagtaattccagtctcactaatcgtttagatcacaccattgtaaatgtgttacgggtccatttgttcctggaatgcgtttaattctaaagtcagtttctccctgttttggagattttgtagttaattaataaattttggctaattgttttggaaaagatagaagcatgtctgtgtagatatgaagtatagtttgttccataaaacagatgtttattttgtaattgagagagagaatacacaacatgtactttgtttacac

SEQ ID NO: 588986 - DNA, 222 bp, Homo sapiens
gaccaatgaaatgttggctgagatgagggagaagggaattcaaaaacatttaatggctatggagggtcaattcaaaagggtaggtacaactccaatggtggagaggaagtttggttaagaaggtccaataacaagcaacaggggagtttccgggaaatattaagcacagggtttagctagtatagttagcacatttttaaatgtgcatgtcttttgtcgacg

SEQ ID NO: 588987 - DNA, 420 bp, Homo sapiens
tcgagctcggtaccttccagccacgcaaacagtacttatcccctggcatgtttcagtgtttttgtgaaggactaactttctataagatttctcggccgggcgctgtgtgctcacgcctgtaatcccaacactttgagaggccgaggcaggcggatcacaaggtcaggagttcgagaccagcctggccaacatggcaaaactgcgtctctactaaaaatacaaaaatcagctgggcatggtggcacatgccctgtaatcccagctactcaggaagctgaggcaggagaatcgcttgaacccaggagctggagattgcagtgaaccaggactgcaccaccgcactccagcctgggcgacagagtgggactctgttctcaaaaaaaacaaaaaaattagggtggcggggattcacctctaaga

SEQ ID NO: 588988 - DNA, 147 bp, Homo sapiens
agacgcgatcgatagtgatgaccgggcgtttgaatggaaacgtcgatcgcgccgaatcgatcccaagcctgacgataaaaatcaaccacctgcgcctcatcggtgacgtcgaggatcaccggcagaatctccacaccataacgctgg

SEQ ID NO: 588989 - DNA, 1395 bp, Homo sapiens
gacgcgacggcggtccgcgcgcccatttcctgcctctggttgatggctcgtctgtagttgcacgccgcgggcccagttgatatccctggacacctgaaccgcaggaaggacagtcctaataagattcacatttgaaccacgcgatacaaattccagggtgagcaccaagtctcaaaagtctcctagacgcgatacagttaccagtatcatttagaagcaacacagaagataggcagtctaatagtcgataacatcttcacagaagttgaccatggggacggacaatccctacgtagactagacaatccctcaggtccaaacaatggatagagcacaatatggaaaaaaacgcaagtggaatcgcaaatgctacaaagtcgattcactaaggtacaccacgccaagtgataatcactaagggaccacgacggggaaccaaggatgctgaaattctttcccgttagattagaccaaaatagaagacgccttcaccttcaaaaaactgtgactttggaacacagcacagagcgaaagtcctcttgtaaacgagacagaataggaaccttaggacccaagggaagttcacggacttagtccataaatactaaagagcggcgtagagaagactcccatggcgccgcctgaactcaccggcaggtcggacaaatcgtcggaaaacaactttagccgcgaagtaagacactgaaggcaagaatccccagatcgaaacgggtaaacgaggaaaaacgctatcagagagagccacatgacccagtaacacgcgttaactcaataccatgggcagaaagtggggtgcatatatcgcgagaaaaggaaaattagaaatccaattacgctgcccgttatcacaacgagatgtgtgatgccagatattgacggaaatacacgcacaattggcgaagggagagcaacaaagggcgaacagcccttgaacattcgaagtgtgtcaagcatataatgacacaatgccatgagcccggagagaaggctgcaaagagaacatagagagaaaaaagcctcaactggaacagacgaacatggtcagtcgccattccaggccaactttgaccccgcgcacatgtaaatcaccaatataccaaatgaagtacgcagcatcaattagcgaatgaacatcgtggagaacccacacccaaagcaaagcaatgaaactgcatcgactacgaacgaaacttcgtagccaccaaaagtaagagaacgcccggaagcgaaacgtccctaggaagagaagcaatggacatccgagataggccaaaatgtcacaggaatacatttaccactaagatgatatagtgagagcaacatggtagagcacgaaacgtcgaaatgaaggcattaaaaagtggacagaaaaat

SEQ ID NO: 588990 - DNA, 834 bp, Homo sapiens
gaggcgcatgctctggggcagttccgaggcccggcggggatgcgccgggagttccttgtgtgccgatcgtgtcaccaatggtacgacggcaagcatgtctacccaagcgcatagctaacatatggtccccgcccacatgcaatatgccatcctctaaaagcaagaaggtgaaggtctctacacaggtttcctacagaggacgagaacccggtttggttgctgacactaggtcccagggtcgaacgtgggtccagtcgtggtgtgctgcgtgtgcagagatgtgtatgggatggaggcatagatagccgggccctggttatccatatcctgagtaggtatgtatgtaggtcaaggcttgagggcattggtgtgtgcctagtgctcatcagcgagtgtccgtaagcacagagatgtgcgcgcaggtcatatgtctcgtgtctaagtcgtgctaattgaatgatgggtggcgcctgtccgaaagggtgacaactaatcaagagtggaacggggcctccgcgagaattgggtccccctggggcaccagagtaagagacgactgccaacagaatggacactgtgcttgaggtcaccatggggatggattcgaggactagcgagaagggaaccagaagttctgatcaacaagtgtcgacgtcgctcggtcgaagcgctgggacttgagacttgtgcccaggggtggtactttgtccgcgtaccgtagggaggggcctccccttttttccccagggcgtacgcgaaaataaaaaccccgggaggttaacctccgagaaccttcgcgttgggggagggcctcaaattgtaagtgaacacgta

SEQ ID NO: 588991 - DNA, 200 bp, Homo sapiens
  misc_feature (195)..(195): n is a, c, g, or t
tggtgaaaggaataagcaactcaaggtaaataaagaagaaagatgaagattcttagaatcgtagaaagactgcagggggaaataattaaagcagctttattccttacggcattcatcattcgtcgagctggaaagcactgacaactttgtaatgagttttttgcgcttaactctgtcaggtgatttatatgaatnactta

SEQ ID NO: 588992 - DNA, 197 bp, Homo sapiens
  misc_feature (175)..(175): n is a, c, g, or t
atggccaatcaggccacacagcattggctcaagcagggcagtgggtgttgcagggttcatgcagcagtcagctcatcacatgcacaccagcgcatcagtcatacattcccttctcaggccatagtcagggcaggcaccatgcaggtgtgcagcgcatcatcactcagtcattccntcagcacagtgcagcataggtc

SEQ ID NO: 588993 - DNA, 309 bp, Homo sapiens
caaacgccgattggtgagatgagccccattgtgttgtggtaaatatgtagagggagtatagggctgtgactagtatgttgtagccctgtaagctagagagaagcgatatttgatcacggagaacggtggttactacgccacagaggaattctcccagataggttacctagctgggcgagtaacggcgaggattcgcgagtgctctgccttagaagttcatcaacaaatgctattaagtggggcagtacgatgttttgaaaggtcccttgcagcagtacggaattaattgactggcggacctggtcgacc

SEQ ID NO: 588994 - DNA, 368 bp, Homo sapiens
gtcctaagctgcatgccagcaggagcgggatgagctggctgacgagatctgccaacagcatgtggcaaaggagccctggcgttagacggagaagcggcgtctggacggcccgcactcgcccgagctggagggaggacgctggaggaggaccagggcaacacggcagctgatcaacgagccggctgaagaaggccaacctgcagatcgaccagatcaccaccgacctgaacctggagcgcagccacgcccagaaaaacgataatgctcggcagcagctggaacgccagaacaaggagcttccggtcaagctgcaggagatggagtgcactgtcacgtccacgtacaagggcctccatcagcgccctcga

SEQ ID NO: 588995 - DNA, 431 bp, Homo sapiens
  misc_feature (68)..(68): n is a, c, g, or t
  misc_feature (164)..(164): n is a, c, g, or t
  misc_feature (166)..(166): n is a, c, g, or t
  misc_feature (400)..(400): n is a, c, g, or t
tccggcataagccccttccccacaaacccccaccagcaaggggctggggccagggagcagagtttccncaagacattttgaagtcatcattccttttttagggggccttgcttggtggcaaaagggaatgtcagcaggcccccatcgccatccttgtgtctttncncgttgtattgtgtatccccgggggcattattttcattgtaatgttcatttcccccccctgctccagcctggatttggttttattttgagcccccattcccccaccccagtttcttggggcccaagtgtttgtgcatgtcccccaggagcccccgtggggagccgatagggaggggatggagaaccaagccggggcttttttcaggcccagtggccggtcagcctatccagggcncgcagccaataaaccgaaagtgttacagcca

SEQ ID NO: 588996 - DNA, 170 bp, Homo sapiens
tggaaacaatgcttatcaggcacattttaatcacagtaagatttctgtatgacagaaacaacaaaaggtgtctgtcttctatgtaatattgtttttaggacacatgactttgaaattaactggactatacaatatttttccttgtaattgctcttgttatcatgtaattt

SEQ ID NO: 588997 - DNA, 711 bp, Homo sapiens
  misc_feature (1)..(1): n is a, c, g, or t
  misc_feature (63)..(63): n is a, c, g, or t
  misc_feature (158)..(158): n is a, c, g, or t
  misc_feature (175)..(175): n is a, c, g, or t
  misc_feature (185)..(185): n is a, c, g, or t
  misc_feature (245)..(245): n is a, c, g, or t
  misc_feature (256)..(256): n is a, c, g, or t
  misc_feature (262)..(262): n is a, c, g, or t
  misc_feature (295)..(295): n is a, c, g, or t
  misc_feature (341)..(341): n is a, c, g, or t
  misc_feature (382)..(382): n is a, c, g, or t
  misc_feature (395)..(395): n is a, c, g, or t
  misc_feature (415)..(415): n is a, c, g, or t
  misc_feature (426)..(426): n is a, c, g, or t
  misc_feature (431)..(431): n is a, c, g, or t
  misc_feature (456)..(456): n is a, c, g, or t
  misc_feature (507)..(507): n is a, c, g, or t
  misc_feature (526)..(526): n is a, c, g, or t
  misc_feature (553)..(555): n is a, c, g, or t
  misc_feature (557)..(560): n is a, c, g, or t
  misc_feature (563)..(563): n is a, c, g, or t
  misc_feature (699)..(699): n is a, c, g, or t
ntctgcgcgctgtaatcccctgcacatggcatcttagctgtgaaggagaaagcagtgcacganaaggaatgagtgggcgggccaacggcctccacaagctgccttccagcagcctgccaaggccatggcagagagagactgccaacaaacaaacagcnagctaacagagtctctncacagctggngtctgaaagctcgagtagtggcatgtgtgaatctgacgaaaattaaaagtgtgcatagtncattacatgcntaaaanactaataataatcctgtttacgcgtgacgtgcngcaggcaggtccagctccaccactgccctcctgccacatcacatcnagtgccatggtttagagggtttttcatatgttattcttttnttctgtaaaaggnaacgaaaatgatacagaacnaaactttcccnttttnaaactaatgttacaaatctgtattntcacttgtatataaatagtatatagctgatcattaataaggtgtataagtncaatgtattctaaaactgntaagcgaaaaaaaaaaaaacaaaaaannngnnnnggngtcctcctcccccactcacgctggtgatcactgtgctctctgccagcggcgtggggtgacgggaggagggagtcactgtgtgtgcgagagtgcttcagactcaatttccaaaataattttcacccctctaagcatntaaatatacaaa

SEQ ID NO: 588998 - DNA, 461 bp, Homo sapiens
  misc_feature (20)..(20): n is a, c, g, or t
  misc_feature (29)..(29): n is a, c, g, or t
  misc_feature (51)..(51): n is a, c, g, or t
  misc_feature (236)..(236): n is a, c, g, or t
  misc_feature (308)..(308): n is a, c, g, or t
  misc_feature (313)..(314): n is a, c, g, or t
gccctggagccccccgccgnaatcccccnaggggccaaggggcctcccccnttttgtggcaggcaaatttggtggtagttggaggttggccattaagcccaataaaacctcccacctttaaaaggccttccaaggaaaaaaaccccggccccgggccaggcaagggggggttttccggttggccccaaccttctcttttttttttttaaaaaaaaaaaaaaccttttaaaaaaccnccccctaaaacacaaaacattcttggggtttggacaaaagaattttccaaattttgtgggggttttgttttnaaaannaggaaatttttccccccaaaaaaccccccggtttaagcccccccaaatttaaaggttggggaatgggggaaggccaggggttttttttttttttttttaaaagggggggggacaaaaggaaaaaaaaccggggccggggccctttta

SEQ ID NO: 588999 - DNA, 322 bp, Homo sapiens
cgttacggatcgcatgtccctcaagcccttcagaactctgcttcccttcgttcttgggaggctctcctcattgcagtgggtcagtacacccaattttgtgggacgcaggtgctcctgctgttattctggcagaccggtgccaggacattcccacccctaaaaaggagccatgctctccagtaaggatgatgggctcctctccctcagctggtacctgtcgtccccatgcaggtagcaggaatgatagggtgtctggaagcgagggcatcttcatacgagatttgttcttgggcttggtaagcatggggaaaccgggaatcct

SEQ ID NO: 589000 - DNA, 233 bp, Homo sapiens
caaggtatttggtaagaggtggaatctaagtgttgtatgtccaatttacttgcatatgtaaaacattgaatggcacagcaatggtttacatatgcaagtaaatggacatacaaaccattgctgtgccattcaatgttgatgcataattggaccttgaatcgataagtgtaaatacagctttgatctgtaatgcttttatacaaaagtttattttaataataaaatgttgttct

SEQ ID NO: 589001 - DNA, 915 bp, Homo sapiens
  misc_feature (131)..(132): n is a, c, g, or t
  misc_feature (796)..(796): n is a, c, g, or t
gccgttgcccggggatgggtccctgacacttggggaagtaggagcccgtgtgatcggcgtctgagtctgggctgagaccagtcctggccaggcagttaccaggacggtctccggaggccgggattcgcggnnggtccagcagcaggaagaaaccccaggaggaagaaacctcagacagatcgccggcgaggcagcgcgggatcccagcctcaggcgtgcgcggacggtgtgcgggtggaaacccccttcccatggggtgaagcgcagtctgctccagagacccactgttagggtcggggatgtcacagaaattaacagggcagccaattcccatccagaggggcccaggatgaccccgaaccctctagctcagccccaagctcgggccagggagtgaagcctttgtccccaagcaacagagtgagggtctgtctctaacccggtgggctccagtgaaaggaaaatggcctggaggtgcccacaggagggcgccctagttctgagacaggtctacggctcccagactgcgtccccatgagtaacagagggacacgcagaggggcatactgagtgcctataggggactcacagactgcagatgcatgctgcggatccagaagccggtcagcgcacacaaccaagcttaggagccgactgttaagatgccccagtgacacggacaagtttctcctctgcaacccaatgagagctgtgaccacgagagcatcgcgggaccgcaaaggattctggaaaatgtggtcccgggtggccagtgtgcgctgacttcactgaaggnacggttgaaggaaacttctggagggtggggtggtgttgaagagaaggcacaattgtcaccattttgttcaacatgggcgttttctttgtgcagtgattacgcattggtaaagattcata

SEQ ID NO: 589002 - DNA, 1116 bp, Homo sapiens
  misc_feature (353)..(353): n is a, c, g, or t
  misc_feature (964)..(964): n is a, c, g, or t
tgcccaggatcgctggtcccctacatgcccaacggctgttgatgcatggccagtgaggctgtatacaaactcgctgaatcatagatcttctttgcgggaaaaaggtggcaggtgccctacagaccatatgagatcctccctggctcagatacaagtctcacccagcatctgtgtgcggcttcaacgggggcaaagagctgacacgtggctcctcgcgtggcatccattctataccagtgacagtctggtggcacgagggaaagttatcgctgaatggtctccatgatcgccgcgctccaagattcctggtaataatctcgctagggcagtctaccgcctctatccactgaagncctgagaaacaatggtattcctacaaggggaaccacttatcacaggaccgcgtagtcattcgttgccatgagtagttcgggataccgcgctagagggtgggctatagcagctcgaatatgcaatggggccccttgcgagtagaaaactcttgggataggagctagcggggacaccctcgcgcaaggccttgggcagcggcattgtcccattattggggcctaacctctggctcggggaacattgaccccctttacatcccattgttaagacgctacattgctcgccctttttccatggccgccccgtacgttgaaccactaggagctttgggcccccggctaatttcaattgacgggccaattcgagagcgcgcaatcttgtccttgagaaccttggggacccttacgcatgaaggaaccattcgttgggggaaacttctgtcctttggcaagtgcgaaggacgttagtttctgaggtcccccagttagctttggttaattacacattaggttaattagaaacgccggaaggggcattaacgacagcgaatttccaacctttgcggagggacaagattcacgggggaaggaaaatatttagcgcggttggnccggcggaaaaacccgcccggtgtcaccccattgggagaagcgcttggccccttgtgaaggcccgcgagcggtgtatgggacacaagccccgtccatgcatattacccgggtacgcaatcggctttaatcccttacccttggtgaagaaacc

SEQ ID NO: 589003 - DNA, 215 bp, Homo sapiens
tggagacgggttctgggtcggtcacccaagggggagtgcagtagcaccatcatagctcacggcagcctccaagtcccaggctcaggcaatcttcccacctcagcctcccaagtagcggggagaacgggcacttgtcaccacaactagctaattttttattttttcatagagacggggtcatagttttgtggcccaagcgggtcttgaactccgga

SEQ ID NO: 589004 - DNA, 196 bp, Homo sapiens
atgcagataaggagtgataccccggaggagccacaatccagtcattccacccacgtcactgaagtccacgatacaaagggtgtctacttacagctggacttaaggcgtttccgctgtttgtgtaagtgctatgacgttattctctattgtggtgaggatgcccttttccatcatggccaaaagttactagcaactg

SEQ ID NO: 589005 - DNA, 716 bp, Homo sapiens
ggccggggataagcactggaagctttttctggggataggaattctgctgctcctgttcatagagatactgggggagccctggattaggttaaccatcaaggccaacagtaagccctgacgtgacggccttcggtcagagatggagagacgcaatggcacccatctgctgcaacaagagctgaccgaggcccagaagggctatcaggatgtggaggaccaggccgacacctgcaaccacactgagatggacctaacgggttacctggatgcatagaaggcccaggcacaaaggaaagtgaaggagcttgaggcagagatcactacattaagccataagcttcaggacgcgtgtgcatgaggcggagcgactgagatgagccagggcttaagcgtgagaatcgtgcacataaagtactacaccagatcctaggactacaggtccgatgcggagccccagctgatgattgcgctgctgtaccttagcggttttgctgaatggggatcccaggacgctggaacattttggaaggtccggcccgatcgcgtttttcgcttgcacactcccattggtctcattaagttgtgatcggcccaaggtggcatcaacctttgacgcacttagttcgtgcttaacccgcagaaggttcccgggtagcaaacttggaggcatcctggaggccccgcgtttctgcgcaccaccttggcacctccgcgcg

SEQ ID NO: 589006 - DNA, 311 bp, Homo sapiens
  misc_feature (28)..(28): n is a, c, g, or t
  misc_feature (53)..(53): n is a, c, g, or t
  misc_feature (61)..(61): n is a, c, g, or t
  misc_feature (70)..(70): n is a, c, g, or t
  misc_feature (140)..(140): n is a, c, g, or t
  misc_feature (149)..(149): n is a, c, g, or t
  misc_feature (252)..(252): n is a, c, g, or t
  misc_feature (283)..(283): n is a, c, g, or t
gtggatcacctgaggtcaggagttcganaccagcctggccaacatggcaaaantccttctntactaaaantaaaaaatttagccaggtgtggtggtgggtgcctgtaatcccagctactcgggaggccgaggcaggagantcacttgancctgggaggcagaggttgcagtgagctgagatcccactgttgtactccagcctaagcaagaagagcaaaactccatctcaaaaaacaaacaagcaaacaacancaagaaattagccgggcatggcttgcatgtncctggagtcctagctacttcgggaggat

SEQ ID NO: 589007 - DNA, 584 bp, Homo sapiens
accccaactgatgcctgctgcagacttcctgcagctcatttacaatacagagggatgcagaggaaatgtttcttaggaggcagatgacaggaaatgttttgacttttggaaagaagggatgaaggaggtacaaggaaagagaaaagcagccaactggcacatacttacattggtcaggggggcatgtgcaaacatagaaaatccttcaaagatatactcgtgatcatcgtattctataacagttggcctgtcagttaaaaagttcgtaggcggggagactgtgatccggtagtggaaaagtctgccagcattgtaggtcataggacgacagggcttgatggcctgaggggaaaaaaacgaaaatcagtttacaagtaaagcaagagtacttttacttaaaaatatattgtatttcctagattcacatctaacaaaacaggttatatgtctgttccttcacagactggtaggaaagaacagtattggctttgccatacctagaccaataaaaaagggctggccagtctccagctctcagccgcttcctcaggtgctggtgaagcaaggatgaccaataaggccgc

SEQ ID NO: 589008 - DNA, 520 bp, Homo sapiens
  misc_feature (489)..(489): n is a, c, g, or t
ttgggtaggctttcttaagggagccctcccctaaggtagaatggtgctccctgaagaagaataacagtcttagtttttgcccaggattgagaagtttccctgaacatgggactttgagtgttaaaactgtgccagccatgggaaatttgggcaagttcactcttaagcatggaccttgcccctgtcaatcacatggaaaaaactttggaaagactaaaccaacaagaggtcaggtgtggcagctcacacctgtactctcagcactttggaagtccagggcgggaggataggttaagtccaggagtttgagaccagcctgggcaacatagtgagaacctgtctctaaaaaacaaaaaaatttttttaattagcagggagtggtggcatacactggcaatcccagatgttcaggaggctggggcaggagctcacctgagcccaggaggtcgagtctgcagtgtgtcatgatcacaccactgtactccagtntgggcaacagagacagtgaaaccctgcctca

SEQ ID NO: 589009 - DNA, 1368 bp, Homo sapiens
agcggaagaaatcaagacaccaggcagcaggacacacacacactcacatacagcacacacacagaaaaaccagggcaaaagacaagcaaccgaggaaaccgagaaaaactagacgatcaagacgagaaggaaacaaagacaaagcacaaagatgagacatgatgacaaaagatggaagtctgactgagcgttgaggagtcgaagaagactagagacagaaagcgtgcagggagtacgaagaggaggaggaacggaggacgcgattaggtcactgatgctgaaggggacgagaacttaaatggatagatattaataaacgcaatcgaagaagaaattaggatactagagaaacaatgagaaatgaataactcggtaagccgagcaatatctgaacgatactttgaaggataactaggcctaggattacaaatggatgacatgagagagatgctaagatagtgaaaaaccagatttgaaagggctttatgtattgagggcagaagaatctcagagagaaaagaagggtggaggattgagatcgtgagaaagacagattatcgaaatcctgaagtcgaagcaatcggatcgatggcaaatagctaaagtttgcaaaaaaataagagagaaaaaatgggccagataaaagaatccgcccgcgggaacgaaaacttcaaagatgaaaccacccgagctcgagcgaagacaatctctataccagctattaaatcaaacgggggcaacacacaaatcagataagaaggagagacagcactcgcaagcaggccggggcgcaccttggacatggccaagatcaagatacacaaaggggcacgatagcaagtaacaacgcagacaagcatccgtcaagcacgcggacgccgaaaacgcggggattgcccaaatcttgaagaaagcgagcgccaggggggaacgggcgcgggacactcgaatcgaccgcgatgacagacttgggaacccaaatccaacccaaccgaaaccattctaacccggacttccaatgctacgcatgtgggaggaaaattcatcgaactgggcacaaagtgaccgggaggcccaagggacggcttactcctaaggtcaaggaaacctcgccgacctaaccgggtaagaacccaatgttctcaggaatagtttgtctcgcggctatcgattgaattgaagatgcccggggaagaagaagacgcgtgggtggccacaactggattcggcaaacctgatttatttgccgaaaattggcgatcttggcgtcttcgcggaagagagtgggagcaccgaccccgggagagaaagcaccgagagaatcgggagagtccatttagaaccgcgcagaggacactcgtcgcgctt

SEQ ID NO: 589010 - DNA, 595 bp, Homo sapiens
  misc_feature (16)..(16): n is a, c, g, or t
  misc_feature (22)..(22): n is a, c, g, or t
acacatgtagtgtgantccgtntatatgaatggtccagaacaggcaaatctatacagacaaaaagtagattcgtggttgcctagagctgagggtgagggtggaatgggagtgactgctaatgggtatggggtttctttttagggtaataaaaatgaattagattgtggcgatgattatacaactctgtgactacactaaaaatcactgagaattacacgctttaaatgggtgatactagaattatatctcaataaagctgttttcaaaaaataacaaaatctaatttcctggcattacccacctgtagcgcatggagtgctcatgtgcgttcaggatattaagttgttggtggaagcatactacaggaagttagtagtttcctcacaaaaaggactcagtaactcatgcctcttgctttttgcccttgctcatcttcctatctggaacaagctctaggcccttggggtccctaagaaccacagcatgctaaagacggcagagcagcaaacaggaggagactggcaatggatgacaccctgggatcactgcattagcattggtttatctctctctggagctgtcatgcgagaaaac

SEQ ID NO: 589011 - DNA, 1542 bp, Homo sapiens
  misc_feature (170)..(170): n is a, c, g, or t
  misc_feature (380)..(380): n is a, c, g, or t
taaaaaaaaagagtttatttaaaaagtatcatagggtaaacaaacaattggtcccccttggattttctgggaattacaagaactctcggtgagtgcaaagctgtgaagttgtggtgtgtgttcaccaagaactctctttgacaggtgtggtgctttctctcttagggagnggtgtggagtttttttaaaaaaaagaaattactcgtggtgacaccatcagcggtgatttccatctaaagaattctccttttagaggccagagaggcggtggcgtccgagaagtgcggtgcgtgtgtatactctctctctgtgcctctctcagacacagagaacagagataaatagagtgtggtctctgtgtgtgttctctctcagagaantctcctatacaccaccgcagtgttcactgtgtgggccgcacagtatatctctcacacattctcccccttgggcgctgtaatgctgggaagtggtgtggtgtgtacacaaagtgtgtgtgtgagatgtgtcaaacacgtgtggggtctatatctatgtcggagaagtataagcctcggagtgcggtaaaaagggtagcaaaagcaacgctatatatctatatctcttcatagaaagcgcctaataaagcacgcgtgtgtgatgtgtggtgctctatattttcccaccagaggggaggagccaataagacaggggtgtgcttatacatctcccgccagagggggacccaggcgatttagagatgtttcaggagggacacacaccgggcggcggtatactcacacaaaagtcgtgtggcgcccacagaggcgcgtgtggccaacacagctcacaaggggggcgcctcaagaaagaccagagccccccccatatggggcgacttattcttggggcctctgagagggtccctttgaggagataatccccaaatattgtggcgtttacccccaaaattatctgctcaaatataacctatttgcgacacaacaggggctgcccgcaacccctctcccgtttgggaaaacggctgatgtaaccacaagaggcttattttaaggccaaagagggctcttcctttaaaaaaagagggggcgacccatcactcgtggggaggaagacgacgcgcgaggatacacttctcaggaaaaaacctttcgttgaagaaaaacctttcttaaggtctaaggggggcgccccttatcacaaagacaagggggggcgttagcaaagagaaggaccttcccccgtggtgggataaacccccagggggccggggtgcacaaagaagcccccctggtctctgaggctgtctttggttggcaccccccccagggggtgaacccaaccatcacacacacgttggggcaatctctaccccaaccgaggaggcttcccaagtgagacgaacacacaccgtggagacaaattggaacgcctccgagcgaagcaatattctacccatggagctcaaccaccttactacaaaggggggaacggaacctccaccaagagcgtacatctggtgcggcgcaccagcgacgactg

SEQ ID NO: 589012 - DNA, 209 bp, Homo sapiens
tactgtggtgtaccgtccattgccgtctgggcagtgctgatataggtctgggctgaactcagatatgacatggaagcattatgaatgcaatagcaattcagtcatagcaccgaggctgtggaaattttgccacgagttgttcaggattcattattgggcagagtcgtatgttgaatatatcagtgaatttttgtgtaatttgaaatacc

SEQ ID NO: 589013 - DNA, 900 bp, Homo sapiens
gcaggtggatcacgaggtcaggagatcaagaccaacctggctaacacggtgaaaccccgcctctactaaaaatacaaaaaaaattagccaggtgtggtggcgggcgcctgtagtcccaggtacttgggaggctgaggcaggagaatggcaagaacccgggagacagagcttgcagcgagctgaggacatgccactgcactccagcctgggcgacagagcgagactccgtctcaaaaaaaaaaaaaaaaaaggacctctattttccaccaaggcctaatccttcccagaaaattttcctcaaatcatttctaaacttttttggaaaattcacgggcgcttgggccaagggcgggtacaagctaataatcggagccttggggaagctgaggcgggggggtatcaccaggggtcgggagtcaagacaagcctgcccagtgatgggtcaaaccccggtctctcactaaaactcacaaaattggagggcgggaccatggtgcggcattgcgggaaccccaagtaactccagaggctgcggaaaagcaattgtttgagcaggaaggggggaggtcgcgtggacagattcacgcaatggactccagcggggcgacagagcaagactttcctaacacaagacaaacagcaggatacccgggccgggggggcccactggcgcgtttcatcgggtcaacccggtcaggattcgggcctccacccagggtctggctaacaaaaacaaaaaggggtgcgcgcggcgaagttaaacatctgggcggcaagtgaacggaaggtcagaaccgccgaggcgcccaaagcggcacgggtaccgcgggcggcagcccccgcgccgcgggagagcgcccacgacggaagacagagaacacacgcacacaccacggaaat

SEQ ID NO: 589014 - DNA, 416 bp, Homo sapiens
  misc_feature (25)..(25): n is a, c, g, or t
  misc_feature (40)..(40): n is a, c, g, or t
  misc_feature (67)..(67): n is a, c, g, or t
  misc_feature (99)..(99): n is a, c, g, or t
  misc_feature (110)..(110): n is a, c, g, or t
  misc_feature (116)..(116): n is a, c, g, or t
  misc_feature (134)..(134): n is a, c, g, or t
  misc_feature (146)..(146): n is a, c, g, or t
  misc_feature (179)..(179): n is a, c, g, or t
  misc_feature (182)..(182): n is a, c, g, or t
  misc_feature (189)..(189): n is a, c, g, or t
  misc_feature (193)..(193): n is a, c, g, or t
  misc_feature (195)..(197): n is a, c, g, or t
  misc_feature (207)..(207): n is a, c, g, or t
  misc_feature (210)..(211): n is a, c, g, or t
  misc_feature (213)..(213): n is a, c, g, or t
  misc_feature (215)..(215): n is a, c, g, or t
  misc_feature (217)..(217): n is a, c, g, or t
  misc_feature (233)..(234): n is a, c, g, or t
  misc_feature (236)..(236): n is a, c, g, or t
  misc_feature (241)..(242): n is a, c, g, or t
  misc_feature (254)..(254): n is a, c, g, or t
  misc_feature (257)..(257): n is a, c, g, or t
  misc_feature (259)..(259): n is a, c, g, or t
  misc_feature (282)..(282): n is a, c, g, or t
  misc_feature (297)..(298): n is a, c, g, or t
  misc_feature (303)..(303): n is a, c, g, or t
  misc_feature (310)..(310): n is a, c, g, or t
  misc_feature (316)..(317): n is a, c, g, or t
  misc_feature (323)..(323): n is a, c, g, or t
  misc_feature (339)..(339): n is a, c, g, or t
  misc_feature (353)..(353): n is a, c, g, or t
  misc_feature (360)..(360): n is a, c, g, or t
  misc_feature (363)..(363): n is a, c, g, or t
  misc_feature (375)..(375): n is a, c, g, or t
  misc_feature (377)..(377): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (395)..(396): n is a, c, g, or t
  misc_feature (399)..(399): n is a, c, g, or t
  misc_feature (405)..(406): n is a, c, g, or t
  misc_feature (408)..(408): n is a, c, g, or t
cccgcccccagagtctggctttccncggctgcccgcctcncgcgtcttccctgcccgggtctcctcnctgtcgccgccgctgccacaccatggccttcntcaccaggcanttcatncgtcccgtgtcctcctcntccaccgcctcngcctcggccaagaagataatcgtcaagcacgtnacngtcatcngcgncnnnctgatgggcnccnncntntntccctaggttgctgcnncnactcnncacacagtagtnttngnacaccacacacacgacatcctgncaaaatccaaaaacnnaattnacgaaanccttannaaagtngcaaacaagaagtttncacaaaaccctaangccggcnacnaatttgtggagnanaccctgnccaccncancnnccngcaccnncnccccctcc

SEQ ID NO: 589015 - DNA, 313 bp, Homo sapiens
  misc_feature (28)..(28): n is a, c, g, or t
gaaagacagttgataaataacccatctntgaccatgcattgtttaatgatggggatacattctgagaaatgtgtcattacgcagtttcatcgttgtggaaacatctagagtgtacttgtatagcctaccacacttctagactatctggtatagcctattactcctaggctacaaacctgtacagcatgtgactgtactgaaaactgtaggcagttttaacacaatggtatttgtgtatctaaacatagaaaagggacagtaaaaacatggtataaaagatggataaaatggtacacctgtattagggcactta

SEQ ID NO: 589016 - DNA, 132 bp, Homo sapiens
atccagttctcagcatgtccctctcctcatgagattggtgaagaaagtatttggcaaagtccttcaaagccacatcatcgcggtcaaagtatctggcggttgatggcggcctctgagtcctggtggtatcag

SEQ ID NO: 589017 - DNA, 675 bp, Homo sapiens
gcttcccgagctggcggggtccgtggtgcgcggatcgacgattgcgggctatggcgcctgcacaggttctttcgtcagatacatgggatatccccgattggtcatccgattgccaccgtcaagagtcctatcagcagccaaccagtatttgctcatgcggtcgctgcgactgttagccgaccgcatgcctacagagtctaacactacaaatcactccgggacatccttccttgaagtgagtgggctaacggttaggagcaactatcaccgttcaacttgcatgcttgccttgtctgggggccccgttcgttggggggctcatcaagctgtcgtcatgcgcccatgtcgcgcgaagaagcccgatcgagtcccctgagacgtactgtgcctcggtggctgagccaggagggcttgtaggtctgtgtgcagtctcgtcatcggctacgaactacgtggattggcgccgccgcctgcgtgtactcttggcatagcggtctccctggctcacgcatgggccggctggaggtgctggggacggtgtttgctggacccaaggtgtgagccctgttgcttgccggggtccttccagacctgcctgaatggcggtccagaaaataagcccctgttgtcctgtgacgcaaaatgggagccaacaaccttgaagtcgcaaatgtg

SEQ ID NO: 589018 - DNA, 551 bp, Homo sapiens
gacttcctccgcggtcctcggagccgctcgacctcttcagggacttgctgagaagggctctcgggcgtccagacccacgaaaggtgtgtgggatccgccgagaagttgttggccccaggagcatccctcggggccgaatgcgcagtgacgattgccccttctgacccaacagatccaagacgaggatgatcagtacagcctttgtggccagccttgacaacgtaaggaatctctccactatctgtgaaagctattcatttcggagaactatgccagcgtgttccgcaagtaaaaatggtatcaacgtaacagtggaaaattgcaacgtgtgtgccaagcaaatgcttttatcaggctgaattatttcagggagtctaaaggttccaggacgagtctgtcactttgcgaaattaatttaactgtccttttagagtgttatctatttgtgatcaggtcctatgccagggacttttaaagtgcacttcgatgtgtgttaccaagggtaatgggttacccttggatgctgttcctggaagaaggaggagtggtga

SEQ ID NO: 589019 - DNA, 237 bp, Homo sapiens
ctagaggatcttcgtacgaatcatcatgcattcggacaggaaagctcatgtgttaagaaattttttaaaaatcaggatacaggagttcccgttgtggtgcggtgggttaagagtctggcgtgtctttgtggcagtgcaggtttgatccccagcctgacacagtggattaatgatccagcaatgccgcagctgtggtgtaggtcacagctgtggcttggattcagtatagtaattcgg

SEQ ID NO: 589020 - DNA, 603 bp, Homo sapiens
ggagcaccaactcttttgtcgtgcattaaatatgtcacacacgcgggtgttgataaataatactgttgctcttcttgccgttcacacagacctgctctctctctaggtgcgcatcctcccgctggggcgatcatctcttttattcttaactgaaggctgagggggctttcatttccatgtctgctgatgctcgcgttgtgaaacgcggcctcgttatagttgttacctcttcggctccagcctccgtcctgcctccgccgcttcactctacaaaattgttgcgccgcggctgctctctttctatagtaatagagttgtggtggatatatagagcccgcgctcgtcgtgatatatatatatagcgggcgataatatattttggttgagattcgcgctctcttagtggtgttgtctcttctagtatatgacagccctctctttatttcaggtaggggcagagcagcgtgttgtgcagcggaagacaagtggtgacacacgcacttatttttttgcgtggcgcgcctttgatacgccgcttttataatatgttgttacatgatgttggtgtgtctatcgaccacacaacaattgatacaagaaatc

SEQ ID NO: 589021 - DNA, 91 bp, Homo sapiens
agaacaagcgcctgacgaaaggtggcaagaagggagctaagaagaaagtggtcgatccattttctaagaaagactggtacgatgtgaaagc

SEQ ID NO: 589022 - DNA, 223 bp, Homo sapiens
ctatcaaggtccgtgtggttcttgcagaaggaggatgacacacacacggtgtagaacacaccacacacacacacacacacacaccacacacacacactcaaacaatgcacttccctgaaagcgacacaacttcaggccgtggtgaagaatcaacaacttcccacagcagcacaacacacacaatatcttcagcttctagcaccacatctgcaaggaacccagg

SEQ ID NO: 589023 - DNA, 821 bp, Homo sapiens
ggcacaatgacagcaagaggcttcctggtgtgggtgaacgaggaggatcagctccgggtcatctccatggagaaggggggcaacatgaaggagggttttccgccgcttctgcgtagggctgcagaacgcattgagggagatctttaagaagagctggcacaccccttcatgtggaaccagacaagcctgggctacgctgctcacctgccgcatccatagcgtgggcacgggtgcgtgcgtggaggcgtgctatgtgaagctgtgcgctacctgtagcagagctaccccaagttcgaggagatcctcacccgcctgcgtcggcagcaagaggggtacaggtggcgtggagactagctgccgtggggtcagtatttgacgtgtcggaattgactgatcggctgggcttcgtccgaagtagaacaggtgcagctggtgggggatggtgtgaagctcatggtggaattggtgaagaagttggagagaaggccagatccatggacgtacctgttccccgctgagagtaggcgcctggccattgtcgcgtaatgctggaacccagctagggacgggccagtacctaaagagtcctggtcctcataaccgaggcaccgcaccatgtgacgtagtccgacgggtcgagtacgcaccgtctggaagagcagtccaaggaaaatcggtcacgggctaaacctcggatccgtcacagagaatgcccgcaagcctttgctaccgaggcaccaaaggatcacaggggaccagaacagaggggtggcacaggaaaactggggcaacaaaaaccgtgccagcaagcacagggggca

SEQ ID NO: 589024 - DNA, 194 bp, Homo sapiens
cctcggaatacaccggacagagacagcacatatatgcaacagagccaaatatatatgcttcttcactgcagcatagttagtaatagcaaaagactggaaacggtgtactgtctatcagtgtaacggtacggtgccaagtatctttacttgctgatcgggacgtaacagtcacacaagaggtataaaaatggccg

SEQ ID NO: 589025 - DNA, 139 bp, Homo sapiens
tgatgttattaaaaatctgttctggtttgaatttggagagtctgagatcaaagaaagcgtactggttttttgagcatcacacaatatcccattgtaataaacctgcacatgtactccctggaccttaattaagaattga

SEQ ID NO: 589026 - DNA, 590 bp, Homo sapiens
  misc_feature (66)..(66): n is a, c, g, or t
  misc_feature (255)..(255): n is a, c, g, or t
  misc_feature (257)..(258): n is a, c, g, or t
  misc_feature (583)..(583): n is a, c, g, or t
tcccccacttaaaaaagaacccccccccccccctttttttttcccaaaaaaaaaatacccccgganttttttttggtcctcccccccccccaaaataaaccaaaagggggtgggtgtttttcatcttaagaaggaatgttttttttcacaaaaaaaaaagtttcttcctggggaaaaacccccccaaaaaactccctccccccacaaaaggttttcccccccggggtggggggagttttttcaataaaaacctcntnnaaacccccccccccacaaaagggtgggtttgtttttttatttctccgcccacacagaaaaaatttcttttcccacccccccccccccaataaatcccccccgaggttttttcgttggaaaaccccaaaaaaaaggtttttttttcccccggggcaaaaaagaggccctcttttgtggggccattaaaccccccccaattgggtgtttttcccccgggcccccccctttaaaaaaagggcttttttgccccattttcccccttccccattttccctcagggcattggggttttaaggtccaaggcctcaggtttgcccctttatanggaaggt

SEQ ID NO: 589027 - DNA, 1021 bp, Homo sapiens
tgtgacccagaatggtacgctggccttacatagttcaacggatctcgagcgtgaatccttgtgactcgcgttggtggtgattgccacgatctgtcaatataatagtctggagcctcacttacatgtcgaacgaatacacagtgttcttgaaagactggaaggaacgataacgaggaaaggctgacattccctgtgatgtggtatgatcttgagcggagagggttggcagaatgttggttactgaaggtatcatcactgggaccgtttttctcgactcatggcgcgggccaagacacacataaacaattgcgcactcttgacttgaaccagaccgagctcagagcgagaacatgctcccgagaggatcttctaatggaatgtgctgcgacagaagtgacgactaagatgtctttggccagaccctacaaggacctgttgagtgctgtgtgttgtgatctgtgagagcggctcttgcagagtactgacgtaggcaaaatctgcaatcaagatgtccttgtgcctcgaaacgcgacaagagtagtccatgggtgtctcagctcgctgggtttcatgcagacacgatagttctcctgccatgaacactgttcagttctgtctctaacatctcgtccttggtgactgtattgatggatggtaacctacgggcggtgaggggtggttaaccccccatgttcaggtgtgtcccgtgtaccccccacaaaccaacaagtttggtcttctatctccacaacgtgagcctggaagaggagaaaaatgtggctcctcttggagcttggacagaccacttgggtccggtcttggcgtgaatgtccctttagcccaaagacggtgaagacacgggctgaaatcaggtggttctgcaccctgaggccttaaacccatggggtggctaatcccactggacttgtgacagcactataataattccataattatttgggagaatgagggacctggggtggcgtagttggctggtgggaactgccggggttgggttggc

SEQ ID NO: 589028 - DNA, 155 bp, Homo sapiens
  misc_feature (91)..(91): n is a, c, g, or t
gaatgtcgaaacgctttaggcagtcctcacaccttactacacataagataattcatactggagagaaaccctacaaatgtgaagaatgtgnaaagctttctaccgattcatttaccttactacacataagagaattcacactggagagaaaccct

SEQ ID NO: 589029 - DNA, 133 bp, Homo sapiens
tcacgccatgtccacaatggggcgggcatggaggcagcctcccgacgtcttcacggtcaggatgaggtgccggagatgacgttaagcagcctgacagctctcaattgtgtaggagtgttgagaaagcgtccgc

SEQ ID NO: 589030 - DNA, 283 bp, Homo sapiens
  misc_feature (129)..(129): n is a, c, g, or t
tcgggggcgagtgggcagctggcgggtctggccgctcgcttcggaggcagtgaactggcaccgcgcctcgcgcccgcccagccgagggctccaacccgatccggaccacgtcccggctgccctccgaanccggcagtccgcgcaggaatcctctgccttcccggggccttcacagatcctcccccgggccggcagttcacgaattccaggaacttactagagcctgggaagcccgggaagcgcctcccgccaggccgcctcccccaacccaactccgcggact

SEQ ID NO: 589031 - DNA, 156 bp, Homo sapiens
cccaacctcaggtgatctgcccaccttgggatttgcctcccaaagtgttgggattataggcgtgacacgttacggcgcagcctaacaaattctaaaagagctgtaacactgacagtctcttcatggtcccagttaggccaaagggacttctgctct

SEQ ID NO: 589032 - DNA, 321 bp, Homo sapiens
tttaggtatagctctaagactcctgatccatacttttattaactggctttcgtaggctgtgggcttgaactaagtacagaagcctaggagttcatatctagactgcagagaagtaagtctcattctaaaacattgcaactactgttagagtctaccccatgaagctgtttctgattgtgtatctttgactgaattctatgagtatatgttgttcagactatatacaaatgttgctagctaggttggctgtgctgtctcagtacgacgttgtgactagccagatcttcctctggagaccttggacctaagtgccacatgcat

SEQ ID NO: 589033 - DNA, 297 bp, Homo sapiens
  misc_feature (52)..(52): n is a, c, g, or t
  misc_feature (99)..(100): n is a, c, g, or t
  misc_feature (109)..(109): n is a, c, g, or t
  misc_feature (226)..(226): n is a, c, g, or t
  misc_feature (267)..(267): n is a, c, g, or t
  misc_feature (270)..(270): n is a, c, g, or t
ttttgaccaagttgtttccattaaaaagtactgattttaaaactaataactnaaaacgccacacgcaaaaaagaaaaccaaagtggtccacaaaacatnnttttcgttnctgaaggttttcgatgcattgttatattacctcttttactactaaactggacggccaatgaaacaaacagttctgagaccgttcttccaccatgattaagagtgaggggcaggtatnagggataatatctaaaccttttgagctctctgggcagactngtngaccttgtcagctccagcagcctcttg

SEQ ID NO: 589034 - DNA, 170 bp, Homo sapiens
  misc_feature (4)..(5): n is a, c, g, or t
  misc_feature (125)..(125): n is a, c, g, or t
  misc_feature (129)..(129): n is a, c, g, or t
ccgnngggacaggataactgttacgcatatatgacttgaacaacctgaagcgaacctaaggaaattagtggtcatacttcttggtataaaaaaaagctctgtggtgcagtgaggattaacagatncttnctgctgatgacaaaactgtacgacttggagatcatgctact

SEQ ID NO: 589035 - DNA, 249 bp, Homo sapiens
ttcagctcggtacccctaattggttcttcgatgacggcaccacttactgaaaatacttttctctattgtatattcttgcctccattgtcatagattaattgaccataggttcatggatttatttctgggctttctatcctatttcactgtttttgtgctaataccatactgtcttgatgactgtagctttgtagtgtagttagaacgtcatcgaagaaccaattaggggtacgagctcggttgtccaag

SEQ ID NO: 589036 - DNA, 473 bp, Homo sapiens
gcacgagcgcatgagctgtgcaactatgtgaacacacggggtaccacgtgtcaggcgcgcgcacacactttacacacgcggacatgagctatcttgagagagagcgtatagtgggacctttctgtggggggcccaaggcacacccagagaggtatggttaccgaggacctggagctggctggaaggtttgatagcgcgggaaccatgggcacagtgtgccaccattgagagcagagaccaagggttctgggggttctggtgggcctttggggctgtggaaggcatttctgagcggatctggattcacaccaatgggcacgtgaacgtggaagtgttcgcggaggagctcggtacacagctgtggcagcatgtgtggggaccggtgtgatggtgggtattccggtgaagcttggaacttttggacaagctccattccttcctgtgagcgccacattacggggttccgggccccg

SEQ ID NO: 589037 - DNA, 375 bp, Homo sapiens
  misc_feature (259)..(259): n is a, c, g, or t
agaagcagagtttacagtgagttgagattgtggcactgctactccagtctgggtgacagagtaagactctgtctcataaaaaaaaaaaaaaaaaaaaaaagcaagaaacaatggggcaggtaccagccagggtttcctgaatctcaactaaaaaggctgtagtctcatcagctaatctgggtctctatatgttaatgtaagaaccatattattttcccttaacatctacactcaagactagacaaaaaataattcaggngttatgaacctacagttattcaagacagcatgtggtacgggcattaagtacagacatttagataaacgggaaaaaagctgagagtccagaattaaacccacacgcttaaagtcagg

SEQ ID NO: 589038 - DNA, 905 bp, Homo sapiens
agtgtatagtacaaatgtaattaggcattgcctcctggcgaggttcttgatgcatgacttcgatgctggctgctgactgaggtgaccactgtcagtattgtactttggcatatgttgtttttaggaaaataatggaatgccattccttagattaacttactgtttttgagttggcacaaacccatacaaagcatgcagggtattatcaagatatgcccaaatatttatacccctacaaaaggattacagaaaaggcagcagggccgaaacacaaaacaggccagttatgcattttcaatcagcgtctaatttttttttgcactcggaattttgtggacactagtcaattgcataatttaacatggaggagctttcatttaaaagaagttctcagctactatattctgccattaaaattaaccatgcctgttaatttctacattgcttgacgatactcgtcagctgccgtcaatattgtctcaagattttcttatagtttatgtttaaatggaaacagttacatatataatctatggtgcagggtcaggcattggccattaaagatcaagtttgatctaacttattttactgacagagactaatggtataccctctgtaagtactgacttattgtttcttggatctgtagtttacccccgaatgtaaccaggtcctacggttgaagtttccttaacgtccttcccatattctaaatggacatttggttaaaggcattcacaatctttgggacattcctattacctgtaaaagggctattttaccacaatagaagtgatgtggataatcgaatgtcaagcggcgtaaggaaagcgagagaagagaaaccaccgatgttacaagtgacggcagcagacgaatggacttgaccttgtcaaaatcgtcac

SEQ ID NO: 589039 - DNA, 281 bp, Homo sapiens
gcaggagaatggtgtgaacccgggaggcggggcttgcagtgagctgagatcgtgccactgcactccagcctgggtgacaagaacaagactccgtctcaaaaaaaaaaaaaaaggggaggggttccttaaaaaaaaattttaacccttgccccaaaggggaatttgggttttccttgggaagggggggaaccagggcccagccacacagccccttccaagccgggaaagccttgtggggaaccttttagagtcaccttgcggccttccaagttggccattgc

SEQ ID NO: 589040 - DNA, 271 bp, Homo sapiens
  misc_feature (49)..(49): n is a, c, g, or t
gtatcccagcctattatgtggaagaatcctaaatctgtgatgatcctgnccagacaattcaaccaaaatcagataagcagatgagcaacgcctcctgcgaacagtcaccttgtcactcaagggcggtgtctctgtgtggtcatgcctgacgtcgccgaatgtgccacacgttttctctgtactatggccgtgagacagctgagaagcatgcttaatagagagtgtatgtgtcagatcattggctgctcatatcaaactccacatggcaggg

SEQ ID NO: 589041 - DNA, 325 bp, Homo sapiens
  misc_feature (9)..(9): n is a, c, g, or t
  misc_feature (138)..(138): n is a, c, g, or t
  misc_feature (218)..(218): n is a, c, g, or t
ggcccccgntggatgagtccagaagcttctgacaatagtagatacacgggatggatagaggggtttccgaccaccactactactactacggaaaagccacactgtggcttctattctcctcacacatattatcccccnggtttggactccccttctttcatccacgtcagacaacgtggccaatcatactgttgcacgaggttagccaagcagctggnaaaaggctctagaacattagaatgggccttccatatttccttatttggaccactcatcttcacggtacagattgacatggtccaactgccgcttctaaaagcaacaa

SEQ ID NO: 589042 - DNA, 325 bp, Homo sapiens
cagaggctgaatggactgcacttttccctttttgttctgacacctgcacttatcatgtgtatttctagcagagcaagatattattattattattattgagatggagtctcactctgttccccaggctggagtggaatagcgtgatttcggctcactgcaacctccacctctcaggttcaggcgattctcctacctcagcctccctagtagctgggattacaggtgcccaccaccatgcctggataatttttgtatttttagtataacggggttttgtcgtgttagccaggtagtctcaaactcctgtcctcaggtgatccgccca

SEQ ID NO: 589043 - DNA, 1502 bp, Homo sapiens
atttaatgtatatacaccagaaatctatttttcaaagctttttttactgcaaccaatagttgaagattatattttacatatttctgaaacgacacaaggcttaagtagaaataaactgcttgtgaacaactgcttagcttattacttacaaacagtgcctaggaactcaagctggtatcagccaatttctcatatgcacacagacactataggcttgtaatgtaactctcaggaactagtaacttttttactcctagtcgcgggggtctaaacggcaccacgttacgcaacacactcagcacgacgacaagcacgactggccccagcccctctaccagcaactcggcacttcctcacatgcaaaatagcgcctctacaagtcatagagacaccccagacataactacgcctagctcctgttctcctctgtgtctcactctctagcagcgccctactcagcgctactgcgcggcacggcgcataccccacgcgcgacctcactctgccgagccactctctcgacctctctctcactctacaacgcgcccccctgtggctccccttctccgcttactccctcctcgtccctgcctctctccacagctctcctcaccacacctagcttgccgtgcgcgcttcccgcacgtgtgactctcacagtccttacttccacaccactgcgcccgtctctcccagctctcgcctacaaggtcctcttcacccctctctctagctcgccgtgtcctctcctcccccaggctcccctcctactgtgcccccctgggcctttcacaccgtcattgtggctaccctgtctgtctcccacactcaccaacaggcacaccaccgtcgctttccctaatcgcactcactccgcctcacctcctctcacgggcctcaatcgtacgccctacttgggagcgtggccaccacactccggctccctcattggcccttttcttatccccctctcctcccactttcgtcggcctgggctcctcctaatcgccacactccttctggtccctctgcgaccccttttatccacgcaggcgctcccctttccccatcggctcgcctggttacctcacctcttagttccaaccgcgcctcccgtgttctccaacccttccccgtttaccctattcacgctctgcctcttccccgcgctatatccccggtccctcagacggccccccatgcgcccaatttctccaaactcccccgtgtattacaagttttccccttccaccttaacaacccctccctgtactatcactcccgatcgcacaacatgtaacatatatgctcatccgcacactctctctcaccaccgtgcggcggcgacgcaacccacctatatagcagcacacagcctcttaccaattgcacacacccgcgcgcactaaacatcgtagttatactttcacacaatcggcgtccctgatcagcaacccctttatatttgacaagggcacctctaagacccgacagtattacac

SEQ ID NO: 589044 - DNA, 222 bp, Homo sapiens
ccggatcatgatttgtatttttgtgtggagctctaaggatgagtaagatgctggataacaatgatatgcctatgggcctatccttttcctttgcttaggagacacattccactcccatgaagaaaggttcccagcatgaaggtcagagcctgagacgagaaggttggattagaatagtcacgacagcatatatgtcctgtacgagaggtaggacccagtggt

SEQ ID NO: 589045 - DNA, 597 bp, Homo sapiens
  misc_feature (15)..(15): n is a, c, g, or t
  misc_feature (30)..(30): n is a, c, g, or t
  misc_feature (234)..(234): n is a, c, g, or t
  misc_feature (398)..(398): n is a, c, g, or t
gtccgaattcggggnaatgtgacacgcgtncgaccagcgtcccgatgatcaagggatatccagagggtatttgacaagtattaatctgaacctctgggtagcttgaagatgtctgctggtatagtaagtgcatgagaaccatctgcatttttgctgaagctctataatcgatgagggctgggcacgatgatacacctcatcagagtgatgtttctcgacagaaatgacatgtgnatatcgggcacactcaagagactctatgaaagtctctgtctcgtcatcagggtgacacatcggagactcaggaaagtactgctgttctctgtgaggagatgattaaataaaaatccagaaggacagaggattctcacccttgaatttttttacttcatttttcnacactgctattatcattatctcagaatgcttatttcccatttaaacgccctcagctgcctcctagaaaaaaggctggctgtattattattcccctataattagtcattatggtcccttaaagctggacctgcctttccaaggttattagaaattaatggaggtttttaagtaggaattaatatggattccctggtttta

SEQ ID NO: 589046 - DNA, 255 bp, Homo sapiens
tgattctagaggatcccatggaactcccgacgttaagagggagacagacgaatcgcaactgcgcagccacagtagggcccagacagagaatgagggaaaatgactgtaataggcaccaaactcagtgcctgggtctgagaagacagtggatcctgtagcgattattctgttcagctggactgtgataggctatagtccctcagagacacctgccatcctcgataatcacactgcctaaggtgcacatcctagggt

SEQ ID NO: 589047 - DNA, 1660 bp, Homo sapiens
  misc_feature (1)..(1): n is a, c, g, or t
nctttctcttctctctttttttttttctcccctcgcaagcatcgaacgagacgaacgacgaagcacgtgaacgtaagtcagatcatggctcgtgctggttacgcgtcttcatgctagctcagtttacctatcgatacatcgaagatgatgcatcctttctcctccctcttatgaggagatgcctacagtgtgggggacgcctagctgtgttgtcatgcctgcctcctcaacaaagaggaggtcgttctttctagtgaacgcaacatgggtgctgttttccttctgcccgccctgtgtgtgagcagccactctttttctctgctaggggtaccaacccaagaaagtgtttgtctccaccccccctcccggtgtcttccaacaagtgccttctcctgtcagcacacaacaacgtgttgtcagcaccccgtgctccaagagttttcctccaccacaacaaacctggtggttcttcctggagaaagaccttctttgccacacacccacggctcgtgcacagcttagctgggcccaacaacaaagaaaggaactgcttgtggtggccgcccaccccctcctcggcgaaacaatcttgtggtggctctatttgtccacccccgggcggttttttctccacagaaaaaactctgttcccactccgaccctctctttttttgagacgacctgtcacacaaaaaaattcctgtgggtgacaaaagagtgctgtctttctcactcggcagtcttgtttcctgaggggagagttactctctctctgggagagatggggcccctctctcctgggtgttcccccaccactctctcgcacaaccacagtgtctcaccacactgtgtgggtgagacacaccgagctaccccccccgctgtgcttgtgaggaaatacccccgccccccacacatctttgtgtgtgaaaatcccaccacacaaaagagagtgtggttttgaacacacgcgcgcgcctctcgtggggagccaccccccccccctctagggagcgcgctctccctctgtggcgtcacacacctgtgtgacccacccacacgcgcgggcgtctttctctctcttctctgagagtctctctctctcacggtgctctacccccccctctctctctctccacacctctcttgacacacctgctgtgggcggtgtgcgcgtcttttcgtcaccctctcatccgagcagcactctctcttttctccacagaattccactctctctctctcgctgtgtgtagtagacacacacacaaatctttgtgcgatgcacacacacaccaacacacaggtggtgtgtggcacaccactcactatgtgcgcacaccactctgtgcgcgccccaccacagaggtgtatagagacacccctctcggacgcccaccacccccctccaccaagcacacaacaaagtgagaaaaaagaatccctctccactccctctgcggaggtttctctcccccacacacacactcactcttcccccccccacacactcttattcttcctcctccctctcaccacctctctccccaccttaaaaccccctctctataaagggagagggcccttggggacacccccccctttctattgttcccccatcccaataaaaaatcccctcttgtgtctctctcactaaata

SEQ ID NO: 589048 - DNA, 178 bp, Homo sapiens
tacgtggtcatataactagaagtagtgaggcttgggcaggtctatccagcttcaaagttgtttggtgtgggttttgttccccttcatgagttacgaggtttctaatagaaggatttggttaggttagtaatgtagttaaccagctagatttatttgaaggactttaggttttcttttg

SEQ ID NO: 589049 - DNA, 1554 bp, Homo sapiens
  misc_feature (883)..(883): n is a, c, g, or t
aacgcagctggtgtgttgtgtcgtgtcgcggtcgtcgtgtgatatcctcgtggcggtgctcgtcctgcgggggtagttgttgttcgtgctgcggcgcaccgcccgccgcgctgtgtgtgtgttctcccggccgtggggtggtgtttagtgtggtggttgctacccctgccctcccgcgcgcgggtaggtgtgttgtccgtcctccgccgcggtgcggcttcgttggatagttgaggttcgtcgttgtttttccttcgccgcccccggcgcggggtttcctcctctatgttgtttgtttgtggtgggggttcgtgcggctcccgccaccccctcggtccttcgttcggtctggcgggcgccgcatctttgttttgtggtaagtggtgtgtttggttcttggccgtccgcacgactgagtgtgttttgtgggtggcctccgcctcactgtgtggtgtgtggttgatacgctctgttgtgttttgtttttctgtcccgtcccccagtgttgttgtggggtggcgtccgtctgcctgggctggggcggcgcacccgtgttgtttttgtttctgctgcacgacccgtgcgttctgggcgccgtctctttatggtaggagacttgctgcgtcgtgtgtgtgtgttaactacgcatgcgggacgcgcgctctcgtctgtcatgccctcctccgtccggttgttggtcgctgcgccgcttccctctcacacggtatttgtgtcgtcctcctctctctgcactatagtagttgagagcgcggcgtgatgtctctctcgtccgcacacatagtagagagcagctgctgctgcgctgctactctactcctctcgtatgtatctctcgccccactgtgtgtctttactcgcgtgngcgcgtcccccgctctctcgggcgcctcgccactctctcgttcgcgcccagcgagtctctctctctctgtctctctcttcatctatgtgttatgtgtcgtcgcgcgcgagagaatattatatagtctctgtgtgtattctcccgacacacacactctcttttgtgtgcgcgcgctctctctcgcgcgcgagtgcactcccgccgctctctcttctctcgcgcgctctctcccccgcgcgggcgcctctcacaccctccctctctcgtctcacactcttctcttctctctctctctctgtgtggggcgctctctctctctcttttgtttctccgcccccgcgctctctttatatataatatattttctcttagttttgtagtagagacacacactctctctctctctgttgagagcagccataaatattctctctatatatatatagagagagagacacacacaccctctcctccacccgcgcgggtggagaatatatatagagagagagacacacccccccacccctcccccccctcgttggtgaacacccgctcttactcacactaattatttttagacacacacaaaagagagagagagagagagagggcacccccccccccggggttgtttcccaccccccccccgtcctcccctcttttttttctca

SEQ ID NO: 589050 - DNA, 306 bp, Homo sapiens
ggtgttgagcagttcacatctttatgcaactttaaggaggcgcttgatgtcaggctcgatgtttactcgttgggaaggtgcggctgtagcgtcgtgaagggctctccctccggccctatgaggaacttctcacagttccaggcctcatctgagcggcgcacagggactccaatactgatgagcttgtgcgatcggtcctgacggaaaatgtggtcaatcataacggttggggagcttgtccttcaagtaggcgaagacaggatgctcgttctgcccattcacctcacatttttggacaagggtgaa

SEQ ID NO: 589051 - DNA, 667 bp, Homo sapiens
  misc_feature (49)..(49): n is a, c, g, or t
  misc_feature (156)..(156): n is a, c, g, or t
  misc_feature (621)..(621): n is a, c, g, or t
acgagattcatcaatgaagtattgcacatcaggaagtcacacgtgcagngtatgcgggtatgatcgacgtcgcatctgcgacctcttgctatcatcgtacatgtcgtatagatgctactgtacgcatagcagcgcgttagcttagctctgccccanggtgtgtattcctctgtcattccatccttcctggtccaggttaggatgtatagtagaagtcgaggtcttccattcatcacagttctctagtctgagctatggtaggctgtcttctggcccccctcccaatttcagccacagccgttcccaagcaccagcgtggctcctggtgccagtgacctgccaggaggccccttgtgattataaaaccgttcagttggaccgggcgcggtggctcacacctgtaaccccggcactttgggaggccgaggcgggcggatcacgaggtcaggagatcgagaccatcctggctaacatggtgaaaccccatctctactaaaaaacaaaagtgcaaaaagttagcctggcatggtggtgggtgtgtgtagtcccagctacttgggaggctgaggcaggagaatggcgtgaacctgggaggcagagcttgcagtgagctgagatcgntgccactgcactccagcctgggcaatagagtgagactccatctcaa

SEQ ID NO: 589052 - DNA, 314 bp, Homo sapiens
cccggaaatcgcacggagccccggtaatcgcacggagttctatacattaaatatatgcaaatcttttaataatctatgttatacaatgaaaaaatataggattctaatagaaaacccatcaattcagaactgctggacgtttcccatatttggaggataatttttatgtaaataatgtattgatcttgtgaataatgggttatatatcatatttagaaaacaatctctgatggcttcttacagaaccttgtcagtctcatttttatttatgcaagcctaaggtatagaagatgtttatgatgactaacgatttg

SEQ ID NO: 589053 - DNA, 398 bp, Homo sapiens
ggctagtaacaagagctacagctgcaggcctgcaccacagccacagacacgccagatccgagccatgtctgcaacctacaccacagctcacggcaacgctggatccttaacccactaagtgaggccagggatcaaacccgcaacctcatggttccgccgatgggtgccagtgaacccacaaacagccctttgtgcagacagctgtaaaagcagacgactcacctttccttcagagagtcttataagattcaatcacccctaaatggacaaataaatcaatctacaacagaacctggaagaggaagtttgcatgtaatgcattcctcccaactccgagccaagcactgtgcgtgacccatcggcgtgtgacccatcggcgtgtgacccatcggcgtgtg

SEQ ID NO: 589054 - DNA, 108 bp, Homo sapiens
atgagactgcagattccatcatcataaggctccctcttgtagctctttaatagctacatccacttacctcctgcccgcacccgctccattatcctggcaatcaagctt

SEQ ID NO: 589055 - DNA, 221 bp, Homo sapiens
acttcccccggggaaaaaaaccggcccccccttgggccggatagggggggaaacccaatttttaaaaaaaagcccccaaaaattcccccccccccgtttattggaaaggtgtccaaggttaatgtggatcccaaaaaaaaaaattttgggcccggtacccggtttttctttttttttaaaaaaaatggtaggggggcattaaacccgggttttttttttta

SEQ ID NO: 589056 - DNA, 214 bp, Homo sapiens
tctagaggatgccgttgtggtttattgaacactcacatggcagtgttaaaagtaatagaatatatgtttattgtgttggtgtgtatgtatatccacccacctcacaccactaaacatacccaggagaaaaggaatctcttctatttcatttattccaaagataatttagttcctaagatgcaatgatgagcaaaatgagtgtccttgttttgtt

SEQ ID NO: 589057 - DNA, 88 bp, Homo sapiens
taaaataataatctatccaatttatatgcattttcattttatgtccatggtatgtactttattattaaaatataaataatgaaaaaaa

SEQ ID NO: 589058 - DNA, 366 bp, Homo sapiens
gtgtgtgtgtgtggtgtaagtgtatgtgcgtgtgtgatgtatgtctatgggtgtgtgggtacatgggtgtgtatgtgtgtacacaggtacatgcatgtgcactcaagcccctaacaccaggagcctgctagaaggagatcccaaccattcattttgtcaatgatccccttgtacccatctatcatggatatttgggaaacctttccatacctaaaatccaccaaatgaatttatgcagagtcaatttgtatgtgtatactggtgtgtatcttgttcctcaagattccatctctcttgttatctgagacagattctatctctgaactccaagctgcctctctctcctcagcaagagggtgtcgacgc

SEQ ID NO: 589059 - DNA, 103 bp, Homo sapiens
acaagaataggacaatgtttctgggatcttctaagcttcaggggatttgaaatttggtgtcagagactgtttactagggtgacttttgtagacagctagaaaa

SEQ ID NO: 589060 - DNA, 361 bp, Homo sapiens
  misc_feature (1)..(1): n is a, c, g, or t
nacccggaaaatgcccagggtctgcgaggaagcccatagctgtggaatggggtctgggcactcaggggtggcccaggagagtacgcctatgggcggtcttgtgggaacatatggcacagcgagctaagggaggaagctgtgcagggtgaggtcatccccctcacgctcccccatgccatcctgcgtctggacctggctggccgggacctgactgactaccttatgaagatccagagggcccctcacccccatcatgaccaccacggccgagcgggaccatctcggtgggggagtaattacgcacggggtacatgtggcccttgcgggagaggcggaccgccagcaccacagtgcacacgaa

SEQ ID NO: 589061 - DNA, 116 bp, Homo sapiens
tcttctggtgagcactgtgcgggaaacttaggataaactcgtgagctgcatgccttttaaaggcatagcctgtctcctcacttaagttcatgtccatcgaccaaagccctatactg

SEQ ID NO: 589062 - DNA, 364 bp, Homo sapiens
caaactttgttcattgtagatcacaagggtattgcactattaagtatattgtactatcaccagaacacaatctcacaacaaaagcactgttgattcttcttgatggacattgtcaacagtgtggggtttgagtgagtctcaccaggtatccaggtgaagttagaggttccactgtagacgttgtggccccattattggcagaaccaaacaagaactgcacaaagtgcttgtagaggccatcaaagttccctgcggtaggaacctcaggagcggcgagggacagtcctgcctcatcttcaacgcagatgtacagaccatagataactgtcaccttatcatagactcatagatcaattgtcgacgc

SEQ ID NO: 589063 - DNA, 531 bp, Homo sapiens
  misc_feature (489)..(489): n is a, c, g, or t
acgcgtccgggagtgttctgcactcctgacctgcccaatgggtttagctgattccaaagaaagactacgaatggtccaggccaggagcaatccctggtcagttgggaggagtcttaggggacccgttcttgtccagcctaggtctgtcttccttcagccaggtgaggatattattctcagagcagcaaatccactaggagagaggcaataaaacctgccttgacattcatttcaccctttgatttgataggaaaaggaaaagaaaagagctggtggttaaaaacagccccaaagagctaagaaaccaaagagcaaaaaagcccagtgcacttcacagtgagtgtgaatgtgcagacgttctcatggaatctcacatttcatttttttcaatctctttacactagaaagtctttattcaaaaatagtaattttcattcagcatttttcaagtatcataaagggattttaataagtcatattcaatggatntttccagttaacaaaatgtattcatgtgattactgttttatg

SEQ ID NO: 589064 - DNA, 377 bp, Homo sapiens
  misc_feature (8)..(8): n is a, c, g, or t
  misc_feature (29)..(29): n is a, c, g, or t
  misc_feature (91)..(91): n is a, c, g, or t
acaaaaanggttaaaaagtcattgaaggncctaacccttactgccctcctttgtatcactgtcttcctaaataattattatggctgggtancaggtgtcacgcctgtaatccccagcactttgggaggccgaggtgggcagatcacaaggtcaggagattgagaccatccctggctaacacagtgaaaccccgtctctactaaaaatacaaaaagaaattagctgggcgtggtggtgggtgcctgttgtcccagctacttgggaggctgaggcaggagaatggcatgaacccaggaggcagagcttgtagtgagccgagatcgcgccactgcactccagccggggcaacagagcaagactccatctcaaaaataaat

SEQ ID NO: 589065 - DNA, 569 bp, Homo sapiens
atccaatccaaggatgcccaaatcgtcccgcacatccagtttggcttgattgtcgtattaatgtgacacgtatcgcgaggtgtaagtgacggaggagttctcgagagtcgttttctaatggggagggggaacctgacggtgtttggcgatttagcttggtccgtcgcttcgactaatccgctgattttagcgcgaagctgattggtagtttattgaaggatctccgtctgctcttgggctggtttggggggggactggggattacttttggtgtattgaaatgtggcttcggtgggcgaagatgtttgtctgataattcgagggtggggtggttattgaccgacctatagttggaactgccgtggttacgtggtgggtgactttagcataggtggtctcgattattcggatatgcgggtttgggactatgctatattgaggtggggggatgaactcggaaggggtttctgtttttctgtgtagggggagaggtagtgttcggggtgatgtttttggatgatttctgggttatattcctttgggagatgttgagggtatctattgtatcg

SEQ ID NO: 589066 - DNA, 236 bp, Homo sapiens
  misc_feature (127)..(127): n is a, c, g, or t
  misc_feature (190)..(190): n is a, c, g, or t
ctcctttcccgtcacaagaaaaagtggtgccgcttcgcgacattatcacgcccaaccagtttgaggccgagttactgagtggccggaagatccacagccaggaggaagccttgggggtgactggacnatgctgcactcttatgtggccccgaccaccgggtggtcatcaccaagctcctgacctgccctnccccgcagggagagaaactacctgatttgtgctgccggagtcagag

SEQ ID NO: 589067 - DNA, 420 bp, Homo sapiens
cctacctgctgggagttcagtgtggctatgggacttggttttgccaaattaataatacccaagttggttttaaagtggaggaaggaaatggtttttccctactgtggccatcaaggaagggtatgtttataaaaaaaaactgtgagatcgaatggcatgctaagtcatcacgcaaggacagttgccctggatggcagccacccaaacccaaaagcagaccagggtgagctatgaataaacttgtataaatcctaagatttggggaatgttttttactgtggcatatctagcctattttgactatcagaactggagattttaataaacattttatttatttttttatttatttattttgagccaagattgtgccactgcactccagcctgggcaacaaagtgacactccatctcaaaaaaa

SEQ ID NO: 589068 - DNA, 196 bp, Homo sapiens
cctggtaggtgcagtgcagataggatcaaagcaagcagaggacatggaagggctagactggctaagtcttctggcctccatctttctccattactggatgctacctgccctcgaacatcagactccaagtcttcaggcttttggactcttggacctagaccaggggctctcagaccttcaaccacagactaaaggc

SEQ ID NO: 589069 - DNA, 171 bp, Homo sapiens
gtgtgtacgagataagttcataaccattgtggggcaattgctttgatggtaagggagggatcgtagatgcgtcgtgctgttatagtaaaggatgcgtagggatgggagggcgatgaggactaggatgatggcggggaggatagttcagacggttactatttcctgagcgtc

SEQ ID NO: 589070 - DNA, 470 bp, Homo sapiens
  misc_feature (112)..(112): n is a, c, g, or t
cataaaacacttgttgtaaacttaccgtaactaaaacagtgtagtattgcgacaaggttgggcagctagataatgtaagagaaatgggaggccggagctagactcacacacnctatgaaaactgatataggccaggggtagcaggtcagttgcaggtcagtggccagatgtgagcaattcaataaatgttactgaaaaacacacattagccacatggaaaaatgaaattgtatccctgcctcacatcctacacagaaatcaattccaagtggttgaaaaacttaaatgtgaaaggaaaatctttaaatcttgttggggaaaatatagaatatctttaagggcttgggtagaaatagacaagtcacaaaaatcactaaccataacggcaaaaaaattgaagattggtatatttggttatactgcaattcaaatttctattcatcagactacaccacaaaaaggtgggacag

SEQ ID NO: 589071 - DNA, 161 bp, Homo sapiens
tcacagacctgctcaccctgtactacattgtccaacatgccagaggtgcgttcctgcttctgctggcatattaaatcaggaaaaaaaaatgcaggtcttggtgaggagggtcttgtgaggggcagaagcaggggcagaagaaggaaggcagaagcaggaag

SEQ ID NO: 589072 - DNA, 205 bp, Homo sapiens
acgatttctaaaaccacgtgacagtacctcgttagtgagccaaaaaaattggctcccatatggtcccatggttgatcccatattcgctttcacaatatcataacggtggtcctccagggctcgaactgccttggctctcgacactttggctggtgacatgaccaattcatatgtcctaactttcaaccccggttccatcgacctc

SEQ ID NO: 589073 - DNA, 737 bp, Homo sapiens
gctgagcaaaccatggggtatcacagaccttgccatctggccagtttgtagtaaccgatgtggaaggtggaaagctttggtgtttcacagtagatcgaggatcaggagtggtcaaatacagctgcctatgtagtgctgtgcgagccaaatttgtcaccgtgctggatgctgagggcaccgtctacttcatcgcaggagttagcctccatctggagaatcggccaaaagtgagcaccacctgggagggtggctttctccattggctctgtaggccctgatgggcagcgtgggtcgccagtacttagccacttcttctcggagaatgaggatttccgctgcattgctggcggtgtgtgtggatgctcgtggtgatctcatcgtggctgacagtagtcgcacggaatattctccatttgcctcgggtgggggctatagtgtccttattcgagagggacttacctgtccggtgggcataagctcctaactcctaaggggcagctgctggtcttggacatgtcgggatcattgcatcgaagatctacagttaccatcgtgagaaagataattccagcccataggggatgagaaatcatcagtttcttctgctgcccaagccaacttccgttccctgaagtctggggagaagtggacagtacagattagactcagactatgtcctgactccagctgagtaatttagaaataaaaagtcatcttcaagtggggttagtacgtcc

SEQ ID NO: 589074 - DNA, 305 bp, Homo sapiens
ccgggagcccgtaaccatcattaagtctgtgaccacccacaatagcagaatcggtccatcaccagtgacacagctccaaggtggggctggtcacgataggagatgaggtcggagcgcactaagacaggccacgcccgaggtcgcccacagagctggtgcggaagccgcagactgccaccttaggtgccagcagcaggaggaacgtttcgacgctatagaagccacggtccacaaagtccaccatgaagaggcagtcgttcgcagggacgtcgccacctactctgaacagctcttttatacatcac

SEQ ID NO: 589075 - DNA, 326 bp, Homo sapiens
  misc_feature (102)..(102): n is a, c, g, or t
  misc_feature (106)..(106): n is a, c, g, or t
  misc_feature (125)..(125): n is a, c, g, or t
cagtccaattgctatctatttttttatccagagggttaagtaaatgatgtgtggaaataatgtttgagcattaggccaatgtaattcttaatttctgggggnaaanatattccgaaataaaatanagggggggggaggggatagcaaaagtaatcaccaaaaccccctttcccatcttgcactgtttgttttggattgggtttgggggaaaaagatgtttttcttagttgtctactttgtttgaacacttttgttgtggttcaagtgctgttttgtgtgttgggaccaaacagttgtcaatacctttcaagcgagcatataaagaa

SEQ ID NO: 589076 - DNA, 424 bp, Homo sapiens
gtgaaagacgaaaataaagaattgtcccactatcgaccaacacggcacaggtctgtttctcgcacgcaacacacgggtattcatatcaagctcacgtcggtgacttcaggccgatagcaaatcgctcttctctctttcatcctgtgtttcgaggctttctccattatctcttctctagtttctgtatttcgcacaaaagagaacatgttctctttcttcgtcgtcgaaccttcggtgtgtgctactcctggtagcaaatatatatggagttttaccttctaactggtcttaaataaaagcgcagaggaagaggccacttgtccgctcttttcttcacctcaatccaccagacgtcttgtgataagtgacattataaaatacaaagaaaataacaaaataaccctaggcggccccgccaagctct

SEQ ID NO: 589077 - DNA, 637 bp, Homo sapiens
ccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccaggcagaaatgccgggcacaggccaggacaaaatggcagacttttttttttttttttttttggaaatggagtcctcgctctatcgcccaggagtggagttgcaggggcctcaactctcggctcaatttgcaaacctccgccctcccgggtttcacaccatttctcgggcctcagtctcccgagatagcgtgggactacgggcaccgtgccaccacgccgggctaaagtttttgggtatttccacgggagacggggttctcacggtgttagccacgagggtctccatctccgtgacctcgttgatctgcccacctcggcctcccaaaggtgcggggattacgggcgtgagccaccgcgccgtgccaaaatgcagacatataataagggggataaggagggcaaaggtaaagctatag

SEQ ID NO: 589078 - DNA, 221 bp, Homo sapiens
gcccctgtggaattgagtgtaagagtggaataaagttatcaaggacaatgccaagggtggggcacccccaaatttgactcttggagactcagccaaatcctatctggtaataaaatttcttttttcttttttttttttatattttttttatttttttttttttatttattaaattattaaataatatctaacattaattaacagcttacacataaacatac

SEQ ID NO: 589079 - DNA, 468 bp, Homo sapiens
cgcagtcacgacctgtaaagctgaatacggatgaatggtcatctgctatgcataactcaaattgtgactcgatcacttccgataggatagatcgttagatctagtgctacgactacttgtgatctaataacagagcctcatggttggagctccactaattgaatgacgactatgcgtctatgacgtgaatgatagtaagtgacatcagcgccctatgtcgccatcagtagcctattcgaaagttaaccgtctgtcctcatctggatgcatgcataaacacaggaactgcgatagtaaagcccttgagtcttttgaatagggagcgggctcctggatatgcagatccatggtcagcattcgtactcctcttgcgcatgatgatgcacgctgtgcaggtcattagcatcactaatcagctaactgctatcgagaacgtcaaacagcgggccgaaccgccgcgtgtcgtag

SEQ ID NO: 589080 - DNA, 425 bp, Homo sapiens
cacgaggaacataggcgagagtgtggcttcgcgaattcacttcgactggttcaccgatgagacccgccacctggtcccagatctcaccctggcggtcgcgatgacgtacaaagttcgaccaccaggctagttgctgttcttccgagacagctgactgtggcgcgagcaggtgaaggactaagaaggtgagggactcggacgaacccactctgggccgttccatcaagatttcgagcgccactagctccttaccttcagcggcttggaggtgccagcgctcgaagtcacggccaccgtaaagggcatccccctgatgctcagcgatgagagacctacgagtgacttcgtcggtcggacgctgatgccctagcttccgtgtagttcggttgcttggctgcactagaggcagtggccctgtcgaccaa

SEQ ID NO: 589081 - DNA, 625 bp, Homo sapiens
cgatggataacgttgtataaatagttaaagcagtgaggatctatgcaatcaccactggttcagaacgaatcaccaagggatctaattgaagaggcagtagttgacccatggggttactagaatgaacctctcaggattacttagacctgtgtatgacgagactttatgttcttgggctacccgctgcgcccttagccctaatataaagttgatatcagagagcaatatcgatgagtggtcaagccccgataatcgtcagtacttcaaccctgattggctactcgggagagagtttgaactctacgaatctcaagcggtagaattggctcgtcaattgaagttggacattgacgaaattgcacattttttccgtccgcgttctgagtttctcttggctccagcaagcagagttgcatattgccatttgtgcattcagtctgatgtagcatttaaaagatatccatcgtggagaaagtcttggtgctattcaacgaacgcatattgctttcagcatagatgtttgcttaggtttttaggtgacgctcttgtggcagataagcaatggaaagcattttggaagggggatgcaggtgattatcttccgggaaaaagagggtcgcacatt

SEQ ID NO: 589082 - DNA, 204 bp, Homo sapiens
ttttaaagtccgtatttcaaagataaataaggtgagaaatattttatgcttcacacaatatcttatggcacacattcttattcaataacattcatggggaatatgacaagacattcaagtttgacttttgttaagttacaacacagattcattaaagatattaattaaagataccacatatagattaagcttatcaatctattc

SEQ ID NO: 589083 - DNA, 130 bp, Homo sapiens
gagtatacgagtctgtgcttgtctgcttttgttggtgagaagaagcggaaagatcaaggagcccctcctactcccagaggatgacaccctgtacaagcgtcttctactatttgggtacctgagctcgaat

SEQ ID NO: 589084 - DNA, 334 bp, Homo sapiens
ggccaaacgtaccaacgaacagtcgggctcgtcggtcactacgggaccgctatggcgcctccctccggaaaatggcgaagaaaacttgaaatcacgcagcacgccaagtacacttcctctttctgtggcaacaccaagatgaacagacgagctgtggggatccggcactgtcgtctcctgcatgaagacagcgcctggcggcgctggacctacaataccacttccgctctcacggtaacgtcgaagcagctgaaagaccagtagacgcccctctactccttgagacatcactggcctctaataaatcgcttaatttctgtaacaacacaaaaag

SEQ ID NO: 589085 - DNA, 483 bp, Homo sapiens
  misc_feature (112)..(112): n is a, c, g, or t
aatcagctgggcgtcgtggcgtgcatctgtaatcccagctactcggccgactgaggcaggagaatcgcttgggccgaggaggtggaggttgcagtgagccgagattgcgccnctgcactccaacctgggcaacagagcaagactctgtctcaggaaaaaaaaaaatgttcttggttagggatgtttgaagaatagaggaagtgggctgggcacagtggctcatgcctgtagtcccagcactttgggaggctgaggaaggcagatcgcttgagcctaggagttcaggaccagcctgggcaacatagtgagacccccatctctacaaaaaatacaaaaattaaccggatgtagtggtgtgctagtccaagctactccaaaggctgaagtgggagattgggtagagcccaggaggtcaaaggctgcagtgagccgtgatcatgccactgcactccagcctgagcaagagtgagattccttatctaa

SEQ ID NO: 589086 - DNA, 133 bp, Homo sapiens
ctttataatgtcctttgtgttgtgaaaatttttcccctgaccccaaatggaaccggacaaagcccatccggggatatggaaaagtttcatgcccctgggtttactcagaaaaagtaaagtcctgaaacttcca

SEQ ID NO: 589087 - DNA, 1120 bp, Homo sapiens
ggttcttgtgctcaccatggacggccacctcggcctcgtcaatgaggacgatcttcagaactggtagccttagcacaggctgtgaatgctcgagccctgccagcattgcagcaaattaacctgtactaggacctcatccggaagctgtgcatatgtggtctgctggaggatctgagtcacccattaatatcgtcctttcatctgggggcctggcatgcaccaggaagtctatgcaaggcctgcatccagggaagttcatgccccatcatgcagtggcatatactcttgatgcccttgagatgtctccctgaggacaaagaggtcctcacatgaggacaagtgcctccaggcaccagaaccgcttatgacgggcacaggtggctgtgtttggctcagacctgcccgagaagctgggcaagcagaagtattgcctggtgggtgcggtggccattggactgtgagctgctcaagaactttgccatgattgggctgggctgactgagagggtggaaaacatcatcggttacgtgacatgggaacacccattgagagacggtcaaacatctgaaatacgacaagtatcatcatttccagggccctgggattgtcaccgaacgacaaaggtcatgaccacggcatgctgcaggctgtggcggccacaattgacatccacatatcccgaggtgacaaagccaccaagaaaccgtcgtgggagtccatagaaacgggaaagcggacatttcaatgaatggaaacgaaagcgtacacaacaaaagccgtagattggaagtggaccaaaatgaccatgagaaaaaacgtgggaatgcaccagagatagcagacaatgggaaagcccgaacaccgaaatgtagggaatccctacaatataccccgaggaaacaggtcgccaacatgtggcatgcggaactgatacacgaggagcaatccaccctgtggggagcacgaccaaacagaggcaaacattgaattagagagagtaggatagaaatccccaccctagacatcgagaaccggaagaactggaaaccaagtatcacccataccagaggacaccccgaacagtaaaaaaacgttcaacagaccaatcataggtatccat

SEQ ID NO: 589088 - DNA, 718 bp, Homo sapiens
acaagaaactaacatcaatactcggtaggaattatcttaattagagatacattggctatgattatctctggctatagatcgagatgtcagcgaataaggcggaatggagtaagtgacctaattgagaggctgcacgcgtcaggtaaagtccaatggctatagactcaagagtgtaggttgtcctacactctaacacgataaaatgagaacaatacatacaataccaacatgaccagagggaagatggaggtaggatagcagatgaaaacagacgatcagataggatgaccatatgatacgtagaagacacagtagaggctaggggagcaactggctttcctccccaaaaggcgggcagggttatccacactatgcccaggtccctgaagcctgcggctgagctcggggataacaggggccaagtcactggtcccagacacctaggaactattagagacaggaaccagcatatgagacaggggctgttaagtaggaggttggagaacacacgtaaaggtctaaaccgggggcccctctctttgcccactgagcccgcgtgctgcgtggtgctgagacttgcctctggccgcgtcagcttgggacaaggcctgagcggtggtgatcccacctggatgtccggggccgggtttccaacccggaaagccgggcaatcccgggacgcggtggggagaagtggcgcttgtcctttgccatgctt

SEQ ID NO: 589089 - DNA, 964 bp, Homo sapiens
gtgatagtatattcctcttgactctcgggacatgctggtgctgatgtgatagatgcataaaaccagatatgatgtcatgtgatgggtgtgatacagaaggatgtgtggggttacatggatgaaacatgactggagagagtgaggaatccagggctgacatgcatgcatacactctcgtggctattaatttgtagtgtatgtctagtagaacatcaattctttataagtaaggtaagggtagacggcatattaagtcagtagcaatttggaccagtatgatttgcattttattagaatctatttagacacgtatgggtagtcaccatcttaggtagaataataacatggcattaatgtagtagcgcgataatcgatttgtacatctataatgtgtagggtagaggaattgactgataagttgaccttgagggaagtggacgcttgttgcaaagaaaggggctgtatacgaatttagtatcctacatgagtaatttatggttgggaatgcgtagtacagataaataagaagtatgctcaattttggagtaccttggccattgctggaaaatcattactggcaatgagagctctctgaaggcgaaagaacaactctgttgactactgaaaagtggagaataaagaggatagtcttaagtgctgagttatgtacctatttcgttatataattgttacgaggcatcttgtgtagaaacttctcccagaaaaacgtgcgtgtctacgtcagggtgtgtttgaatattcacggaggagaaagtcgatactggtttatctcgttgagggggatttcatttgtcctgaattcattattcaaattatatttgtgtggaaaatgtgagttgtgggggggatcggggcccccctaaaaattgtggtaattggatgggggggcggcccaaataattaaagagggtggagtatgaaattggagagatgtggggtatgg

SEQ ID NO: 589090 - DNA, 179 bp, Homo sapiens
ctgacggatcattctcagaccacatagtgtctggactggtacacctctgataatcaggaagtgagagcctgctttgggttggattcttcttcctatgctgtcctgtgagtactcatggtatggagatcgggttatgtgtacactctatgtcaacagtgttccaactcactgtgtgacct

SEQ ID NO: 589091 - DNA, 127 bp, Homo sapiens
tagatcgagccggtaccgacagcatcctaaccagtacactcaccagagacaacactctgttttcagaccgcctggatggggggccatagcgacctcggggagcagagtctcagacactactcggaac

SEQ ID NO: 589092 - DNA, 604 bp, Homo sapiens
taccaactaagtttattctaaatctgttgtcatctcaacattgtttacactgtcttcaccacgagtagatttcatctcaagaaaccactttctttgctcatccttggaagcaactcatccactcacgttttctccggaggctgctgcagtctcgccagatcttcaggctctgtctctgattctagtgctcttgttatttccaccatatctgcagttacctcctccacagaagtcgtgaacccctgtgtcatctgtgagggttggaataatcttcccaacttctctctctctctctctttttttttcttttgcggaaatagaagtcttgcctgggcgctgggagtgcagtgacctgggagattgccccactggcactccagcctgggtgtgaccaaatgagtccatctcaaaaaaaaaagagaaacaagaacacactttggagacacatctttaatggcgtatttccacactttagaaaactctgtggaatccccaaaagcgtgtttggacccctgccaccggtgacattaaggattacgcacatagtaggtctttaccaaacgggaaacctgcaatatccctttttaataaatttaactcctct

SEQ ID NO: 589093 - DNA, 112 bp, Homo sapiens
tgaggcaggaggatcgctagagcccaggagttggagtctagcctgggcaacatagtataacccagtcgctaataatcaaacaaaatgacaccctcccccgcaaaaaaaaaaa

SEQ ID NO: 589094 - DNA, 220 bp, Homo sapiens
tccccgcactgtctgatgtgccgatgctgggcggcatgcgcacctttgagcacaggtctcagaaataacgccatatcgaactgatttttcatcgacgacctccgatgtaagcactcaccacatcgatgcggttatgccccaactcgtggctgatctgctgtcgcgcacgccgatcaggctcgcgatggtcgccaggcgcacggaccgccatgggacgggg

SEQ ID NO: 589095 - DNA, 147 bp, Homo sapiens
acccctttttccccccccagggcccaaggggttttggcaataaaaatagaaaacattgccccccctttccctgcataaggggggggggttcccccttttccctcccccattggttgggggaagggcataaaaatttttttttttgca

SEQ ID NO: 589096 - DNA, 393 bp, Homo sapiens
tgatgataagctaaggaagtttgaaattcgtgacatgatgggatttcaccatgtataggtacactgttgcccagtcagttagtcctgtagcccggccctagtggagagtgcctttggcgctttactcataaagctccctctttagcaacccctttgtcctcactgcctgtgtctctcagcccatctttaatggtctttgaattccacgccccaaagagggcagtccgcaccagtaccctcacccccgtggtgtttgccaccaagatctgcattggcgccacattgccatgacacctggcactccccccccctttgcctgcttttcaggtagaaaggcctggcttttcaacatttgcttccccccccttcccatcctcctcccagctgcccaaa

SEQ ID NO: 589097 - DNA, 619 bp, Homo sapiens
  misc_feature (232)..(232): n is a, c, g, or t
cagcatggacctgggacagtgaatcgacaatgccgatctctctgtcgtcgctgggggcaatccctccatgacatggcaggctctgtgctgccatggatcggcctgaatctcccttggtctgagtgaatccctctagaggagatgcttgcctccagaagacaggatatcaattcccagcttccgatgtagtccaaggatcaaagccaaatcattcacacaaaagtagtcaccncgcacgaacactagggcctgaagttacagcccctatgcagctcctattaaccggctcagactaggtcaagcactcatgttcctaaccatgacatcctaaataatctttcgttcgtccccgagtggagcatctgggtacagtccttagacaatgtcctctcgccgggggatccaaggcctagacactcacgattgaaataatcgcttcggtaggggcctttgcaatatttcaaatccctttccacacggatgaattccctggggaagggttttcagagaattcccactgacatgggcttatccatgagtaaacctcccctcgctggtaactcccgtccaaggacaaaggcccaggaacaaggcaccaagccgttccatagcttgaacc

SEQ ID NO: 589098 - DNA, 121 bp, Homo sapiens
acccaatgacgccagctccaaaagtactgggattaccggcataagccactgtgcccagccctgtagcattatatctaacaacaaacaattagaaaaattaaacactgcctatacttttttt

SEQ ID NO: 589099 - DNA, 334 bp, Homo sapiens
ttcaggcttcaacattgaatacgccgcgggcccctttgccctattttttatagccgaataccccaacctttttataataaaccccctccccggtacaattttcctaggaacaacatatgacgccctttcccctgaactttacacaaaatattttgtccccaagaccctacttttaacccccctgtttttatgaatttgaacagcatacccccgattccggtagggccaattcatacccctcctatgaaaaaatttcctacccctccccctagcattacttatatgatatgtttccatacccattacaatttccagcattccccctcaaacctta

SEQ ID NO: 589100 - DNA, 384 bp, Homo sapiens
  misc_feature (43)..(43): n is a, c, g, or t
  misc_feature (194)..(194): n is a, c, g, or t
  misc_feature (251)..(252): n is a, c, g, or t
cccaccttggccttccaaagtgctgggattacaggcgtgagcnatggtgcctggctatcctaatataaaacgaattcttttcatgctcactattttctcttcttgcctcctttcaaagaaattagtgtctctggattacctcactaaacatgtacagtgatactcatattcatcccaattttttaaataattgntttctctctgtaattttttaaaggagtttgtgcagttaatggtctgttatatgttgnnggaggggatgatggttcctagaaactcggcggtcatgggaatcttataacccatccacctattaatggacattatggccgtaaagtgttagcaccgagagagcatatgcagcctgctctatgggaagagaca

SEQ ID NO: 589101 - DNA, 1528 bp, Homo sapiens
gccacgatgagcagcagcttagctaagatcgcgtgagatagaagcagaagtataggttcgagagctcaaataggaaccaaggcacagcggcacaccgaatgagggctgcgatactcggcatccgatctctgtcctcacaagcctttcgctctgaggaactcatttactccgaatggtgcttggttggtagagtcgtgatgcgtccgaaggacgtacacggtattcagacttgtcggtactagtgatcaaggtagacttgtcctctgaagtgtgggattccgtcatgaggttgacccatacttggttgtggtgacatgtccaaactaccttggcctttagagaacccttggccaaggggtgctcatccatgtccctgaagagttagagcaggacgctacattgtacatcccaacatgacgtacgtagaacccgacttagttgaccacttggatagtccatcgtagcactacacagagccgcgttgcactcaaggaatctgaggtctccctgggatccgtcgccaaaggttaatcgaattggaaacaagggttgccccgaacgagtactagggcaatgagaggtcattcaaggtccagataccaaaacgattcaactctggacaatgctctgcgaccgcaggagacctcttggtaaagcattggcactcgtttggacttgggttcctcgggagactggtgcctgtcgcaaaaactcccgtgtttcggtgtgccaccccatttcacacgccgcatctgggaaagttaaggccttcttgcgaccagtgaataggttaaggcctctggttgacgaagaagttgcccctcctacgctgccaccacttcacgttgacccttgtgccacaccctgaggtcacgaagacaagcggcccacactgagaaccgaggtctagcggccacatcacatgacccgcccagagatcgctccatgtggcacacgccacgatggtgccaagcgtcttcgaattagaagacactgtcgtatgttacgaccccaaccaatcttaggccggacgccaagcgaaacgcttgggaagagaccgtagtgaacatcagcacttgggacacacatcacatgggtttgcagattgatgagaccaacatgtctgcgcttggaggactcttggacggcaattcaccgcgcgttacgaacatctttccaggttcacacagtgcgctgcttcggtagtatgtatagaacccctatccttatagcacggagaagcgcttgaacctattgccctaacgcctcggcccttgcacctatgggaagcccgttggcgtatatgactgtcgctagggctatgcgcgagaacttctgtgtaaatctagcacttgaaacggttgcgtactcttatgcgtacgccgcgccctagggcaccttcgtcttactatggttgtgatttacaaccagttaccctgaacttcacggaggaccaacgttgcacttccatgtagcgacatcttatgggcttgaggcaacgtgtatcggcggctgttatactacacag

SEQ ID NO: 589102 - DNA, 225 bp, Homo sapiens
tctagaggatctcgtgtcatcccccttcgtacagactcaaagcaaggcatgtggcacttctttatttcaaaacagaagtgtctccttgcacttaggcttggcagacccttgactcccggggagatgacctgggggaggaagtgggtcaactatttctttagggctgtttggctccgaagcctatatgtgcctggatcctctggcacgggttaaattttcaggtga

SEQ ID NO: 589103 - DNA, 302 bp, Homo sapiens
cttctgggtatatacccaccagaactgaaagcagttgaacagatatttgcacaacaaggttcatggaagcataaactgcaatagccagagatggaaacaacccaattctcgatagacggatggatggataaacaaaatgtggtacctacatacgatgggatattattcagtctttgaaagtaatgaaattctgacacttgctacaatgtggatgagccttgaagacatatgttaggtgaaatatgtcagacacacagggcagcattgtatattctccttgcatgaaatatctgaaaagtcaa

SEQ ID NO: 589104 - DNA, 360 bp, Homo sapiens
gagaactagactcgagtacaaccttatcctatctaactttaaacaaattgttattacacaaaggttggcacatagttgcatactactctactttgtacacaattattctcactcttcacagaacggctgcttaactggtcatctggtggtggcaagcactaagcagaccactgatccatgactattgaacccagtatcaggaatgatccgttatttattcaagattactaggtagaatactctgtacgtatggacaatgacgatagctgaccgttatatattgagtcaactgacaccagtaactgagggatatagcgattctcagtcagcctgtaacttcattgctacctgactgatctg

SEQ ID NO: 589105 - DNA, 114 bp, Homo sapiens
aatatagcgaccaaacttttaaacaatggattaacatatacatggtacacaggtcatgctgagtgctaactgtaatgcataggcagagggtgccagaattcacttttatgtcaa

SEQ ID NO: 589106 - DNA, 1866 bp, Homo sapiens
  misc_feature (1586)..(1586): n is a, c, g, or t
  misc_feature (1605)..(1605): n is a, c, g, or t
  misc_feature (1782)..(1782): n is a, c, g, or t
tagggttgtgtggtgatttctagcggtgtgtttttgttgagcgtgtgtgtgtgatgtggtctttgttgtttcttgcgtctttgtgtgtgttactggtgttgtgtgtgtgctttgtgttagcttggttacttgtgtctgtgtgttgttctgtgtgtgctgttttgggttgtgtgtgttggtttgggctgtgtgtggtagtgggtttgtcggttgtgtcttttgtttcttttcgttgtctttgtatggttttgtggtttgtttttgacgcgccgcgtgtgagtgtgtggtgtcacggcctgatcccacctggttgtattgacgcgattgtgccgccctcgtgtggtgcgttgtgtgcacaaggtgaacggacaccagtaatcgctgaggtttgtttagaggggcgtagcccactctgtatgttggtggagacctgtcctctgtggtaggggagatccactcaccccaaaagagtgtgttggttgacccgccgctaatatatgagcccactcgggccgctttgtgggtttggtaagtagcggtgcccgcgcccctctagtgtgttgtacttgtgttttgttgccggggtgtccctttaaagaggttttatgcgtgagggacccttgcgtggtgattgtgccgtagattttctcgggcctaagcgtggggggcccccgcttttcttgtgattggggggataaaccgctgtatagttttagttggttttgtttctccccggcgcgcccacccgtgggtttttccccacgagggtgtcgccagcccgctttttgggtgtttccccgccgcgcttaggtgtatattaggcttctgtatggatagtgtggctcctcgttcgaggagttcactcccgcgaggggtcttgctgtggcttgactacgctattggggtgtcctcccccgccgccgcgtgggtggttggcgcccccaccaaaagcaccggtgggagtattgggggcctccccccgcacggtgtttcttatatctgcatgcgcgggtagagggctcggcgcacccccagtcgccaacggggggcaatatagcaacaccgcacgcgcgcggtgctgctgtgtggagatgttatgtgttcccaccccggggagcacccttccacgtggttgtttcctctatgccgcccgcctggcttctcgcgggggtgcccacctgcgcccgtgcaatgtctctctcggagctctctcatcctctgggctctgtttgataccggcttgtttcactgtctgtgtgtatacctctgtgttgtccggcctgtcgctctgtctctctggtctgtctgtccacttgaggtgtcgtctctcactgtgtgtctcatatagggcgcgggatatagagaagtgtgtggagacacacacattgagtttgtgtcacacatatcaccccggagagaacctctctgtctgtgtgacacacagagagagagcctctcacttgtcgcggaggcacatgtctgtttcgaccactgagacctgtcctctgtgtgtctgtgagagacgtggtgtctctgctgtgacaccggacactgtgggtggacacacgtgtgctgaactggataantttgaggggacaccgcggnggagactgttgttgtataaaataaccacaagagtgtcgcgagagaggacactcgtgtggcacacagcacatgtgataacacccacaggtatgaactgttcctctaagtgttcttaaagtgtggttagaatttctgcgtgcgttgtttctgtggtaacaggtgtaatacacgtaagantgtaatatcttgtatagacgcgagagaccctgtatatatttttccaggaatttatatgtatagcgtggagacacaccaaaatat

SEQ ID NO: 589107 - DNA, 109 bp, Homo sapiens
  misc_feature (30)..(30): n is a, c, g, or t
  misc_feature (45)..(45): n is a, c, g, or t
gctcccaccccaccctcttcctgtgtctcncgcaagttttatacnctaatatttatatggctttttttcttcgacaaaaaaataataaaacgtttcttctgaaaagctg

SEQ ID NO: 589108 - DNA, 276 bp, Homo sapiens
gtatttccccaagcagccattcccttgtctctctcctctccttagagctccctattctctgagaaacaataatattgaaattagtaactcacaatggcctttaagtattgacgtgaaaggaagattctcacctctctcactttaaatcaaatgctagaagtgactaagcttagtgagaaaggtatatcaaaaatggagataggttgaaagctaggcctcatgtgccatacagtgagcagagtcgtaaatgcaaaggaaaagttccgttgaagccgt

SEQ ID NO: 589109 - DNA, 358 bp, Homo sapiens
gcatggagacgcatatagacgaagatgaggtcaggtcatgggcagaccttcggatacggaaatcccagtactctgtcattactcggaagttggtggaggtgatgaccaaatacaatgaagctcaagtggcacttccgagaacgcagcacagggcgaatccagcggcagctcgaaattactggcaacaagacacaccgatgagtgagctggaggcgcatgtgggagagtggccaacccggccatcttcacttctggcatcattgactcacagcatccccagcaagccctcagtgaaattagagggacgacacaaggacatggtgaggctgaagagcagcatcaaggcagctcacgacat

SEQ ID NO: 589110 - DNA, 155 bp, Homo sapiens
agtccgtctcacttcatcgcgtcattcaactcgattgcattggaatgagagatggaatggaacggaatggaatggaatggaattaacccgaatagaatggaatggaatggaatggaatggaattaacccgaatagaatggaatggaatgtaattg

SEQ ID NO: 589111 - DNA, 226 bp, Homo sapiens
acacggatccccgttacagccattggttgatgctaacccagagaatgcgctatcgcactaatctgccactgtatatgaagtagtgggttattaatcaccctccttaattcattgagaaaatttttgtcccctttgtgacatattgaactagtgatttgaccagattccagactgattcacaatatcgttttcttctatcccactttttactcagttcctctctgta

SEQ ID NO: 589112 - DNA, 235 bp, Homo sapiens
  misc_feature (44)..(44): n is a, c, g, or t
  misc_feature (50)..(50): n is a, c, g, or t
  misc_feature (55)..(55): n is a, c, g, or t
  misc_feature (120)..(120): n is a, c, g, or t
tgctgttctagaggatcccgagcgagatcacatcaccgggtgantgtaanggtcngggcctgccttggggggtgactgagggtccaggcctgcctcgcaaggtgactgagggtctggacngtctcgcggggtgatggagggtccgggcctgcctcggggtgactgtgagggtccgatggaagacatctgtagtgtcctgtgccatcagggataccgagtctcgaagttcgtaagt

SEQ ID NO: 589113 - DNA, 531 bp, Homo sapiens
tatccccagatgtggtctataaatacaactgcctactaaaaagaagggctccagaaagaaaggtcggattacccacaaagggaagcccatcagactaacagtgaatctctctgcagaaaccttaaaagccagaagagagtaggggccaatattcaacattcttaaagaaaataattttcaacccagaatttcatatccagccaaactaagcttcgtaagcgaaggagaaataaaatactttacagacaagcaaattctgagggatatcgtcaccaccaggccggccttacaagaactcctgaaggaagcactaaatatagaaaggaaaaactggtactagccactgcaaaaacaaaccaaaatgtaaaaaccatcgacactatgaagaaactgcatcaactaacgggcaaaataaatggcaagcatcataatgacaggatcaaattcacacataacaatattaaccttaaacgggctaaatgccccaattcaaaggcacagactggcaaatgggatggggataaaccgcga

SEQ ID NO: 589114 - DNA, 123 bp, Homo sapiens
agctcgcattccctactttgaccctgggtgggctctgtgcagtcactggaggttgaagccaagtggggtgctgggaggcgggagagggaggtcactggaaacagggagagcctgctggtaccc

SEQ ID NO: 589115 - DNA, 251 bp, Homo sapiens
cacacacacacacaaatatacatatatatcaaatatatatgtatatttgatagagatgatagcaattatgtgtgtgtgtgtgtgtgtgtgtgtgtgtgtgttagccaagtgtggtttctcatgcctgtagtcccagctactttggaggctgaagtgtaagagttgcttgagcccatgagttagaggctgctgtgagctatgatcatgccactgcactccagcctgggcaacagagcaaaaccccatctcta

SEQ ID NO: 589116 - DNA, 1094 bp, Homo sapiens
aatcactactacaagctgttcatcccctggacgaatcagaagatccagcaatgactttgcgtgcagaggaacatgttgtgagttcaatgcacatcagagggcttcgaccgggctttcgctgacaatccaggaccgatggttgtgtttgccatcgcctaggagatgctagcacgctgggcgagtccctgcatggatcttccaggaaatgggccgtgaagacgtatagaagtaacatggtcatcatgcccggttactgcgtgcatgggtcaccgtcgtgccaggaagatcctcagcggggcagcgggaagctcgcagatgtcaggggcggtcagtgtgcatgggaggtcaagatgtcaggtggagtacatgtcatgtcagtcggctagcacggcgggacgccaagggtcatcatgcggcttgtgtgtgggccaggtgagagccggagatgctgtgctgctggtgcaatgagtcggagggcactaagcaatgagtggacgttccttgaatgccatacacgagtcgatgcaggaggctccgtttatgctcgacgtggcgggtggcgtgggggtcccatccatcgagtgtcatgtacggggtcatgtccctggtgcttgcatggctcatctcattacccctcgggggatccatgggggatcacaatcttggctactactgcctgtgcctaaatggtcggcaccacggtgtgcacacgcttgcccacaaccaaggccctcgcagacattgcacccggttatcgcattactcgggcgtgagtgggcttgcctcgaaaagcgcggagcgatcggcggcaggtggtatggcggcgccttggcgcaatggggcgatggggcaaggggttgcatcgagggtgacgaggactgtgagagggtgaaaccggggcgcgtcatagtttggactcggactgcgtggccaaccttgtccttcccggcagcgggatgttgtccccctgtggagggcccacaagaaagtccttccgcgggtcacatggcagcgagcaattcccttggatgcgattgtaaggggacaaggcagtgatagttgccacaggaaacggtcactcttggagaatgggg

SEQ ID NO: 589117 - DNA, 1007 bp, Homo sapiens
gggggcccggggtgcgcgtgccgcggtgggctttccacgggcccgacatgtagacctgtggttgctaggctccctggtgctcggcttggaccgcgcatggggctgggccctggcctcctaacggcggctgctgtctggtgcgcggtaagcttgggggggcgctcctcgccgcctcgtgtgccgcgaggtcggaaatgcattctcctctaaccccgtcccctgtggcgggccacgtggcgggcggtgtctttctagagctggcggtgctactgactggtgtagcccccgggtccctgagtccgagggactgagtcactcgacagttggcgctcgttgctcgcatgttatccttcttcatgtgtcgttcattggcgtggccttcgtcgcgtgccctccctggacgtgggtacggccgtgacgcccagcgtacagcactatactttgactcgactctgcaacgcgggcgactcttatctacctcatgggatgtccgtagatcgacccccaggagggcccagggaaggactcctcggtgtggtgagccctgaagtagacgcgacgccctccccttttgggagggaaccgcgcttcggaaggtgggccctgccctacggagaggagaccaccttccagggggacgggtcggtagggtaccccgttgactccgcttgttatctgggagcacacgtatgcggctgtaagcttccactagagttaactcgcaccgagtctgtggtagggccttgccgtctatcgcgattcaagaagggcgtcttattcgcgccaagacccaagagagggaacgcagcacggctgccgttgacaggcgcggccagatccgtcctcctggcctattgggtaccccgttgtcagagcgtaggagttttgcacctagagttttgcgcgattgggtaacgacccggcgagtcctttcattaccgttcggacaagccgttccgccccttggggcttcgctgggaaccctttggggggcccttacgcactta

SEQ ID NO: 589118 - DNA, 139 bp, Homo sapiens
cttcagcaggtaagttggcaataattttagataaaaataatggttccggatcattctgtttggcaacggtataaattttcccgccattttcttccaccgtccaagtacggattgatccaaaaggttttgcataatccag

SEQ ID NO: 589119 - DNA, 340 bp, Homo sapiens
  misc_feature (165)..(165): n is a, c, g, or t
  misc_feature (334)..(334): n is a, c, g, or t
gggggtattttattttacatatgcggggcggggcgatgcagaggaataatcagtttacaatattcccccaaattaaaactttcttcttgcgtattgacggaagatctattcgaaaatgtcgacggagcgtctctaccacttacccggttactcattgacttaacnctgttcatctttacaagcagttgagggggtttgaaaaaacccacccgaccttttttcaaaaaaatgttttacccggaccccccttttggaaaccggtctttttgaaagttttttcccaaacttccggttttccgggtaaaaatttttttgggggttttttaagaggggnatacta

SEQ ID NO: 589120 - DNA, 233 bp, Homo sapiens
acggtaacgtacagcttgcctgggctgagtcaccctgggagctgagctccgggagtcatgtatcttgagtgaacgcagtgtctgggtggggtccacttgtgagttaaataccatcactgcatcttcatgaggtgctgggatctcctaccaccaggatcacacggacacctgagggtgcatatcagctccacgctcaaagattcaggtctcggcggttgttgtagctgtacctc

SEQ ID NO: 589121 - DNA, 574 bp, Homo sapiens
agcggaatctttagggtgcgcgggtgcagtatatctcgcgctctctcccgtttccccctgccctttccccaaccggggcactcacggtcggcaggcaccggaagccagaggatggacaagcgcctgtgcgcggctctcgagcagtgcaacgtggtgatgtcgctctgagtgtcatacttcggcaaccctgaactgactgatctcatacaggcgaatcagtcgtggtactcatcatggttcgtcgaccttactgaccagctacgagcggggtcacatgccgaagagatctgctcatccgcagcgcattcaagcgaagcccaacttgcccctcggactatcaataccccaccaagtccgtccactcgtgaaatccaagtcagtacagcgcaccccttcctgaacacccactactgcagcaatcaatcactctcacatgcaggctacacaagctttacgacaacatcgtgtaagcaatccaatcccaccctaccctgcgcataacaaccgtaggcctgcgtgaggcacacatggacggcctacaagctaacactgaagctgggacaaggatacttga

SEQ ID NO: 589122 - DNA, 704 bp, Homo sapiens
  misc_feature (57)..(57): n is a, c, g, or t
  misc_feature (86)..(88): n is a, c, g, or t
  misc_feature (91)..(92): n is a, c, g, or t
  misc_feature (105)..(106): n is a, c, g, or t
  misc_feature (128)..(128): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (188)..(188): n is a, c, g, or t
  misc_feature (246)..(246): n is a, c, g, or t
  misc_feature (254)..(254): n is a, c, g, or t
  misc_feature (299)..(299): n is a, c, g, or t
  misc_feature (305)..(305): n is a, c, g, or t
  misc_feature (307)..(307): n is a, c, g, or t
  misc_feature (317)..(317): n is a, c, g, or t
  misc_feature (350)..(350): n is a, c, g, or t
  misc_feature (374)..(374): n is a, c, g, or t
  misc_feature (403)..(403): n is a, c, g, or t
  misc_feature (408)..(408): n is a, c, g, or t
  misc_feature (431)..(434): n is a, c, g, or t
  misc_feature (467)..(467): n is a, c, g, or t
  misc_feature (484)..(484): n is a, c, g, or t
  misc_feature (503)..(503): n is a, c, g, or t
  misc_feature (511)..(511): n is a, c, g, or t
  misc_feature (537)..(537): n is a, c, g, or t
  misc_feature (573)..(573): n is a, c, g, or t
  misc_feature (592)..(592): n is a, c, g, or t
  misc_feature (596)..(596): n is a, c, g, or t
  misc_feature (623)..(623): n is a, c, g, or t
  misc_feature (687)..(687): n is a, c, g, or t
gtagtaaacaatttcattgatttttcttaaatcaaaccacctcataatcggaaaaantcaagaaaaaaaaaaaaaaaaaaaaaaannnaanncaaacacggaaannggcctacctgggctagaaatgnggcgccnggnctnggcatctggaatggcttttggacactgcctttaacaaatgagaaaanaaagcaccaaaacattgtgcttcagcagcaggttaggaaactccacaaagaaaggggngggggggnttcgaacacagatcccgagtgacccagttcagtcctcaaaacttntgagantntgggggggtntcctctccaaaactccctttcagagtgacttanagatgggggtccctttaggaaganccctcccacgaaccaggctgatagggatntgtgngcccacaccccagacacaggttnnnngggggccccaagcaggttcccagctggtcaganatgggtcaggaggggcnagggctttttctgggcgcncagccggngggccggggggcttccggtgcctgtngcctcactcctctcctcacggctccttcccattttnttcacgtggggatgaagantaantgctattggctggcaggacaagaaacncctgtaaacagcttgggtgctgctcacccaaatgtgcaggctcctttgtcagaaagcgattatngtcttagggacagggga

SEQ ID NO: 589123 - DNA, 815 bp, Homo sapiens
aaggctgtactggtctgggggtaatggatcgcgagctgttgcgtgggctgctgtgctagcgggcgcgggcgcgtgcgggttgcgagccgggaggcggcaggcgtagtacggagtacggcggcggcatggcggagagcgaggccgagacccccagaaccccgggggagttcgagagcaagtacttcgagttccatggcgtgctgtgcatgcctgcccttctgccgcgggaagatggagtgagatcgccaacttcccggtgcttgcccagcgacgtgtggatcgtcacctaccccaagtcctggcaccagcttgcttgcaggaggtggtctacttggtgagccagtgcgctgacccccgatgagatcggcttgagtgaagcatctgagcgatgcagctcccggtccatggagtacccacatgcggggcctggacatcatcaagggaactgacctctccccggctcatcaaggagccacccttgccctaaccgctttactgccctctgacctccacaatggagactccaaggtcatctatatggctcgcaaccccaaggatctggtggatgtcttatcatcagttccaccggtctctgcggaccatgagctaccgaggcacctttcacagaattctagccggagggttgactgactgataagcttgggctacggcatcctggtattgagcacgttgcagggagttctgggagcaccggcatggactcgacacgtgcatttctctcaaggtattgaggacagtgcatacggggacctggtgaccgattggtggaggcaggctggccagattcctggggt

SEQ ID NO: 589124 - DNA, 207 bp, Homo sapiens
tacacattttccaccccttttttttaaaacaaaatttgggaacgcccgggaaaacccatctatgggcagggaaaaaaaaataaagagctcacaaaatgtgggaaaaaaaaaatctcatccccttttgttctctcgtattgtccctgttgcacctttccccttataaaaaacaccataaaaactctccccaaaaaaaaaaaacaaggg

SEQ ID NO: 589125 - DNA, 209 bp, Homo sapiens
  misc_feature (34)..(34): n is a, c, g, or t
tggccggacctattcatcggcacccatgtggatngtgagtcattaaccgctttcctgtccaaattacccagtctcaagtatgtctttattagtagcatgagaacagacacacagctattttgaattctctgtctgaaaggtcacatatgtctgtttctccaagattggtccctggtgccgatgaatagcgaggtgccgatgaatagcga

SEQ ID NO: 589126 - DNA, 715 bp, Homo sapiens
gagcagccgctgtaccccgcagagccgacagccccgggcatgttcctgagattttggggaacccgggccgagctccgggaacggcggcgggtacgagcggccccgtcgcagtccccggccgcagcgcgagtgcatgcccaggcgaggaaggttccaccctgtgtgccaaggcatcaacttcagtgagctggcacgtcatggagtctgcagtggatggtacagcctcagtttcctggtggcgctcagcgagttaccccatggccgtcgtgaccgtacccttcagtactagtcccgccactaggcctccgggccagcgacgttcattccgcggccctgtgagggcacggtactcccacgggagataactgatcgaacaggggctcgttgtgaaagcaacggtacggaatctgaccatacaacttgcgtacatgtactgaaagatacattcctggggccttgacaaggcagagtagcatttgaagagaagactgtcaggaaaagactacgcaaagggaatgctgcccagtacgtaggctttggtagacttgggaaggctcgctagcactggatcctcaatgcttgtcgatacaatctcctggcaagggaggcccaaaggaaggcgcggacacaaggacagatatccacgtgtgcacccaagcagaaccgaacacaagagcctccctgcccgtcccttgtacacttggtaattctccct

SEQ ID NO: 589127 - DNA, 413 bp, Homo sapiens
caggtcgtcgctgaacacgggttatttctggactcgtcaattctatgccacggatctacacatttatccttataccagtaccacagcgtctttttatttttatttttttgaaatggaatctcgctctgtcccccaggctggagtgcaatagcacgatctcgactcactgcaacctccacctcccgggttcaagggattcttgtgcctcagccctcccaagcagcttggactacaagtgtgcacccccacgcccggttaattcctgtattttgggtagagacaagatttcgccatgttgcccaggccggtctcgaactcctggcctcaagtaatcctcccgcctcggcatcccaaagtgctgggattacaggcatgagccaccgtgcccagtccaactctcctgactagagtgg

SEQ ID NO: 589128 - DNA, 418 bp, Homo sapiens
caaagtcaaacagtgccccactgcgcccagcctattttcttatattagatgtactattatttatttaaccgatgtcctataactgaaaagttaggtttgttttgttttttgcttggttggtatggctatgatgactgtccctgagcacttgtctgattacttccttcagcttgcctgctgaacatggaattgatggtctcaaggtcatcttttctgtaaaactctgtctatgttgctaaccaccttacactaaaatggtttgggttttcctttgttttccctaggggaaaaggctagcagcctttgggagtgctggatttcacacatctaccctccactggcaaaatttttatttcttctagtccatatccttatgaaatattctttatagaatgttgcttccttggcatttatcctc

SEQ ID NO: 589129 - DNA, 100 bp, Homo sapiens
ttgattttttttttaaattctggggggggggggggaaaaacccaattaaaaaccctggtttctttccatgtaagcattaaccagggtatgtaggtttcca

SEQ ID NO: 589130 - DNA, 696 bp, Homo sapiens
atggatgatgatgaaaatgatggagaacatgaggattatgacacaggatgaggaaggatgatgactgatcgatgaagatgacacaggactgggagatgagggtgaagatagtaatgcaagagaactggtagctgtctgatggcaatgatgttgttatgacacgctgatgatgctgagggtggtgatgggactgatctacggtacgcaaacagacaagaagagtatgggtggaggtgaaggtaatcacagagctggtgagttctcaaaacagtggtgaatggaaatacaggtgcgtagcatcaatcttcttttaactcgaggaggtttctagagaacaagagcccatcatcagcatctgaaagacaggcccctcgagcacctcagtcaccgagacgcccaccacatccacttcccccaagattgaccattcatgccccacctcaggagtagagaccaccaggttcagagaattcagatgacccgaaggcagtctgtacggacgtggcctaacagttgactccaggacataggtggcatgcaacagcatttgacgatgatgacagacgaacagattcctaggtactccaacctcttgtggtgcccacattcggtactgatggattgctgaagccaattcattcgccgaaggtaagctggtgtcccttagattccggtttggggcacttgaaagatatg

SEQ ID NO: 589131 - DNA, 374 bp, Homo sapiens
  misc_feature (326)..(326): n is a, c, g, or t
gacagaactggtgcttctgtggacttggccatttgcacagcacaagcagtgatggataactcctctgtctgtcccccaaatgcaactgtctgcgaaggcgattcctgcgtagtacctgagagcaacttcaatgcaattctcaatacagtgatgagcactgtgctcaccatcctcttagccatggtgatgttttctatggggtgcaatgtggaagtccacaagttcctaggacatataaagagaccatggggtatcttcgtgggcttcctctgtcagtttggaatcatgcctctccacaaggcttttatcctgtctgtggcctctgnatccttcctgtacaggctgtagttggtgctaattatgggttgctgccc

SEQ ID NO: 589132 - DNA, 857 bp, Homo sapiens
ccgagttaccgggatctgccctgtctgcagataccctcctctttccctgcctctccgagttctcccaccgtctgactggagcgtcctgggaggacacgtccaggcccggagggggcagctgagggctcgcctgtgccagtcgccgacggtggcgcgctccggtgcctgcgcgctgagtgtgctcatgtgctggtcagccactgggctgagtgcccgggacccaaggggagggggcaactgctggcgaccgtcggccctttgcgtcgctggcccgccccctcgcctgccagctcctagcccctgtcccccggagcggcgtccgtctcactcggttcaaggcagcgcgactgcgggtggcgcactgaccagggcgcaggaccattgggtgcgcgcggcacatggagatacggggctgacttgagagcccggcgccggtagagcagaggtcatcgtcactgacattacaaactacaacacgagcatagctccacggtgtgcagcgctacaaaagacacaagggatgccggggccattgcgacagcacagaaagaaccgatgagatggatgccttggtcgagattatgaggcccttacaaacagtgactaggaagaaatctacccaggtgatagatataggatgccatccgggaaccagacaaaagcccagagagcatataccaacgtgcattccccaatggttccccttggctcaccatggagagcaaggcacttccaacgtgttagtaaaaagaatacttagctattggaaagagacgacgacataaagccacgcaccaaaagattcccttaattgtacagggagcgcaagtcaacgaccttgagaactggaccaccac

SEQ ID NO: 589133 - DNA, 1786 bp, Homo sapiens
  misc_feature (264)..(264): n is a, c, g, or t
  misc_feature (300)..(300): n is a, c, g, or t
gccgaccgtcggagggcagagtggtgagttgctgggataatcggggggcggagtcccagcttagagccgaagcagtagaagtcacggcagcttgcctaatccatagatggtgggaggacgatgaaggaatagtcctggtaccgcgtgcggcgttggatgatgtcctggacgcagtgatcgtgtcagtgtatggactgccctcgtggacgtgaccagacaatcaatcccgcgagtcactgtccttgtacacagcacaatccattngcgatctatatgcatggacccatggactgtagaccntaccagagtggcgacacgtacatacgcatttggctgctcgacgttattgagccgtgtcacgcaatgccactaggaacaacgtcgtggatcgtgcagtgaagttactaggtggagggccgccaggggactgagacttggggagggcgttgctcataagtggcgcaaattgtttcccagtcggctatttccatagtgagagaactttctattagattcaccaaaagtaagaacatcgtttgcttgtccctaaatagcgcataatctctcgaaggcgtacgattactattaaaacctcggcgggttagttgctttgccgaagtctacgtaacttttcatcgtaatccgatgcccaatggcaaggaagatgcagtctagcactacaagggataattacagcggaaacctagcggcaccaacaagcgaggttgatagaaaggaacggcgagcggctgtaagccaaacggaacggcggtccggcaggtggaaaaaaggacttgaacttaactcgggaagagaaaccggtctttatcctttgtacaacctgtttccgctattgcggcgggccgttcccttgtaatggatggcaagcctggatttccaatcgcacttattactggaaaagcaacaccttcagaaggaatctgtagtaaactttcccgccaagtgtttcgcacccttgacattgcgctggagggaggcgttgtaaattggaacccaccatgtgtcttttgggatatgccacattgtggtaactcagagagaattttcttacacggtgtgactgtccccattaatcgtacctaactatggaacaggggctcttaccgatattacgtgccattctggttgtgcaacggggcgttcacgttcggttcgggaacccgttctgtggcttcattatggaggggagcgatacacttcctttagattcacaaagggtagaagcaaattctataccaaaatgcgcttcccagagcggaaaggggaatatccatacaacaacggcgaaaggcgcacgtctaccttcaacaagcctggcgcgcaacacaccacaaagaattgggcacacggtggaaatatggcgctccccgggtagccaactcagacagactgacatgggaccacgccaaatcaccaaatgtacggacatacaacacacccgagggcgccaaccaccttggatgaaggacgacaccgggcgaggaacagtgagaacagaaccggtggaaagtcaacaccgcagacaacggcgcggcagaaccagcatacgccgacgtggaaacaatcgatacggggtagcaccaaatgacgtcatgtgtttgcctcccaacactcggcagcgtgaagaccgccaactcaacgatccaaccacacgcatcacccacaacgagatgagacgctgacaagaagaaacacaaagagcacgacagcaccgacaagaaacagacgagagaccgaacagcgaggcacagcacacacgacaaat

SEQ ID NO: 589134 - DNA, 702 bp, Homo sapiens
gattacagtcaaaggggattgtctctgttaggcaggagtgggggtcacaaggtgctcagtgggggagcttttgagccaggatgagccaggagaaggaatttcacaaggtaatgtcatcagttaaggcaggcacgcgccattttcacttcttttgtgattcttcagttacttcaggccatctggatgcatacatgcaggtcacaggggatatgatggcttagcttgggctcagagacctgatattcctgtcctccactgtaagagttatccaaagctgggcatctgtgatggtccaggggcttccaaagtcatctggcagcatcagtcttcagccgctaagctgagaagatccgatttaaaattggtgagatgttccttgggctggttggtctgaggagcagagatcgtaggtggatcttatctcatggcagcaaacgagcaggaggacaaggggatcgatctccccaagggaggtcccctgatccgagtgatggcaaccaaatttcattcggcgtagctgtaatcccagcacatttaggaggccaaagccaggagaatccataagacgacccaggaagtacaagaccaggcctggggacacacacgcagcgcatactggatcaataagagcgcggagccgagcgcgtgcgtggcacggaggggcggagacgggatggtctggcactcggaacctgcggccca

SEQ ID NO: 589135 - DNA, 876 bp, Homo sapiens
tttatgtagtggtaatcaatgtgatttttacttttcatgtcaattttaattggaacatttcatatttacatgtactatacttcatcttccttatgtgtgttggaatgatttccttttattattatcttttacatttttccttttttttttttttttttttggagagggggtcccgctcggtaggcccaggctgggagtgggtgcagtggtgcgatctgggctcatgggcaacctccacccgcctagttcaagcgattctccggcctcagcctcctggagtagctggggattacagatgctggccaccacgccgggctaattttttttttttggaaagggagtcttcgtctgttgcccaggctggatgtgcaggggcccgatctgggtcactgggaacctcggcctccggggtccaggtgatcctcggggcacacagcgtccttaaggaaggggggatcacgggcagcgcgcccacaaggccgggactaattggggaattatagacagagacggggtttggccatgtgggccaggcggtctgggaagtccggacctaaggtgacccacggttaagctccgaagggggggataacaggggtgagccacgggcaaggccaattaagggttgcagagaaagtgggggtcaagcaaacggggcggggggcctgaactccggactcaggtgaccaagggctcggccccaaagggggggtacggggtgagcacgggcagtggagcaattaagtacaaaggcttggacctgttacacagtggcggacgcaggggcagggcgggagcaccgggtggatataaccagggtaaaggaaggggcacggaaagggcacaggggaagtcacaaggaggtgcaccttgaaa

SEQ ID NO: 589136 - DNA, 741 bp, Homo sapiens
agcggaggagatctaactaaaatcatttatgacagtagcaagagtaaacaacagattttcaatgtagagggaatagccttctactggaagaagatgccatctaggactttcatggctagagagtagaagtcaatgcctacttccagagcttctaaggacaggctgactttttttcttaggactagtgaagctagtaattttaagttgaagtcaatgctcatttaccattctgaaaatcctagggcccttaacaattatactaaagctactctgcctgtgctctacaaatggaaccacaaggcatggcaacacatctgtttacagcgtggtttattgaatattttaacatgactgttgagatctactgtttagaaaaaaaagattcctttcaaaacgctactgctcattgacaatgcaactggtcacccaagagctctgatggagatgtacaaggaaatgaatattgcttttatgcctgctaacacaacatccattctgcagcctgtgggtcaagagtaattactttccactttcaagtcttattatttaaaaaatacatttggtaagtctatagctgccatacatagctattcctctgatggatctgggcaagtaaatggaaaacctggacaggattcacaatctagatgccactaagaacacttgtatttcatgggaggaagtgaaaatatcaagattaacaagagttaggaaaaagtttattccaaacctcagagatga

SEQ ID NO: 589137 - DNA, 141 bp, Homo sapiens
aaaataagatgcacaaactgtaacttaaaactggaagtgaataggagaagtagggaagaagaaaagaaagaaagaggaagaaaaattagttgatggttaactaattcttccttaggctattcattttccatcattattaca

SEQ ID NO: 589138 - DNA, 343 bp, Homo sapiens
  misc_feature (51)..(51): n is a, c, g, or t
gatgaaattatgtatgtgtgtgcacatgggcaagcatgtatctggaggtanagccatcttgatacctttaaacaatgtgaaaatcagattctgctcagccctgtgagcccaggctctgcatctctaatcctttcaaatgtctctccctggcctcagtagcttcttccccagcatatgctaacagtgttcaacagaatccccaaggggcaccctcctcagagcccacaatggaaggagacagccaacatccaaaagctgtcctctgatctacacacgcacaaaacacatacacacacatacacacgacagtaataaataaaaggaaactttaaaaggtcgacgc

SEQ ID NO: 589139 - DNA, 411 bp, Homo sapiens
tgctgtcgatgtattactgagtgtaagtactataaggtagtgactcctttgacgatttctaccaggcacacactttattaaggaatctctttgtgcctcgacctttttattagtgactaatctggaatttttatcaagtgacgtattgtactgtttttcgtgtttccgagtaagtctcttgtataaacaacaagaggttgtgacattatcaatattaaagtggtactgtttgtggtctgtaattctaattcgattgtgaccacaaagaaaacgagggggggaaaatttttgttttatatattgacgtacagtgatatcgttgtaggttttgtctagttaaacaatgttagtgataaaccatctcgtttgaaatgggggttttcctttttaatttaattttttttttttgga

SEQ ID NO: 589140 - DNA, 686 bp, Homo sapiens
  misc_feature (506)..(506): n is a, c, g, or t
  misc_feature (525)..(525): n is a, c, g, or t
  misc_feature (614)..(614): n is a, c, g, or t
atggcctcgggtcggtgggcttctccaggcccagcttgggcctcccggcggcctctgcaggctcaagtggtcctgaagtcagcctctccaggcccagttccggcctcccagcaagcaagctcttttggctcagctcctgcccagctcccgccggcttttgtagaccctgaactttctccagcgaagctcctcagtcccacctcctgcctcccggtggcctgtacaggcccaggtctggctggagaacagcctctgcaggccccgctcttgcctcccaggggcgtctccaggcccagctctggcctcacggcggcctcccgggaccaagtccctgcctgcctcccagcagcctgtgtgcggcccagctcctccgtcacggtggcctgttgaggcccaactcatgcctctggcaccctttcgagaggcgtgagcccctgcctcacgttggcctctctcacgctgagggaggtcagcgtgagcccctgcctcacactggcctctctcangctgagggaggtcaggtgngcccctgcctcacactggcctctctcacgctgagggaggtcaggctagccctgcctcacactggcctctctcacgctgagggaggtcangctagccctgcctcacactggcctctctcacgctgagagaagtcctccctcgctgcctgttgaggcccaagt

SEQ ID NO: 589141 - DNA, 334 bp, Homo sapiens
ttagcgctgtcaagtgactagcaagtgagtggggttgattctgtcctaactaccctgcatatgtcaggctcagtcagcaaaggtatagatgttgctctaaggctgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgat

SEQ ID NO: 589142 - DNA, 200 bp, Homo sapiens
  misc_feature (1)..(1): n is a, c, g, or t
ngaggtggcgtggtttgtctgccccttaaaaactcatgttgaaacttcatctccagtgtggcagtactgagaggggaggctttaagaggtggctggatcatgagggctttgccctcaagagattaatccactcatggattaatgacttcaggggttagtcgcttaatgggttatcatgggaggagaacgcgtcaaaatcg

SEQ ID NO: 589143 - DNA, 392 bp, Homo sapiens
  misc_feature (6)..(6): n is a, c, g, or t
  misc_feature (39)..(39): n is a, c, g, or t
ggaaanttgtgaggtaattaaatagtttccactgttttnccccctaaaaagggaagaagtttcctcactgaataattttacctgcttttcctacccaatcaaatcttgtaacagtgaagttttgtaggatatattttcctctctttttaaagtataatttcctagttgcattgtggttttattataggtttacgaatccttagtaggaacataatgtcttagggaaagtcgtagctggtaatcaacattcctttagtaaatattttttcatgtttcaggggcttgggatacaaaaataaatgcatttgaatgagcttgcaatatagaagcgtgtccagttttttaataaatgctgactcgattttttttaacttacacatactaaaaaaaaa

SEQ ID NO: 589144 - DNA, 438 bp, Homo sapiens
ggcgtccttatgtagccagaactacaggtgtgtgccacatgagcgcaaataatgttgtgtttctttctcctctgagatggagtctccctccgtcacccaggctggagtacagcggtgtgatctcagctcactgcaacctctgcctcctgggttcaagtgattatcctgcctcagcctcccaagtaactaggactataggtgcacaccaccaagcttggctaatttttgtatttttagtggagatggggtttcaccatgttggccaggctgcttttgcactcctgacctcaagtgatctgcccaccttggactcccaaagtgtcattaggtgctgggattacaggacagctaccgtgcccactctaatttttaaatttatggtagataaggggtcttgctatgttgcccaggctggtctcaaactcctagcctcaggtg

SEQ ID NO: 589145 - DNA, 735 bp, Homo sapiens
ccggcacgtgtctcggcacgtggcagcgcgcctgtgcccgtgggctttggaggcgcctggcgcctgaatcccgcctaccgtggtcgccctgaagtcgggtgtcgtccttgaccatcgccgacgcgttcattgcagccggcgagagctcagtctcggacccctatgtgcccggggttcccaggagggttcatcgttgctcccttcccttgacgtgcagcgcacaaatttaacaggcaaacagctgaaaatgctggacggcgcacccttggttgtagggcacacggggggaaggacgaccatttggtgcggtgacctaatgaaggggtgtggtgggcaagggccttttcatcaggcggaacttaccccaattttgagcccggccaaatttctggacctcaacaaccgggaagaaacacgccggttgggtgggggtgccagccccaattggggctgtgtgcattcaacaattttccaagcacgaaaatttcaacacgtgtggacacaaactcttttgtgggagcggccaacgcttttggaaacacttccaccaagaaccacaattaattattaatggccggtttgggaacgactctgggtaggaaaggacctctttgaaggaaacccatttcaggcgagggtgggaaaaattcccatccggtggcccacgattaccccaatgaaaccctcctattcagggttgtcccccagggaaggtggtggggacacacctttggc

SEQ ID NO: 589146 - DNA, 192 bp, Homo sapiens
gtgacacttttcttcagaagctggtcgccgccgcagctaccagagattcactgactgctatagtgcttctaccagttgcagcctgcgattgacacagcgaatctatgacaagtttatagctcagttgcagacatctatccgggagatatctctgacatcatagaggaggggacctagaagatgtattaaata

SEQ ID NO: 589147 - DNA, 108 bp, Homo sapiens
gaggattgaggaggagagaggaaccggacccggaggagttgtgggtccatagcgatgtgcggggtagagagagtgagagtcagggctttagagtgtttttctagagag

SEQ ID NO: 589148 - DNA, 247 bp, Homo sapiens
cgcatggggtctgtaggaggagcggatgaggcgtgagcagatagaacggaggctgcagagtgagagtgcccgtaggcagccgctggtcgagaaggaggtcatgatgcgggagaaacaattttcgcaggcacgacccctgacccgttacctgccaatccggaaggaggactttgacctgaagacacatatagagtcatcgggcgcatggtgttagatacctgcctgcacgtggagctcagcagcaagg

SEQ ID NO: 589149 - DNA, 118 bp, Homo sapiens
cttgcgtgatatcttctaatccttccgtcctcttcatcatcatcatcatcttcttctccttctccttcttcgtcatgccatatcgggaaccaagtagtagctgaatgcgtccgtgggc

SEQ ID NO: 589150 - DNA, 666 bp, Homo sapiens
tgcagtggctcacacctgtaatcccagcactttgggaggctgagacaggcagatcacgagctcaggagtttgagactaaaaatagtgaagctccgtctgtactaaaaatacaaaaaattagccaggtgcctctaatcccagctagttgggaggctgaggcaggagaatcatttgaacccaggaggcggaggttgcagtaagccgagatcgcaccactgcactccagcctgggtgacacagcgagactccatctcaaaaaaaaaaaaaggacaaagttattagattattagccattggacattagacattaattcattagacccggaacaaaaaaacctgtggaccattagacattacccgtgagaccaaagacacaaaccacagagaaaaagaaaagagacttagacaccagacaccattagaccttagaccaagaaccgaaaattttcgatttttgaacaagagactttaaaccacagaccttagaaaagacttgacacggtgggggccacagtgggctcacgcctggtaatcccagtacttggggagcgccagggggttggctcatgaagtcaggagttcaagaccagcctgccaacttggtgaaacctcgtctctactaaattgccaatgttacccaggcttggtggcgtgccctgtagtcca

SEQ ID NO: 589151 - DNA, 393 bp, Homo sapiens
tgcctagggtggctgccctctgccagggccaatgtgacagcctcttttaggtacccacactcggtgggtcccaagctcttgtcagcatccaagaagaatgaggtcacccggacacttgaaggatggtgaaggtggagaattttattaagcaatggaaatggctctccatggagaggggagctggagaggggatgggtcaggtggggaatcttcctctggtccaggtgtctggctggctcttccctgaagtcaggacgtctttccgaagttaaaccgtctctccttggaagtccagccatccctctgaagtcaagtcacctgtttccagtgaagctacttctctctcactaccaagtctggggtctttataggcaccagagaggggcggagcag

SEQ ID NO: 589152 - DNA, 261 bp, Homo sapiens
cccctttttgggggggggggcccccccccccggtttttaaaaaaagggggctctttttttttccccgggtgaaaaagggttttttttgggcccacggaaccttttttgggccccccccccggggtgaggggttttttccccttttgggggtccccttccgggtttggggggggcccggggggggggggggtttttccccttttttccgggggggggcccccccccccccccccccccccttaagggtttttttttttttta

SEQ ID NO: 589153 - DNA, 590 bp, Homo sapiens
  misc_feature (369)..(369): n is a, c, g, or t
  misc_feature (510)..(510): n is a, c, g, or t
  misc_feature (536)..(536): n is a, c, g, or t
gacctgcctcttctcaccaagatgaactcactggtttcttggcagctactgcttttcctctgtgccacccactttggggagccattagaaaaggtggcctctgtggggaattctagacccacaggccagcagctagaattcccgtgcctcctggcccccggggagcagagcctgccgtgcaccgagaggaagccagctgctactgccaggctgagccctccggggaacttcgttgtcccgaccccccgagagctccgggagcccccagcagctcggcctgtccgccccccacagccgccagaattcccccaccccagggcgcggtgctggtgcagcgggagaaggacctgccgaactacaactggaacntcttcggcctgcgcttcggcaagcgggaggcggccccagggaaccacggcagaagcgctgggcggggctgagggcgcaggtgcggggcagtgaacttcagaccccaaaggagtcagagcatgcggggcgggggcggggggngggcaacgtagggctaagggaggggncgctggagcttccaacccgaggcaataaaagaaatgttgcgtaactcaaaaaaa

SEQ ID NO: 589154 - DNA, 80 bp, Homo sapiens
  misc_feature (7)..(7): n is a, c, g, or t
  misc_feature (42)..(42): n is a, c, g, or t
cacccgncccggcccaggctagggccggatggtcgttgtccntgcactccggcgactgcgctaaactcccaactcctccc

SEQ ID NO: 589155 - DNA, 549 bp, Homo sapiens
gtagatgagactgacaacagaattttaaataacatttgtcttactcacaacagtgttcatcaagcttcaagcatggcaagaggacaaaatgttttgacattcacctaaagcaatcatgcaactctatgtacaggtatatgcatggtaggccctgcaacttgcagccaacatctgtcacatcacttttatcaggtcacaaagccatgttcttttatatagcctgtagactattcaaaatacaaaacatgtggtcaatggatcaacaactatacacaaagccctccacacttcaaatactagtcctggattgatgacagaggcagcacaattcaaacatttcatctagcaatcctaatggttcaacattttaccaggaacagacctgccactctcttgaaatactgtctctgagattaacatacgaacagcatcatctctgtaggaaggctacattcccttatgatgctgatatgtgtgtgtgtgtgtgtagtgtatggtattcgagatatgggtctctaagtgtccaggtaggcacagcacggggatcct

SEQ ID NO: 589156 - DNA, 930 bp, Homo sapiens
ggctcacttccccttccactggtgccccaggactttccctgcggtgggggccttcgacagtgagggccatccgctcagctcgatcgctgagggcagcgtccaaaggggaccccaaaggtgcccacgcggggctgggtggcctccatggtgcgtacgttgggagcggcactaccggctcgcgtggtcctgagctgtcaagactctccaaagcctggcgctgatgaggagcggggacaggcttagacgcgggtcatccagacagtggacggtgtccaggctgcctacatttctgcccggatcctctggcgtcctcatctctccggtctccgcagactaaagccctcgggatatgcagtgagccatgtgtgtgcaaggcgctgagccccggagcccccgtccgacacccgacctaccttgccagactgcggatcagggccctgggtacctgctacggggggacgggagatggggcgagccggaaagcgagcgctgcggagcgcctggaggccgacagggcggggtcacgtcaaggagcgctgcagcgtgggcaaacacccgcaaggaggccggtgtggagcccgggtgtccaaacagaacggtcttcaggacctgagactcggccggtacagggcgtcaagcacgagcaagcggagccatgcctggcacctgcagagtgggacaagatgcacctgggcatcctcaggagtctaatcgagttgtgtgacaagcccgtgtcccctgcgaggcagcgagccactggaagggacgacggagcgggagtctaacagaggaaccatcggaacgcagcagaagggatggacaacgggtgagagcagcccagcgaatggaggcagacggacacaccggaagaagggtaacagcataagcaggttgaagcccgagagaacaaagagagaaagcggaaagaga

SEQ ID NO: 589157 - DNA, 728 bp, Homo sapiens
  misc_feature (383)..(383): n is a, c, g, or t
  misc_feature (621)..(621): n is a, c, g, or t
agcggggcagtgccagctgtcggcactcgcggccgctgtgccagtgtctcggtggaccctgctgaacaggtgtggccctgaagaaggagcgtcgcgtgagatcgctgcatcactcaccctagaaggatgaagttgaaatccgatagcagctaggaaccctgatcctggcaaaagattgatagcagttctgcttgagttcctgtctgagcctggattctggactctgggaaggtgctaggcggggtcctgttcttccgttctgggtgtggaactcttgatggtagacacagcattgggcctggatgccaggatgagaggcatagtacagtacctgtgctgtggcactggtcgttgcgctcaggtgactacccgggcaacccgtncacgtcgttcccattcgtggctccgttgatacagtccactggatcagacgtgctgaacccatgcatcatcatccgatcatgtgtaggtcatgtgtggcgacctggagtgacgaaagctcgtctgcgcctttcgtacgtaacttccacagggttacagagtgagcgtccagcattgtggccttgattgctccttgcacatcgtgcccgatgccagggcttcgtgaccgaatctagcagnctcaagtcaaattcagtctggaaacttggttgctgtaagaaggctgtcttttcaccctctataacgtgagggacttactgttcctaaactgttgactaaagtggggg

SEQ ID NO: 589158 - DNA, 1051 bp, Homo sapiens
  misc_feature (732)..(732): n is a, c, g, or t
cagtttgtattgttacgctcgtccaggtgcagttcttcttcgaatagctcattgacgagtggcgttatggcttgcacgtatatgtgtcctacaattttctcgtagttgtgatagatgttggacctgacatacaaagctaaaatatgttggctgaaggttccagcggtggcacattcgccgccggagagattgggtggactattaatcagactgcacaagagaaaaagccgcgttccgtctactgtccggggctcgagagacagcctcatcggctacaggcccgtgagcgtgagtgtttagtaaaacattgcggtccgattactgcaggagacctcgcacgctgagcgtgcgtacagtcccggaatatgcgtagcctttgcacgcataatttagagtttgatgcgggatgagtcagcgcaccgatgttcataaaaaccgatcgatcccagcgttttctagaaagcggcaaactcatcggttcgcgagcttcgccaggagaaagcgtagccgatagagcgagtaccgtggtacgcaactctcgctacggaagagtaccgacacgcgttgtgtagccaattaccacagctacacgaagacgctcgacccaatccgatttgctcgccccgaagaccatccccagttagccatccagcctcgtgataacggagggggcacgaggaagattgccttaacttaggatccgccagttaaaacattcgttctgatacgagntagaattcctattcggtgctaggcaaatacctttggtgcccaaggtaaggctgagctttaatttccgtgactgcacaaattaggcgtattaatatagattgcggttgcgagcttataagttcttgccaatctggactcttgcggaaatgaagtggaaagcatcgcgactgggtaacaaaaccaccggtgctgtccacggcctcgttgctatgaagtgcccacttgctgatcttaccaacggagtggatgaaagccttgagttcattaagcatagttctgtgttaagatgccggctcctgtaatcccaaaggtacacgta

SEQ ID NO: 589159 - DNA, 186 bp, Homo sapiens
ccccttgaacccccccctcccgggtttttgccttttttctgcccaaaccttcggggggggtaggaactaagggcccccccccccccccgggccaaatttttgggccttttttttttttaaaaagaaaaaggggttttccccggtgtacccaagggggtctcctttttataccctgggaaccccccc

SEQ ID NO: 589160 - DNA, 183 bp, Homo sapiens
cgtgtagctccctgtgttgcccgttagccccgtgtcgtccctgtgtagccccgtgtagcccctgtgtagtccctgtgtagctcccgtgtagcccctgtgtagcccctgtgtcagctccctgtgtagctccctagtgtatgcccctgtagtagcccctgtgtatgccccaggtagtagtccctg

SEQ ID NO: 589161 - DNA, 133 bp, Homo sapiens
catcgcgccatctctgcttctgcttcctcttcttctgaagtcacttctatcagtgtcccattctgacccgtgggtagtggttgatctagctatctacaacagtccacggtgctatcaggacaggttatactaa

SEQ ID NO: 589162 - DNA, 144 bp, Homo sapiens
gatgcacaccaccatccatcagagcacatccatccttctccaacacattcagccatcgcatcacacaacagttcattgtccgtctccaacagcacaacacatcaattcgtattcgtcgccgtcacctgcagcactcagcatcca

SEQ ID NO: 589163 - DNA, 144 bp, Homo sapiens
acaggatcttcaacttcgacggacgcattcactgctaaaaaccctcaataaattaggtattgatgggacatatttcaaaataataagagctgtctatgacaaacccagagccaatatcatactgaatggtcgtcgaagggggta

SEQ ID NO: 589164 - DNA, 799 bp, Homo sapiens
  misc_feature (37)..(37): n is a, c, g, or t
  misc_feature (475)..(475): n is a, c, g, or t
  misc_feature (717)..(717): n is a, c, g, or t
  misc_feature (744)..(744): n is a, c, g, or t
  misc_feature (772)..(772): n is a, c, g, or t
  misc_feature (784)..(784): n is a, c, g, or t
  misc_feature (798)..(798): n is a, c, g, or t
tcgtgtaataccagtacagatgaagagatgagactgncaagcttcaaatgctttgcccacggtcaactagttagtgagtgacatggtgggatatgaactgtaatttcagaatccatcctttcattcctaatcgctgtactgcctccttagaagttgcccaagccaaagaaatggtttggttattgtttgttttgaggtttagaggaatattattgggggataatagttatcactaaagatttaaagttggttaaaagaaggggagactagacttgttctatgttgtagcagttagaaatgttttagaaataaattgggacatctgctgttttctaatgacattttaaatttcttaaatttacccccaccccaaatctctatgctataggtaaaattctatgccataaagaaaattcaattttttttcatttaaaaaatgacatttaaagtttttattgatttatttatttatttngagacagagtctcgctccctcgcccaggctggagtgcggtggccgattcttggctcactgcaagctccgcctcccaggttcacaccattctcctgcctcagcctccctagtagctggggactacagggcacctgccaccacgcctggctaaatttttttgtatttttagtaggagacggggttttcactgtgttagccagggatggtcttcgatcttcctggaccttgtggatcttgcctgncttcggttttcccaaagtgctgggggnttacagggctgacaacttggcacccganccttaagttttnatttaatttaattnc

SEQ ID NO: 589165 - DNA, 276 bp, Homo sapiens
  misc_feature (240)..(240): n is a, c, g, or t
taaatcagctcggtacctggcgatgtcgcgtgcatgtttgtgtacacgttagagcatggtatcttggaaaaatcagtctttctttctttctttctctctctttctttctttttcttttttttttttttttggaaacgggttctggctctgtcacccaggtgggagtgcaggggcttgatcagggctcacggcagccttgaccttcttgggctcaagcaatttccccacctcagcctcgcngagtagctaggactactgtggcacgcgacatcgccg

SEQ ID NO: 589166 - DNA, 148 bp, Homo sapiens
gtatagtcgggtcatcacgatcagctgggtttttggtttagtcatctagatgtcggtctggactaagaggtctttcagtgtctcctatgccctgtgagttgctgttgaaccatccccaccctgaatttgcctcagttgtcctagagcc

SEQ ID NO: 589167 - DNA, 130 bp, Homo sapiens
  misc_feature (47)..(47): n is a, c, g, or t
  misc_feature (74)..(74): n is a, c, g, or t
  misc_feature (107)..(107): n is a, c, g, or t
gcactccagtctgggcgacagagcaatactccgtctccaaaaaaacnttaactacattttatctatttactatnttttatatgggtaagaccagtggtcatcccgtntttcttttgaaagcccacttttg

SEQ ID NO: 589168 - DNA, 211 bp, Homo sapiens
  misc_feature (133)..(133): n is a, c, g, or t
  misc_feature (163)..(163): n is a, c, g, or t
ggcatgggctacacctgtacagtagcagttgtctggatggatcactggtcccttgacgacagaagattgtccctattggaatgaggtggagatctggtctggggggggcagctggggaagcatttgactatcnggaacttgtgtgtgcctcctcaggtatggnagtgactcacctggttttaataaaacaacctgcaacatctcaaaaaaa

SEQ ID NO: 589169 - DNA, 464 bp, Homo sapiens
cacggacgcgaagtcctcctccagagagttgtacaaggctcatgatatacatacgtgtatgtgaatgtagctgatgggtgtccggtggttgcagaagtgataatgtgtgtaaacagatggtgtggttggctcatcggaggggtggaggccctaagtgggatgacctctgaggtttactcttcctagagtagttggaaagcaattcagcctcagtggtaagctctcagctcttctagggcaggtccctcttccaccaccctgtgtctgcaagcattttggtattaagttgtttttctaaggctgggtgcggtggctcacgcctgtaatcccagcacttttggaggccgaggtgggtggatcacctgagatcaggagttcgagaccagcctgaccaacatggtgaaaccatatctctactaaaaataaaagattggctgagcgtggtggtgtgcgcctgtaatccc

SEQ ID NO: 589170 - DNA, 427 bp, Homo sapiens
tatgcttgctcccttttctctgcataagatgatacgccaattggaagagatgcttcatgtaactcactaaaaatcacttaatactcctcactgacacacatactcgttctccctaccatcagcagatggcacatatgttcccctcgtcttaaatatcagtgcctctgggttctgatcctgctcccgtccttccttctcgatggtggtgctcctgcaattctcttcccaactccagcatcaccaagcctctcccgttttctaaacatctctctacaataagcactttaaaatccttcagaatcttccatttaaaaattaaaaacaggccaggcatggtggctcacacctgctgtcccagcacattgggaggccaatgtgggcagatcgcctgagtataggagttcaagaccagccagagcaacatggt

SEQ ID NO: 589171 - DNA, 868 bp, Homo sapiens
tattgtgtaacctcaccaagggtttttttaaattcccattaaaaatattgtccgaggaaaagataggtcacaagaaggggttataaagggggtgacagcccatctaaaagggggagcgggagataatgacagtagtaaagtagcaaccaaagattcacttccaagggcaaagggtggagaggagatcatatggcgaccaaaatttatcccatacaaaagcacatggcgatcaagagtttccataagatggaaaacaacacacccttacttcatagcatcttaccacgtctacttacacaattagcccataaacaccctcgggcggatggggatggcgagtcaccagaactctccccgaaggagggaactcatttagctatagaagaactccatttaattccacatatcacagtggctggggcgcgcatcaggggctaggaaccctaagaaaaacgcgcaatccacagatgaaagtctcctcgtggaccattatatttcttcacgagataaatatcctaggtctaacatctgagtgggaggggtggcatgcagcacacaacaacggcggtcggggtctttacaagaatctttcatccacgggtagagacatctgggtctcaacatgcggggataaaactacacccaaaatcccctctgactcaagtgatcatggatcaaccgggggcactgaggtcgaagaacctcctcggtggatcttagaggccccagtttcgtacggaatagaggcgacaccccatagacagggggaaccccagggcgctggtgcacacacttaaacacaaaccacggatggcccttaaatctgggagagacacggccacaatgttcccaaacatgggatacggcc

SEQ ID NO: 589172 - DNA, 1115 bp, Homo sapiens
agcgggaccggcggtggccacatgcagcgatagcgagaggctggagcgcggcgtaggtggctgccgagtctttggctgtgtgagggtctctagtcctggcgatggaaggcgccgggagctggcggctctgtggacgagcgtaggagactgtggagtggtggctggcgttctttggagatcccacaatgtagtccaagtggttatcgatcgcccgagcagtggcgtggcggccggcaggacagcagacctttttgcatgcgaccgtctgcctcgaagcgctagatgagaacgaacgggctgcgcaacaactcacgatccccgtagaatggttggataggacatatactgcacctagttgggatcagcgtgatgcctgggacactgcagttgtgcatatggcattatgcgaaaggtttcctcttcgccaataacgagttctttggacaagaggaacactctgcgtccaagcacagaattggcttttgcctccttatggcattctatgtttgcaacaaaggcatgccgtgaggatactaacacatggcaatgcaactatggggactggatctaattggatatgtaaagcaacttagtgacatcgataacgttctattactaaagacgcaatggatgggattgtggcctcgaggaacagcttggttttgccttgtgacttgtaagaaaaacaatgtgtttctaatcaagttggggcagcaattcgaaagggtggcccttgggactggattggacggaccttagtcttatttacagagctttcctaacaaagcgatggggcgttgctgttaaatcgtggggtttctttatgggagatacgcaaaaacacttagatagggacttgaaagtcggaagtgatacaaggtattagtggtggggattaggtacattaatctagtgatgaaccccctaatgggggttttaaaaaacacacggtgaaacgttgggagcatgaactcgttcgatttttttggccaaggagtaatttttggaattcgaattgttaagggaaagggggcggtttgaagggcccgaaggacttggatgtggcaagatttgggaaactttaatttcgaaaattaagggttggctcggggggg

SEQ ID NO: 589173 - DNA, 394 bp, Homo sapiens
cacgagggaattaaggaggaagccacctggcttcctaagatagactttatggttaatgggatttattttagctggttaagtccaggacccctaccaggaagaactgaggtccatatttgaggttgggctcacccttttgcatgtggtcctactaataataattttgctgtaaagaagcctcaataaggagatggactgtgtgaaaagagatgagaaagcaggcctgtttgcaaggctggcccttggctggcatctgaaagcttggatttcaggagggttctcattactccctaaatgataagagtgggtcactgtgcctaaactgttcgtacaaacaatgtgggttatgcccaacatctgctttccttctgggagtcagattttcatatgtgtt

SEQ ID NO: 589174 - DNA, 444 bp, Homo sapiens
gtacatctctacaaaaaattacgacaggtttgctaggtgcgctcagctacttcgggggctgaggtggagaggatcacctgagcgcagaaagtcaagactgcagtgagctgagattatgccactgcactctagcctaggcaacataacaaaaccctgtaaaaatatatagacagccaagcgtggtggcacatgcctgtaatcccagctactcgggaggctgaggcaggagaatcacttgaatccaggaggcggaggttgtggtacgccgagagtgcaccattgcactccagcctgggcaacaagagtgaaactctgtctcaaaaaaagaaaagaaaaagggcagggcgctgtggttcacacctgtaatcccagcactttgggaggccaaggcgggcggatcacgaggtcagaagatcaagaccatcctggctaacacagtgaaac

SEQ ID NO: 589175 - DNA, 520 bp, Homo sapiens
atatatgtatttttaattgattggattatacacgtcccagcctcttgtaaccactattctactctacttctatgagatcaacttttttagtttctaaatgtgagtgaggacatgtggtatttgtctttctgtgcctaatttcacttagcatcatgtcctccaggctcatccatattgccgcagataatagaatttcattctttttaatggctgaataatattccattgtgtatatatacgacattttctttatccattcatctgttgatggacacttaggttgattgcatatcttggctagtgtaaatactgttgccgtaaatatgagtgtgcagatatttctttgacatactaattttctttcttttggatatatattcagtagacagattgctggatcatatggtagtttaatttcacagtaagaagtgcaaatattataattttggttgttaattttatctgctttttcatccctaagtagtggaattagatttgttttttacactgggtttattga

SEQ ID NO: 589176 - DNA, 207 bp, Homo sapiens
gggagacgatgagaacctagtctcgtagttcagtttgattatgtgcaatgaatgtccaagctggagttctccatttatctcatgttatccccaggtttccacaggcgtggtgatgtttgagtcctcttactaagtcgggtgcgtgcgacgcgacccgagagcgagccgggagcactctgattgtagcacgtatgcgagtggtagaca

SEQ ID NO: 589177 - DNA, 442 bp, Homo sapiens
  misc_feature (93)..(93): n is a, c, g, or t
catagtaagttcttccctgtcagtaattattttaaatgcaaatagattaaagtccccaattaaaagacagagattagctgaatggactaaaanccaggatccaactatatgccatctacaagagtcccactttatatcttttcaaataccaaactcttgtggccaggtgcaatggctcacgcctgtaattccagcactttgggagaccaatgtggaaggattgcttgaagtcaggagttcaggaccagcctggacaacatagaaagactcttgtctctaaaaaagttttttacttagtaggcatagtaacacacacctgttgtcccagctactgtggaggttgaggtgggaggatcccgtgagcccaggagttctaggctgcagtaggctatcatagtgccactgcactccagttgggtgacatagcaagaccctgtctcta

SEQ ID NO: 589178 - DNA, 379 bp, Homo sapiens
gggggccaatccggcctcaggcacgcaccggagccgcctttccgggcctcaggcggattctccggcgcggcccggagcgcgttgcgactcccgtggttgcggccccggctccattggcctgatcctgatgtggatgatcgcagtggtccgtatgcctgacttcccaggaatctggctgcaggtcggcggcgaggggtcgagactcgttactagacagcgggagagacctcacgtctgtcagccgccctcacaggaaagatgctgcgtctagaaggggcgaccccatgagccatgggtgtgcactgtgggtgcagcactgggagcactgtggtgcatgcctcacaggatccctgaaaggtccaggtcccttgaagagcca

SEQ ID NO: 589179 - DNA, 1037 bp, Homo sapiens
taaaaggggggttttttttccccccccccctttttccccgggtgttaaaacccctttccaaaaacttttaaaccccccgggggggcggcccccccccctcggggcccggacgcgggggggcctgcaccaccatcttctcctccggggggagggagctatcgacgccgcctcccactcttttcatagacggacagatttggcgtagaaaacggcaccacagagaggagcccctatcgataccctctctatcgacgcacccatctgctgccaccgctcacgaggcgtagtactacccagacgagacacctcagagagacgtgagtgagatgctcctactatcccccgacgagaactctcctctcatatgagcgacacgcgtctctctctctctcgtagatacgcagctccaacgcctgttgctatctctcctctctctttatttactatatctctctcttctagcgagaatcaccttcgtgaataaaccatatcaatcaatcgaactcatccgagacgctagctgaccctccctcccacgatgggtgtgtgtttcaccagcgaggacagacatgtgaggcgccccgcccgcacgatgtgctcgccaacaaaatatatctctcccgcaacgacctaccagactcatctcgacccaacccactaattataatcacgccccccgccacgcgagagacgaaatgaccacctctacgcgctctgcgtaggagaactgcgacgacgcgcgggagagcaggccccaacagctcgccagcccaccacactactcagcccgccacaagcgacgagcaacacacaactctgcgagtagctatcccaacacgacgccagcgcgcgcgacgacggcgcgcctcgagacgaaacggctgcgtaccaccctcaaactgcagagaacagaccgtccgcgcgggcgagcaaacgagcgcaggtatgtgagttgagtcaaccccccacctgggaaggggcaaccaccaccaccccccacaaacaaacaccggccgctagcgcccacgcgcgaaagg

SEQ ID NO: 589180 - DNA, 270 bp, Homo sapiens
cgagaatgcacagtatagtgtcgttatgcttcatgacaggacatatgatatccttggagcaaaatggaggacacagcgtgtttagcagctgattgtacgtattccctcaaacatcttgcttcctgaagataaatgtcaggagacaccttatagtgaggaagattttcagcatctccagaaagagattgaacagttacaggagaagtacaagactgaattatgtactaagcaggcccttcttgcagaattagaagagcaaaaaattgttca

SEQ ID NO: 589181 - DNA, 191 bp, Homo sapiens
gttagcacgtttaggacccgaaagcatggtgaagcatgcctggtcagtgacgaagaagagaaaactctggtggagtgtcgtagctgtctgacgtgcaagtcggacgtccgacctggttatagtgcgcgaaagataattcgaaccatctagttagctggttcccttccgaaagtttcccttcaggaatagct

SEQ ID NO: 589182 - DNA, 440 bp, Homo sapiens
  misc_feature (356)..(356): n is a, c, g, or t
cattggtgcttaagatgttttcagaccccgcactcatggatcagctggcatcactcagatggataaactggctcatctagtcctgtagcccccacccaagaactgactcagtgcaagaggacagtttcaactccctatgatttcatgtcacaccagagccatcaattctccccgctccctggtctcctactcccccaaattatcctttaaaaatcccagtctctgaattttcaggagactgctttaagtaataataaaactctggtctcctgtttagcccagctctgtgtgaattaaactctttattgcaattcctttgtcttgatgaatccactgtctgggcagcgggcaagatngaaccgttgggtggttacaatgacaccaggaacccctgggatcaagacttgctcgaagccagccacacttgagacctgttaacc

SEQ ID NO: 589183 - DNA, 194 bp, Homo sapiens
cgcttgactgctgtgcctccagcacactgactgctttgaccaactcagtgctcaagaacaatttgtgtccctcgggcagccacctcatcagcaacctcttcaaggaggactgccaacagaagatcgatgacctcttctccgggaagctgtaccacatcggcattgctgccatcgtgatcgctgtgatcatgatc

SEQ ID NO: 589184 - DNA, 827 bp, Homo sapiens
  misc_feature (686)..(686): n is a, c, g, or t
  misc_feature (774)..(774): n is a, c, g, or t
ggatcactcctgttgcatcctcccggcacgcatcgagtatcttcgacaagataaacttcttgatgaatcaaaaataggggtctgtctactcgtcagaacacaaccagaatggcataaggtgatggaaaaaagtaagtacgagaccgcgtgaattcagctgacggaagaggaatgcgacagaacaagaagatctgacttggccttagagtctattataacgtgagcagaagttggtgacaggctgtgtaacgtgtgcagaagtcatgacatgttgactagcatacgagcagagtatggatggcccccgcagtttggtgacggtgctgaacagggcacattctcagggagtagagcagggcctaacgagagtggccccaagccccaggagctcctcatgactgtaggcgtgctaccgaagacgcatcagtgtgtcgacgcctcgatctagatgtctgttctgatgggggtgaccgtctcgtcaagtcttcaggggcccccagagtcccctgtggagacatacttccagtcccagtcgatgcagagacttttttggactgtgaccagtaagggacttcggattctgattgtatacgcatactgatctaggagtggaatgcgctttggcctagtggacaagtgtggcaagattccctttattgtgcgcccaagatagaaagcggtcagtnggccgctgacgagcgataaacgttagggagatggattggcaggcatgtggtatcacgaggaactataaagcaggaaaacccaaacaanaggcagaaaaacgcaaagttgaagaaacaggggaagaacacgggaaggcagga

SEQ ID NO: 589185 - DNA, 188 bp, Homo sapiens
  misc_feature (89)..(89): n is a, c, g, or t
tttcatctctagcttatgattttgggcaagtcatggtaatctgatttaaatggggataaaggttacattgcgtccatgatgctgcaganctgtgtgatgtgaaacactgtgggatgttgtgattaggatggttgctttgtgtaactgtaaatgtatacttacacagtatggttgtaacaggtcactac

SEQ ID NO: 589186 - DNA, 125 bp, Homo sapiens
  misc_feature (71)..(71): n is a, c, g, or t
gcacatacttcagttcactcctttaaattcaatctaggcttataacgcagtcttctctttgaaaatgaggnttgttccagtgtttccctgagttcagccttaaagcagaaaatactctacatatt

SEQ ID NO: 589187 - DNA, 114 bp, Homo sapiens
acggaggtctattttgatactcaggtgctcatgttgttccctgggttaaaatgtgagcacaaaacagagcaacatcaattccggggcatcctgactattggttcctccagctca

SEQ ID NO: 589188 - DNA, 234 bp, Homo sapiens
  misc_feature (223)..(223): n is a, c, g, or t
aacacttattattctataagacccagctcaacctccattttggagcctcccctgtcatgctcccataactgcacagaaaacccgtggaatgcagacctcgctccatcagtgagtcagctcccctgcctccatttgtctatgagctcttcccagggcagagaaaacacaattgaggctgggcgccgtggctcacgcttgtaatcccagaactttgggaggccanggtgggcagat

SEQ ID NO: 589189 - DNA, 955 bp, Homo sapiens
  misc_feature (447)..(447): n is a, c, g, or t
cgaggacgaaggcacgcatggatactagtacggtgggatacctatacactcgtgtcatcacacgattgtcgcgaaaagtcgattgacagacaggtgtatgaccacaagagcggacatcgctcaggacggcttaccgatgatgatctaatacaacaaatgtgtaacaccaaggcacaaaggagaggtctcatgtcacttcataaattggcataaaaaaggataaggatacaaaatatagatattctctaaataggactgggtctaatcggtaaattacgagtgatacattttacaatggataggtagacacacatgaatatataggactaggttccgaaaattggattgtcagaatagattggtaaggctcgaagatagtgaggataaatttttaaggtgctctaagttaaagctagccagggttgggtccgctgtggctcacgcctngtaatcccagtactttggcgagaacaggaccggtacgggcggatcgacatgaaggtcacggaatgttcagggagcaagccgtggcttaacagtggtagaaaacccctgtttttctacatatcaaggtacaataaacacttatgccgggagttgtggtggctgcacaccctgtatatcccagactagctcgggaggctgggggcacgagaactctgctgtgaaacccacaaggaaagggtcgcaggtcggcagtgacaggcagaagatgtggtagttaacctgggctgcccaggctttgaggcaatcaaggagcataaccctcccggcaaaagctacgtagctaaccacaaccaaccacagtttgctactttagccggcctcttccacactaaaagggcttttcacaacacatgtcggcttggagggcggcgcccaccactcatcgtaacgtacgggccctccctggtccggggacccggcgacgcacatgggcgctccaccttaaacc

SEQ ID NO: 589190 - DNA, 138 bp, Homo sapiens
gacctggcccccctctgcagaactgcagaggggttttagcttccaaagacatttagggaggccctgccggacttcttgttttcccagaaccaattagttacctttcgggggaattccttcttagtagtctcgacctgt

SEQ ID NO: 589191 - DNA, 513 bp, Homo sapiens
acaggatttaaccatgcagccaaagacagggtcccactccttcacccaggcaagctgtcccccagtggagcactgacgggtcactgtagcctgaccctactggcctgaagtgaaccttctctatcgaatttaacaaagtgctgggattaccggaatgagccaccatgcctggcctgtattggatcattgtacacatttccatttttactggatactgagtggcagtgcacactaacagcagataactaaaagagagaaagctaacttcactggccaaattagcccaagcttttcgcacaactcatgaccaaacagatctgcataggaaacaacacttggacataaataactatgctaagggaacagccttcatacatgcacatagaaacatatgtagaacccttccttgacaggctaacgctattttgtttttttccaagaggtatagcagagaggaaactgagtgacttagctatagctggggtcccgaattgtcacaaactgaatgggtca

SEQ ID NO: 589192 - DNA, 873 bp, Homo sapiens
  misc_feature (21)..(21): n is a, c, g, or t
  misc_feature (69)..(69): n is a, c, g, or t
  misc_feature (76)..(76): n is a, c, g, or t
  misc_feature (82)..(82): n is a, c, g, or t
  misc_feature (88)..(88): n is a, c, g, or t
  misc_feature (94)..(94): n is a, c, g, or t
  misc_feature (171)..(171): n is a, c, g, or t
  misc_feature (179)..(179): n is a, c, g, or t
  misc_feature (200)..(200): n is a, c, g, or t
  misc_feature (210)..(210): n is a, c, g, or t
  misc_feature (225)..(225): n is a, c, g, or t
  misc_feature (243)..(243): n is a, c, g, or t
  misc_feature (279)..(279): n is a, c, g, or t
  misc_feature (299)..(299): n is a, c, g, or t
  misc_feature (332)..(332): n is a, c, g, or t
  misc_feature (345)..(345): n is a, c, g, or t
  misc_feature (358)..(358): n is a, c, g, or t
  misc_feature (361)..(361): n is a, c, g, or t
  misc_feature (499)..(499): n is a, c, g, or t
  misc_feature (524)..(524): n is a, c, g, or t
  misc_feature (551)..(551): n is a, c, g, or t
  misc_feature (628)..(628): n is a, c, g, or t
  misc_feature (674)..(674): n is a, c, g, or t
  misc_feature (689)..(689): n is a, c, g, or t
  misc_feature (714)..(714): n is a, c, g, or t
  misc_feature (733)..(733): n is a, c, g, or t
  misc_feature (774)..(774): n is a, c, g, or t
  misc_feature (795)..(795): n is a, c, g, or t
  misc_feature (808)..(808): n is a, c, g, or t
  misc_feature (853)..(853): n is a, c, g, or t
gtcatggtagagtgttttatnacaccacaaagctaacaaggtcgggtttgtggtttttttcctttcacntggttanggtggngttgtnctcgtngcccgttggagaaaggttgggcccaaattatttcaaaaaggaatcaaaaaagttggcaaagtgcagccctgggtttnagggagcnatggaaaaagatggaaatgcntgttgggacntttagagcagactcnagggaaggcctgtaattnggtaggaaaggggtctttaggaggatgaccaagctntggaaggaggatggggaaanattatactgtggggtatggcaaaatgaaaaaantacaaaaataatnatgtccaaaaaanttnaaagtttacaaggagctttccacttgcttcagcatgcttaatcctcacatcaaccctgcttaggggacacaagctcagacagaggaagtgacttatccagagtcacacaggcagaaacccaggactgaagccaaaacntttaacaacatcaagctgtctttcnatgaggggtaggggcagatcccccganccggagcctccagggcagccctcgctcagggcagcactgtggtgacgctggtgagcacaacatgttcaaagattttngagatggagcatcggctctgcaaggacaaggacttgtggctggcanacgagcggggactangggccttcagagagccgcagggacncaggccaggcaggcagcangagaaggcagccttaaactgctcccggaatttgccactgangaagttgtagatgatggggtnggcagcgctgttnggcgtacaccagccagtgggagaaggtgaagcaggcgtacacagnttcgcgctcactggcttggc

SEQ ID NO: 589193 - DNA, 1009 bp, Homo sapiens
  misc_feature (1009)..(1009): n is a, c, g, or t
ccgccttctttggggtgccctcagaattcaggccattcatggccgggccctccctcgctcttcgcgcgggggggaggagggcacggcgcctgtgcacggccgtgtagctgacgcaccgcgcatgtgagttcagtggggagagctctgttatgtgatgagaattaagagctcccaccgtcgcgaccgactactccacttctgcgcctggccttcgcgccgcgcgcgcgcggttacaattcatctcgtcatacacttattttcacctaggacgggagcaatatatttaattctgtgagccgagtccaggattgacagcctcaccacagcgcaccatggtatgatctttgttctcttttcacatcatcacttccttttttttagattatcttttcttatttatcagtctggacgtgacgcatgacagataaaaattacaagtacagaagcgaatgctggcgttatttcgttccatcccggcctctcccgtgcgggcccctaggcgcgtgccgggcgcccgatagacacggttacttatctcatacacacataccacaagcgtccttccacagttctcacctcgtcaccgctcaccagactgctcctcgtcccatagatgactgccttgagcgagcgtgactatattagccagcagcttctctcacttttctacacatcctaaatatatccaactgatgacaccagttacgtgtccgtttctctacgaatcgatccctatgcatctcaacgcaagagaccgctctcgcagtagcacaacatctcacctctctagagatgacacctcaatataactgtcacatctctagcttagctaatgaacgcctaccacctcgtcctagacgcctctcttacacccgtagtttctagttcagccgattacccgcctgcgtcacctttccgtcgcgtaagttgatatacagtctagctaccgactgagcacgctgtcttcgcccgtcgataccatgacccgcaccccttccgtcctttcatn

SEQ ID NO: 589194 - DNA, 154 bp, Homo sapiens
cacggatcttcggcatacgggcaaaaagagccaaggaagcgcagaacaggatgtagacatagaaaaaataaagccctcctggggacttgagaatcagtctggcagtcatgctagggtctcccacgtggtgtgtttcattgggccatctgggacg

SEQ ID NO: 589195 - DNA, 323 bp, Homo sapiens
tggccccaggacagtgatgaagacagagcctgtttcagctttaggctgtggggatcaatgccatcagtccctgttattgagggattatcccttagccaacattcctatttgtgggtgggcgtggaaagtgtatctttttttggggggtgtggggaaatgggtgggggaaagggggtgtgtgtttaaaagttctgtttgtaaactcttttaataaaagttgtgcctccccatacttgaagctcccaggacaagggttgaaaggctcaacccctctttcagcttttatgtggtgttggaggggctggtattgtgttcacccaaga

SEQ ID NO: 589196 - DNA, 252 bp, Homo sapiens
gaggccaggaatcattggcaaaaaaactctatgatcagatagtccgatcctagattatccaaatcaagagcagagatagctgtgatgtataatagtaaatcggaaacttatgtactctgtgcacacttttactagatacacacacacactagctatatccacgcacatgagtcagcccccagtcatgctctcggactctggttatcacacctcacatccccgcttagtcctgtattcatatgccctccatgt

SEQ ID NO: 589197 - DNA, 728 bp, Homo sapiens
caaagttcaacattctttcatgataaaagctctcaacaaattaggtatagaaagactgttcctcaacacataaaggaaagccatatatgaccagcccacacctaacatcatactcaatggtgaaaagttaaaggcttttcctctaagagaaggaaaaaagacagatgcccactctcaccacttcttttcaacatagtaatagaagccctaaccagagcaattagacagaataaataaaaggcacccaaatagaaaatgataacgtgaaattgtctctgtttgctgacgacatgaatttatatatagaaaatcctgaagattttgccaaaactgctagaattgataaatgaattcagtataatcgcaggatacaaaatcaagttacaaaaattagtagcatttctatacactaacaatgaacgtaaaaagaaattaagaaaacaatcccatttataatagtatcaaaaaatacttaggagtaaatttaaccaaggaagtgaaatatctatatactgaaaactataaaactttgatgggaaaaaattaaagaggatgcaaacaaatggaaagataccttgtgttcatgaattataaaaattaatattagtagtagtaatttcctgaaaaaaagttccaaaccaggatggccatagcagccacaaaaggaagcaaacaagaacaagtcctgatggagcaatttatgaagacaggcagcatagagggagaag

SEQ ID NO: 589198 - DNA, 411 bp, Homo sapiens
  misc_feature (303)..(303): n is a, c, g, or t
  misc_feature (328)..(328): n is a, c, g, or t
  misc_feature (407)..(407): n is a, c, g, or t
aatagagttatttcatttactcccatagaaagaccaaatggctccaggcaagagaaaattgaatcaaagggacccatgtgtcttagttggggtaagttctaattttaaaagagatttttagcacacagtaggtataagaataaagagatgatctggggattcagagaagataattttgcctaaaacaagcgagaagtggataataaggagagactaatctgactcagcaaaataaacggatccatgaatcccaaattgggtaaatccaagaagggtccgaagacagaatggggaacattcagntgcacatgaaattcgatggaatgantcctcttggttgggttctctttttttctctggcatctgtccttgtttggcccttaggtttgtgttctttggggggcccnttag

SEQ ID NO: 589199 - DNA, 610 bp, Homo sapiens
tgtggcgccccctgcgggctgctcagcgtgcgtgcacatgtcctgtccggctggcttggtggggtgccgaggctcaggcaggatgacgacgtgagacctttgtgaagtgatatcagagcctgtggtctcaagaatctgaaccttatcttcattgtgcgggacgagagtgcctgagtgaccaatgacaaaggacgggcatgagtgttcggacctgcaaagtggcggagaaaacaggcagcatcaatatcgtctgtctgggacgatgttggcgatctgatccagcctggggacattatccggctcagcaaagggtacgcttcagttttcaaatggttgtctgacactatatactaggccgggggggttgatctcgcaagaagatctggaggaatcgctgtattggtcttattctgaggttcctaacctatcaggtgaggccaaaaggccagagtacaagcagccgagcaggcagggaaatgaggcgcgtgcaggaacgaagagcaaccccttcaggttcccagcctagcacttggagcctctgcgtgctctccagctctgagaacagaactgggacatggacttgagtgccccaggcagggtcccggtggtg

SEQ ID NO: 589200 - DNA, 184 bp, Homo sapiens
cttagaatttggggggaaattttaaaaaaaaattgcccggatttttgggaatttgttataaagaaagaacccttttgtcaaaaaaaattcaaatttcctttttttcccttttataaagtaagggcggggggggggtaatttgggtttttttttttcccccagtttaataaatcataaaacttta

SEQ ID NO: 589201 - DNA, 483 bp, Homo sapiens
tcaagtatcataaagggattttaataagtcatattcaatggatttttccagttaacaaaatgtattcatttgattactgttttatgtttatttaactgattctgatatttatttcatgttaaagactaaatcttctcagtcttgagacataggagagaaatataaaagacaccatggcctttgtaaaatgattatttctgtatttcataccatgaaaattaccagcagaaagtataaatatctttacagataaaaatctcttcctatgtttctgatattagtctatagattagcaatatttagacttcgcagtgagctgatccatggattggatcctaaaggtgatgccaggcctagatcatgatttatcctctctgccctagcaccatgatctaatcatagtaggtgttaaagaaacatctgctgtgacgtaaaatggaggcagcttctgcatactgccccttgctgtcactgagacagcac

SEQ ID NO: 589202 - DNA, 160 bp, Homo sapiens
agtggccatgtgataccaaaataatcctcatttctccatcctatccttgtttcattgctttcattcatttcagttatatatagccatacacaaacatacataatcaaatacgttattactatcttgaacaaactgttatctgccagatcaattaagaatt

SEQ ID NO: 589203 - DNA, 183 bp, Homo sapiens
tatcaacggaagtttatacttttgagccagacttattatgatgaccctaagttcagaaaagaagaagaagagggatactcccatgctgccaaaggataccatacttgcagagtcccttcagatacataaagaacacattgtcaggataccatgaacatgattctcttttggaccacaaagaag

SEQ ID NO: 589204 - DNA, 181 bp, Homo sapiens
cctgcctctaggacgctaacgctaaaaagggatcaccagttaagagcgattattttctctgtttctttactaacacaaataacagaaacgacgacagataaaacatggacagaacccaaaacaccatctagcatttgcaatacctattattccctccattttagttagaatttttaagtgt

SEQ ID NO: 589205 - DNA, 908 bp, Homo sapiens
ggaaggaacgcaggatggcagccggaacagcagttggagcctggtgtgctggtcctcagtctgtggggggcagtagtaggtgctcaaaacatcacagcccggattggcgacgccactggctgctgaagtgtacacgggtgtgcccccaagaaaccaccccagctggctggaatggaaaccttgaacacaggccggacagaagcttggaaggtcctgtcatccccagtggaggaggacccatgggacagatgtggctcgtgtccattcaccaacggtctccctcttccttccggcctgtcagaggatccaggatgacgggattcttccggtgccaggccactgcaaccacggaatggcaacaggcagaccgaagtcccaactacctgagctccgtgtctaccagcattcctggcgacagccacgaaatctgtcgcatttctggcctctgacactcaccgggctggtggttcaccaactacagcgtggagagaccatgctgtcgtcagcagggcaaagcttatccctggacagggcactctttacgcctggccactttggcactggcgaacggccccacctcgtgaccctacatcgagcaacgcgcgaagctatcatcgtcgaacgggcacaccaggacccacggacgaccacaccgtgacagaaccacgcggccatcctttaccagccacacgttgccaaaggatcatgggaaatccatctacacttggcgttaaaacaccaccatgcacacctgagggaacagagcagcaatcccaccagcatcacacaaggccttaatcgttcacgcgtgtaagcattttccacggcagccaataggcacctgtttcccacatgaacacaacctggtgagacacttgtacgagcaccaattgcagcgccaattccac

SEQ ID NO: 589206 - DNA, 97 bp, Homo sapiens
cgttcgaggaacgcatccgccacttgatgtatttacgcgagcttcaggacgaaacgggcgggttcatggtattcatccctaactccgcgcagccggc

SEQ ID NO: 589207 - DNA, 566 bp, Homo sapiens
  misc_feature (35)..(35): n is a, c, g, or t
  misc_feature (61)..(61): n is a, c, g, or t
  misc_feature (75)..(75): n is a, c, g, or t
  misc_feature (101)..(101): n is a, c, g, or t
  misc_feature (106)..(106): n is a, c, g, or t
  misc_feature (124)..(124): n is a, c, g, or t
  misc_feature (129)..(129): n is a, c, g, or t
  misc_feature (132)..(132): n is a, c, g, or t
  misc_feature (136)..(136): n is a, c, g, or t
  misc_feature (138)..(138): n is a, c, g, or t
  misc_feature (143)..(144): n is a, c, g, or t
  misc_feature (163)..(163): n is a, c, g, or t
  misc_feature (221)..(221): n is a, c, g, or t
  misc_feature (238)..(239): n is a, c, g, or t
  misc_feature (242)..(242): n is a, c, g, or t
  misc_feature (250)..(251): n is a, c, g, or t
  misc_feature (266)..(266): n is a, c, g, or t
  misc_feature (275)..(275): n is a, c, g, or t
  misc_feature (300)..(300): n is a, c, g, or t
  misc_feature (306)..(306): n is a, c, g, or t
  misc_feature (317)..(317): n is a, c, g, or t
  misc_feature (329)..(329): n is a, c, g, or t
  misc_feature (332)..(332): n is a, c, g, or t
  misc_feature (337)..(337): n is a, c, g, or t
  misc_feature (359)..(359): n is a, c, g, or t
  misc_feature (402)..(402): n is a, c, g, or t
  misc_feature (409)..(409): n is a, c, g, or t
  misc_feature (411)..(411): n is a, c, g, or t
  misc_feature (425)..(425): n is a, c, g, or t
  misc_feature (427)..(427): n is a, c, g, or t
  misc_feature (469)..(469): n is a, c, g, or t
  misc_feature (553)..(553): n is a, c, g, or t
tgcccgcccacccacactcatggcagggtgggggntgggccaggggcgggtgccaaaggtngttttgtttttggnacaactgtccagcccgggggctaganaaatnctctttgcgggggtgggnatggnggntcangnctgtnntcccggggctttggggggntggggtgggtgggtcccggggtcggggggtcggggccgtcgctggctaacatggtggnaccccctctctactaannatncagaaaannttgggtgggggtggnggtgggggnctgtggtcccagctacttggggggntggggnggggggatggngggggcccaggnggnggggnttgccgtgggcgggggtggggncactgcactcccgcctgggcggcagggcaagactccgtctttnagaaaangnaaaaaaagggaaantnctctgcgaagtgaggggggggggtggtgtgtggagggggggnggtggcacaggtgctgggccccacctgtcctcttccctaggcagtgggcccccagggcagccaaatgcctgcaggagggctcanttctggcccaggt

SEQ ID NO: 589208 - DNA, 417 bp, Homo sapiens
catgtggaagactttccccttttttgtcgcgccccccggggtggcagtccgcctttgtaatgggtcctgaatgtcgcaccccggagggcccgagagacccgggtttttcgcctccccccttttccgcatcagggccaaaccgtttccctggggagatggtacccatacttttttccataaccctcatgtgaatccccttccccctgggttcgaagatgaataaaaagaatttgggccccttcccgggcccccggggccccagccctggtttgggccgtttctttgcccctgggcccgaaaaagtttttgggccctttagctccccttttttacttgtttccaatgatggctggtatcctggtttcccctccctttggttggggccggggatggctttaattaattactttaccttta

SEQ ID NO: 589209 - DNA, 302 bp, Homo sapiens
tgtgtactgtcagcgttaagattcagtgctggcattgtgtttatgtgccaccgagtccatcggcctccaggagctcacaccgacatgctgtctggtcccctgcgtgagggtccacttgttctcacctcaatcaagggacaggcccagcttttgcacagacggttcttggtggtcccagaatgtttcttgcatatcttcttgttggaacctcactgcaggtccttgggctgggcttggaatatgtcctgttaacaacagacgagagactcgcctcatgtgccctccttgtcaacaggccagcc

SEQ ID NO: 589210 - DNA, 151 bp, Homo sapiens
aagcagtggtatcaacgcagagggcccattatggccgggtctctataaaaaatacaaaaaaaatggctggacgcagtggctctcgcctgtaatcccagcactttgggaggctgaggtgggtgggtcatctgacgtcaggagttcaagacca

SEQ ID NO: 589211 - DNA, 292 bp, Homo sapiens
gacaactcctctgtcacttcctttatcaaatgatttttattacggtgtggtcacttatttagatggacattgcttttcaaataacttataataacacgttatgtgccatgtgtctactctagtaatgttacccagaagagcacaattttcacactagtggcgtctcagtgaagctaaccaaggatgaagctttggctttgttggtgagatcagagcccttctgagcaggcagcgccactccagggttcagactgtgctgcttaggctgcagagatacagggtctgagggctt

SEQ ID NO: 589212 - DNA, 439 bp, Homo sapiens
  misc_feature (379)..(379): n is a, c, g, or t
taaggttggagggggaaatgctggaagaatcgtaaggggtatggaaactttctcatataagtaatgctagggtgagtggtaggaagtttttccataggaggtgtatgagtgggccgtagcgaaactcgggggtatgctgtccgaatctcataaaaacagggaaggttaaaagtaagggttctgggtggaccacaaatattgttggtgtgtaagatgtccacgggagaagaagtgcgtcatattgttggtccctagagaaagatttgtagtgggtcagaggtgttgttctacttataataacttgttctggtagtattccggctatagaaaacataagggcagaaagggcgcctcgcggcgtaatccagattgtttaganagcctagaagacatatgttctcgagaactcctcccctttcgagcaaagggctcagaaggg

SEQ ID NO: 589213 - DNA, 309 bp, Homo sapiens
  misc_feature (46)..(46): n is a, c, g, or t
  misc_feature (79)..(79): n is a, c, g, or t
  misc_feature (234)..(234): n is a, c, g, or t
  misc_feature (302)..(302): n is a, c, g, or t
gaaactgtggatgaagaaaggtgaataagaggctgggtgccaggtntcacgcctgtaatctcagcacttttggaggccnaaacgggtggatcacttgaggtcaggagttcgagaccagcctggccaacatggtgaaaccccgtctctactaaaaatacaaaaattagccgtgcatagtggtggatgcctgtagtcccagctgcttggggggctgaggcaggagaatcacttgancctgggaggcggaggttgcagtgagccgagatcgcgccactgtcctccagtgtggtgacagagcaagnctctgtc

SEQ ID NO: 589214 - DNA, 657 bp, Homo sapiens
  misc_feature (574)..(574): n is a, c, g, or t
  misc_feature (578)..(578): n is a, c, g, or t
  misc_feature (615)..(615): n is a, c, g, or t
ggatggtggacagcgtgtaccggacccgctccctgggggtggcggccgaagggctcccggaccagtacgcggacggggaggcggcgcgcgtgtggcagctgtatatcggagacacccgcagccgcaccgtcgagtacaaggcatggctgcttgggctgctgcgccagcacggctgccagcgggtgctcgacgtagcctgtggcactggggtggactccattatgctggtggaagagggcttcagtgtgacgagtgtggatgccagtgacaagatgctgaagtatgcacttaaggagggctggaaccggcggcacgagggcgccttcgacgagtgggtgagcgaagaggcgggtggatgactctggacaaagatgtgccccagtcagcagaggggggctgtgatgctggcatctgccttggcaggtgcgctcacttgccagacgtgagaagggaccagagtgagcaccggctggcgctgaactgcgaccacatcctcagtacaggctgggcacccacagggaataacatgtactatgagagtgacttgaccaaggacgtcgcagcatcagtggtnatantgaacaacgggccacatggtgacgctgggctgtacgngggcagtgccgggggctgcgcagatgggtgtgctgggtgggg

SEQ ID NO: 589215 - DNA, 130 bp, Homo sapiens
gatcgtgagcgtgctcccccagatgtggagctccacctgagccagatggtgggggattcgtgcacccttcattctggttgctggtctcactgaaccatagccaggctgggccacagctccctgagtgttg

SEQ ID NO: 589216 - DNA, 456 bp, Homo sapiens
  misc_feature (193)..(193): n is a, c, g, or t
  misc_feature (208)..(208): n is a, c, g, or t
  misc_feature (352)..(352): n is a, c, g, or t
ctagaggatcccaacacgcatctcactcaccgcactggcactcccaggctcaagcgattctcctgcctcagccctcccgcgtagctgagattacaggcacgcaccaccactcccggctaattttgtatttttttagtagaaacggagtttcaccatgctgcccaggctggttcttgaattcctgacctcaaanttgatcacccgtcgnctcaatcggaacaggtgtagcacggctagcctgtgtcactttttaatgtcatgttacctgtgggtacaacggatgaggtgagcccctatctctctccctcaaaatggagtttatctagagtatatttctagaattgcaaggggntttgtgaagttattttagggcatgcttcagttttaatagataacagattgcggggtttaacccggtagctcgggaaatttcggtaaagtcaatggctcaatagc

SEQ ID NO: 589217 - DNA, 243 bp, Homo sapiens
ggatagtcagtggacttgagagtacacgttgattctccttggtcgcactcaggaacgctgggcgccggcgctgatcgccgatgcctcgcgggcgcgctgccgctgctggcggcgctcctcgctgaagaagggatagaacacggtgatgaacagcacgaacaggaaggcatactgcacgatggttcccgacgagccgtagatcgcccacaggcagtacacgacggtcaggctggtcagggtcca

SEQ ID NO: 589218 - DNA, 137 bp, Homo sapiens
cttatacagcatgggcgtctgataggcggattatgactctagctgtcgagggtatacagaagaccattccccgtgctactgccaatcttcctcatgtctacataagcctcgatgagagcctggctggctacctcagt

SEQ ID NO: 589219 - DNA, 431 bp, Homo sapiens
ctgcgaggatggtgttgcagaaaacaaaaagaatgaagctcgattgagaatagcaaaaactcttgaagactttgacctgggcacaacggaaaagtgtgtgagaatcaactcggtgtctagtggtctggctgaagtcgacctggagacatttctacaggccagagttcttccctctagtctgatgctaccaaaggtagaaggtcctgaagaaatccgatggttttcagacaaattttcactccacttaaaaggcccgaaaacttgaacaaccaatgaatttaatcccctttgtggagcttgcaatgggtttgctcaattttaaggcagtgtgtgaagaaacactaaagacttggacctccaagtgggtcttttgcctaagatgcagtccgttttttggaggagaagatttttcgagccagcattaggttcaa

SEQ ID NO: 589220 - DNA, 462 bp, Homo sapiens
aataggtttggtcctagcctttctattagctcttagtaggattacacatgcaagcatcccggttccagtgagttaaccttttaaatcaccacgatcaaaagggacaggcataaagcacgcagcattgcagttaaaaacgcttagcctagccacaccccaacgggaaacagcagggattaacctttagcattaaacgaaggtttaactaagctatactaaccccagggttggccaatttcgtgccagccaccggggtcacacgattaacccaggtcattagaagccggcgaaaaaaaaaaaaaaaaaaaaaaaaaaaaaccatgtcggccgcttgggccaagtcgattttagactcgagcaagtttatgcttgcggccgaatttggagctaattgggccaattcgccttatagggagtcgttttacaattaattggccgtggtttaacaacgtcgggactgga

SEQ ID NO: 589221 - DNA, 2196 bp, Homo sapiens
  misc_feature (1249)..(1249): n is a, c, g, or t
gttggagcccgagtggactgaaaatggcgtgctgctgctaggactgtgattgctacctgcagcagtcagtcttggcccagacaatagtgcacttgccatgtcccttgtcgagcacttgtacatgctcattggccgtccctgcaggccatggcgtagcactgtaggagagatacgatgcttgcacgaaattgttacttcgtgttgcttgattccagattcgaatactcggtaactgatatttcgatgctacagaatgctttcgcatcatttgctccactggaagtcttcgccttagtacatccccgatagcatatagctacccccttatctatttgacattgcgcgtagcattgctcggtctcgatcgaattcaggaagaaaggtgtccacgcacagacgcgtatacaggccgattagatcgatcgttgtacctgcggcgataaaatagtgttcggggtggccatttgttccttgacttattgccctctgtgggcatttttgcaccccttatggttggtcgttaccttaacaggaaacatgtcttgcgctgggccttgatgatgatggacccataaaagggcataagagcgaaacctatatacacctggacctggttgaggagcacgtgcgtgtaaacgccatatggaattccgccagggttcctcatagctgctgaataccctgaagctattaaaggccactttctttgtcgcttagtgacttagcatataccaccctaaaggaacgcacgacattggggtcgggatatggaggccctcacaattgtaaattcagtcccgtggcgctcctttgggtttcaggaccctttacatcttataggccaggattttccctcgaaggacttaccgggagtgttgcgttgttaaagaacagcgcgcgcgtgggggcatgtgcggcatacagaagcgggcgcccttgtgagtacaacttggaggcccccagtggagaggtcaatacaaagcggattagagggcgcaaacggaccttcccacttgggggcgaaggggtggagagaaaccatctcggttggtgaacccggccggagtattcaccgctggcagatctttgtccgaaccgtagcggggatctatcgataccatcacatgggcgacagagcttaataaagacgagaccctggttggtgccttagaacgggacagcaaatactatgtgtcttatgttattatctttgcttcatttactcatatcttttattagactctcttgnagatcacgtccacgtagacccgatggtcatcgagcatagcgagaagaggagctacagatgcgaagagcatgagtccggtaggagatatgcggagacatgagatgcatgatgagacagagggtgaggggagtgggagagatgcattcgatattcgatgttggtgaggttttggatgtgagtgcggagggcggcgcgcggctggcgcagtgtgtcacggtgggaggagaggagcgccggcggacgttgtagtgagacggagtacgagagcagagagggagcggtggagtggacatgggaatggaacgggtgacatcgaggagccgtgctcacctgcgtaatctcggctgtagatcgggcatgtcaacactcaacatgcacctgacgcacaaggcaaagacgccatcgcccaggcgctgcatgagcctagcaacgtcagagcacactacgcctgagacgaacagcccccgcacgcctggcaagcgtacgtggtactcgtgctgtctacgctcgagacttgtgacgcagcacctgacgagacggcgtacacaccccgtcgattgcagcttatcttggagcgcccacgtggctagaggcgtcggacagcatcatgcactcggacaagaagattcgtacagcgatgggcatgtctcagatgtaagtgagaatctgacggagagactcttttggatacaggctggaaccagtgtgcgtgatgaagagctagcgctgatcggtgtgcgaggtgatctaggactcgacaggcgctgacgatgtcgagctgctgcagcgtgccgaggctgtagcgatcgctgagtgcgtgagcgtgtgactgaatgcttgcgatccatgactagacaagagcatggctgaagaggaggcggaagacacagtcgagtgcggaggcagtcgcacagtgggctagatcgacgcgaacactctcacgatac

SEQ ID NO: 589222 - DNA, 427 bp, Homo sapiens
cagaacatattcctgaagtttgtatttttttaaaaaaatcctttttataagattggatttttggcatctatcctattaagggaaaattttaataaattaagtgcctgctttttggattccagttaattgagatgtctactttatagctgcttaatagatgaggtagttcaggcttagaaaacaattaaattgggccgggcgcagtggctcacacctgtaatcccggcactttgggaggccgaggcgggcagatcacttgaggccaggagtttgagactagcctgggcaacatggtgaaaccctgtctctactaatacattagccaggcttgatggtgcgcacctgtaatcccaactactcggaaggctgaggcaggagaatggcctccctgggaggtagggattgcagtgagctgagactgcaccct

SEQ ID NO: 589223 - DNA, 135 bp, Homo sapiens
ctggggaagagggggaagggagagcccgaggaagtaatgaatgagtgggttactgctgcgggcaatggggactccatcctgcgtgggcatcctctgagagtttatgtagaatacacttcagtaattgtccgtgct

SEQ ID NO: 589224 - DNA, 791 bp, Homo sapiens
gttggctcataaaatgaattgggaagtattgtctcctcttctagttttctagaagatactgtgtagaattcttattaccttttccttagatgtttgataaaattctgccagggaaaccatttgggcctgccgttttctcttttggaaggttttaacttacagaatgaatttcattaatagatataggactattcaggtgttctatttctacttgggtgagtttttgtactttgtatctttcaaggaattattcccttttatctaagttgttgaatttatggatatacagttgttagtagtatgtatctattactattttattacataggatcagtaggaatgtctcctttttcattcctctattggtaatttgtgacttctctctttttttcttaatcagtttggctagaagtttatcaattttattgatgttttcaaagaaccaactttggttttattgattttctctatttttctgttttcaatttcattgattttctgctcttatctataatttctttccctctacttcctttgggttttatcttctttctctagttccttatggtggaagcttagattacagtttagagatctttctttttttctaatacagatatttaatgctataaatttacctctatgtgatgctttttctacatcccacaaatttgatatatgttaattttaattccattcaaaatattttcccctttctcttgagatttcctctttggccattgatattccgcaaatgtatgccaattttcaataattggtaagtatccaga

SEQ ID NO: 589225 - DNA, 392 bp, Homo sapiens
atctagaggatcctcttctccgaaaagcaacatgtgcagcaacaatctgatgggcagtcaaactcttgggaggacgtaaatccacggtaaatgtcatgatggctggtcgaggcagaaggtcaacaggcggcgagagaggagacagagaatgctacagcttaataaataacagtaatgagaactgtgtggtttcaactgccatgagtttgtaggggcatcctctgtgctactaaagccacaattctatatcatcatcatcaacattcttgaagcgcattttacactattctgcattagcaattgtgttgagggaactataaaccttaaaattactgacacatttaattaaaggagctgtaaactctgctcattattgcctgtcttggatgttg

SEQ ID NO: 589226 - DNA, 200 bp, Homo sapiens
tacaatcttacatggtaagggctcaaggtaaccagacgtagcttaaacaattttgggaaaatgaatgaggttggaagaaatcacacctgcctgtatttgtaacgatttacgtataatagctattagataatcaaggacagctgtgcgtacctgatgaacgaaactaggctcacaaattcaagcagaatatcatggcagaa

SEQ ID NO: 589227 - DNA, 307 bp, Homo sapiens
aatttttagtagagatggggtttcaccatgttgatcaggctggtctcgaactcctgacctcaaatgatccacccacctcagcctcccaaagtgctgagattacaggcatgagccaccatgcctgggccatcagtttcttaaaaagtaaacacatatctgccctatgagttaggcaattccactacaaggtatttaatttaccccaaaaggaaatggaaaactttcattaacaactgtatttaaggagcccaagtagggctggggtgcagtgggctcagggcttttaattcccacggttttcaggggg

SEQ ID NO: 589228 - DNA, 344 bp, Homo sapiens
tcaagtgagtagacaccaacttcctttcacagaagtggctgtgtcaattgggcaccaggtgccctcctgcttgctgccctctcagtgacatcatctatacctgaatgcccagtggtatgcactaggaaagaatctggcctgcttggactgtgtctggtcacaggtcagtggaatttgaggagcaacacagtggcaaacgcccaaaaggactgccagcctgactcaggagggctctaaaccattcatccccttacaattgccacaccaccatatctggcccatccagtgctgagaaggtgacgccaggtggggcccacagttgtcactaaggtcaaaacattgat

SEQ ID NO: 589229 - DNA, 990 bp, Homo sapiens
  misc_feature (13)..(13): n is a, c, g, or t
  misc_feature (30)..(30): n is a, c, g, or t
  misc_feature (33)..(33): n is a, c, g, or t
  misc_feature (39)..(39): n is a, c, g, or t
  misc_feature (45)..(45): n is a, c, g, or t
  misc_feature (64)..(64): n is a, c, g, or t
  misc_feature (72)..(72): n is a, c, g, or t
  misc_feature (84)..(84): n is a, c, g, or t
  misc_feature (86)..(86): n is a, c, g, or t
  misc_feature (105)..(106): n is a, c, g, or t
  misc_feature (187)..(188): n is a, c, g, or t
  misc_feature (190)..(190): n is a, c, g, or t
  misc_feature (238)..(239): n is a, c, g, or t
  misc_feature (294)..(294): n is a, c, g, or t
  misc_feature (307)..(307): n is a, c, g, or t
  misc_feature (377)..(377): n is a, c, g, or t
  misc_feature (384)..(384): n is a, c, g, or t
  misc_feature (386)..(386): n is a, c, g, or t
  misc_feature (392)..(392): n is a, c, g, or t
  misc_feature (400)..(400): n is a, c, g, or t
  misc_feature (404)..(405): n is a, c, g, or t
  misc_feature (479)..(479): n is a, c, g, or t
  misc_feature (482)..(487): n is a, c, g, or t
  misc_feature (489)..(489): n is a, c, g, or t
  misc_feature (491)..(491): n is a, c, g, or t
  misc_feature (493)..(493): n is a, c, g, or t
  misc_feature (495)..(503): n is a, c, g, or t
  misc_feature (505)..(506): n is a, c, g, or t
  misc_feature (511)..(511): n is a, c, g, or t
  misc_feature (523)..(523): n is a, c, g, or t
  misc_feature (631)..(631): n is a, c, g, or t
  misc_feature (744)..(744): n is a, c, g, or t
  misc_feature (970)..(970): n is a, c, g, or t
atctttttacctncacctactcagctatcncangaccancttgancgctgaacgaaaaggcaanatcccganagatcacggcananctcactggtctcctccccnngagaacctcccccgtacggataccggcaaagcgcgtcaaatacctcggttatttatgcagcgattctctggagatggaggnncntttccagagtatctcatgtctgcccaatatccactcgcgcatatcgcnnacgaaataaaaaaatagtcgtaatagctctggtccacttcaggctgagcattctnaaggaaaaaattnaatatgatgcaatttgcatcgtacaaggacagtcaaaatgacaaggtcatttatagcaaatacgactganctgtttncnaaggtngttatgantgcnnatgatccagacctgcaaaggctctcgatgaagatagctattaaagagataacagaaaagacaagaagaaacctnaannnnnntntntntnnnnnnnnntnnccgcngccatgccagtncgagcagctgacaaattggctcctgctcagtatatccgatacacaccatctcagcaaggagtggcattcaactctggagctaaacagagggttattcggatggtaganatgcagaaagatccaatggagcctccaaggttcaagattaataagaaaattccccggggacaccttctcctcctgcgcctgtcatgcattctcctagccgaaagatgactgtnaaggaacaacaagagtggaagattcctccttgtatttctaactggaaaaatgcaaagggttatacaattccattagacaaacgtctggctgctgatggaagaggactacagacagtacacataaatgaaaatttcgccaaattgggcagaagccctctacattgctgatcggaaggctcgtgaagctgtggaaatgcgtgcccaagtagagagaaaaatggctcanaagaaaaggaaaacatgaag

SEQ ID NO: 589230 - DNA, 129 bp, Homo sapiens
actgcatggcgtgcttgtgagttaacatatgtcaagtacctagaacagacccttttattccatcacatgggttggtaggagaagtgcaccattgacttcgaccctggggaactagataaccaaattcag

SEQ ID NO: 589231 - DNA, 232 bp, Homo sapiens
tactatctacagagaatgaaaaaatggagggccagatctccagcctatatatgattttccagagaatgtttgatattgttaagattatcacccttaaaaaaaagagatgtaaaacagacacaaaatgagagaaatggtcatatttagtgttaaatgtattttggttttaaatgtacaatgaattaaacagatttgtatccctcccctcaccctgcaaaagtttactctgaaa

SEQ ID NO: 589232 - DNA, 327 bp, Homo sapiens
gtggttgtagaaccaccaatgagtttcatcttcatactgtgcctgggagagggagaagagctctgccagcagcaggaggagtacgtcctcctcctgctgctcactggaaaaccgtattctgattgttttgtggaacgaagtgttgctcaattctagaatcacaataaagccaatttaggtctttaaatttcttgtcattctctcctttggcactttcatgtgttttaaagagaaaatacacacacacacacacacacacacacacacacacacacacacacagaggcacactgagcttctatctcatttgaatcttccacagctggg

SEQ ID NO: 589233 - DNA, 1539 bp, Homo sapiens
  misc_feature (413)..(413): n is a, c, g, or t
atcttgttttattgtggttttttgttcctgctgtgcttatatatttggcactgcttctatttaattaatcttgttgtggctcggtcagttttcttagttttctgtgttactcggcatgccttatgtggtttcgtggttgtgttgttcctgactgcctccgtcgtgttagactttgcttcatgctcgctgggtatttaatagacgggcggtcttgttgttgtattttcacgtcgctgcgttgtattaggctcgtccctctcgtcgttccgtggctccggttgttgtttactttagacagccgctttgctcgtgctttatcccaggtggggggttttttgttgattgatactcacccgacgtcccctttcctccgtgattaattaatcttatatagaaagcgagtggtgttattntttatacgacagccacctctcactatagcttggcgatattaataataaattttttctggcttttcttttaaaagaaggttgtgattttttctaaatagaaatgatctgggcccgtaaaccaaaccctgtgatgattaagccccaaatctgtgattttatagaaggaaaccttgtagatttccggcccttatttatattggtccggtttgggaaagtttggagcgttgcaccacgagctgttgttttccgccgcgacacggtaatgacaccccaaagtgtggttgttcccctacatattgggcccctcgtgtgtgttgtacaaattcccgtgggggctctcagtaagaggaggttccccgaaaatggcacaccgaccctgtgtgaacacaaagatgttggaatatggtgtagaccacacgtgttgacccccgagacttccccccgtgtttgccgcccactatctttttttcgtaaaccgcgctttctttgttgttgaatttccgctgtgtaattctcgagttctttgaactatagatatgcggctgtaaagggcacacaatggggtgtccccctccctcacataaccccacctatttgagataacccacctatccccacataaccacattgcctctctccattaaaaagattatctcgtaagaggaaaggttttggctctgcttcccctcgcttctttcctcaaactgcactagtttggaaaatatagcccgcttattggagttcttataaacactccggtcacagattgaggttcacaacacactctggggttaattttttaataataacacacgtaatacacccacaatatttgtacaaattgagaagccaccacttttatatggattccacaactatttacccaagctgttgttttaaaccacggtgagagaaaaaaattattaacctgttaaaaccacaatgcacactattgatattttaaatgcgtatattaagagaaaccccttgttgttgtgttttttcttgtataccacataattaagccacctaactgttggcacctgtttggttttctgttttaaacacactgaaggagtgtaaagtatttcctatatttatggatttactactcaaattttggcca

SEQ ID NO: 589234 - DNA, 416 bp, Homo sapiens
atgtgcgaaagacttacctagaaatctaaggtattatttcagctgcagttttgcatgtctgcaaacacacacacacacacaaacacacacacacacacacagacacacacacacacacacacacacacaatttataccccaaatacttatgtgacagtatttgtttgtgttttttgaagacaggatcttgctctgttgccgaggctggaatgcaatgactcagttgcagcttagtgcagcctatatctctaaggctcaatcagtcctctcaccccagccctctctagtgtctgagagtgtagagcagtgtgccaacatgcccagacattaaaaagttttttttttcttttttcttttagagatggagtcttgctctgtggcctagtgcagtggcgcaatctcggctaactgtgcgc

SEQ ID NO: 589235 - DNA, 462 bp, Homo sapiens
ggccgagtgatggtcgatcttgaatcctggctcaagccatctcttggttcgctcctggattgaggaatgagcacggacttgtgggtttatactttggggttggagataacgagtttgagatcttggtccttactcttagggtaaatttcttagtcctggaatgtatgttttactcctaagatgtgggcttggtggggtttcaaatggatagtctcaagtgtttaaggtacttattaagcccctttaacttggcaggacttggactccaaactcttatctaacctgcagctagggagagctaaaatctcagctttttttttgggacggatcttgctctgttacccaggttggagtgcaacggtgtgaacatagtttactgtgaccttaaacttctgggctcaggcgattctcctaccttgggctcccaggtaggtaggactacagccattgcactccgggcag

SEQ ID NO: 589236 - DNA, 85 bp, Homo sapiens
gcggccgcctactactactactgctcgaattcaagcttctaacgatgtacggggacatgacccttggccataatatgatttatcc

SEQ ID NO: 589237 - DNA, 914 bp, Homo sapiens
tagagtacatttatttcaacctgaaggacttaacacttcctgaatggcaaatctcagggatacaatggattttcttgcagttttaaaaaaaaatccggaaatgtcttaatttctccttcagtgtgtggaaggataagtttgccagctatatattgctcaatggacaggttatctgcattattttaaatatataatccagggcctactggcacttcaagggtttcggccgagaaatcagtgctaatgttatctggatccctatctgtgagagtggctcttctctctgagttttcaacatttgctcccattatcttgtcgtggtccgttggacgacaaataatggttacatattccactgggatacacgagtgactatctctgggatacatgtatacaagtgcccaatgatcaacatacggcataacttagcatatccatcacctcaaatatctgtcatccatccgtagtggttgaacagtcaacattctttcttctagttgttcaaaatttataaacatgtaaattttattcacggaaatccaaactgtcgatctgcaaaagtcatatttgtatggcacattgtcgatcattctattcataatatgattgccattcttccttttagctttgacagagatctctaattgatcgttatttccaaagaagtcttacctggtattaatttatccacgtaatattcccctggtgtttgcccagttattcaatgtgattgactatcttctaaaagccccaaaaatgtatggggccaccatacagtgttccaaaatagcgcgggcatctgcctacaaatatcactgttgaacttggcgcaagaaaaggggcgcgaacctcacagacagcggcctcgcacacgagcgaccccatctggccacgagctacacacacgcgcacac

SEQ ID NO: 589238 - DNA, 544 bp, Homo sapiens
  misc_feature (417)..(417): n is a, c, g, or t
agctttgggactccgagtctatattgagtgtatcgagagcgctcaccattaaatcactagcggatgccgcgtagccaccaagacattgcaacgtcgatgcctagcatagtttccgatcggattaaaaccttagttgacacgccacactgcacggacgcaatgaagacaccgattatgcttagcaggatgttggccaactcagatttagtaaaggttttcaccgtaggtggcctgactggtattgtattagcaaactcataactagacatcggactacacgacacgtactacgttgtggctcactttcactatgtgctatcaataggagctgtatttgccatcataggaggcttcattcactgatttaccctattctcaggctacaccctagaccaaacctacgcccactttttcggnctatccggaatgccccgacgttactcgggctaccccgatgcatacaccacatgaaacatacttatatgtgtcggtgtattaattttttaacaggagaatttcacaattttcatgattgagaagccta

SEQ ID NO: 589239 - DNA, 431 bp, Homo sapiens
ccgagctgttcctcctcctgctatacctggtgttgcgggagtcgattctacttgttctgactcgagatcttgaacagagctaagattctctcttagtcttacacctttcactaggctcaggtcatcagtgtgttttagctatttgtcgtctgggtattatagctggattgacaagagtatccccttagctgtccttaatttctgcgtcatgccttgcatgagctctagcttgtcgtgtctccctgactcatctcgttcatactttcctctattacttgcaaggtgtaaggttgagtcgttgctcggcagaggaacgagtgagggaattcaaagtcgtaatcatagccatctctctgccctgtgtgagagctccctcatcaaggaggcaggctttccccctggggtggtgaacatcatcacggggtatggcc

SEQ ID NO: 589240 - DNA, 417 bp, Homo sapiens
ccaggatcccggcccacagccgtggaaggactggcccttggcagctctgcatcatcgtcgtcagagccaccgagattatcatcaaccctgccgacagaagatggtccagaagctggccctgtacggaggatggggccctgacagctggagctgctgtcgtccagctcctctcagctggggctggaacaggcaggccaggcccgaagcaagtgagattcagagcgagtgttcactgggcagatcccaaatcgcaacagtccacgcagcatcccgggccgacctcccttgccgcagggggggcctgcccgggaaaagaggccccgcacgcccggcacaccatggccgtccacctggggacgtaccgcgcctcaccgcccggcaccgaccgtcccccgtgccccactctcccccccaagc

SEQ ID NO: 589241 - DNA, 212 bp, Homo sapiens
ccttattgggctgtctagtcatcctcgtgggtcttctggcttctgggtatcgacatcgtcatcctcatcatcttcagctggcccgcttgcccgttagctgcctcagcttcctcatcttcatctccatcctcttcctcaccatcaccttcttcttcctcctcctcttcctccccttcttcttcctcctcctcttccttctccaacattctccg

SEQ ID NO: 589242 - DNA, 84 bp, Homo sapiens
agcgggggttcctggcgcttgcgcgcggtcgctgtcgcgcgagtggtagtgcgtcagcctgtccgccttggtgaagaagcggaa

SEQ ID NO: 589243 - DNA, 259 bp, Homo sapiens
  misc_feature (25)..(25): n is a, c, g, or t
ggagaccagggctgaggcaggaganatcacttgaaccctgggaggcgaaggttgcagtgagtcgagatcgcgccactgcaccctaacctgggcaacagagcaagactctgtctcaaaaaaaaaaagggtcttcaccccagccccgacccaccgggtcagatcttcctggcccgttgtcccggccatttcccaccccttaagctggggtcttcacccaagccgagccaccgggtaagaatcttttctggaccgttagctc

SEQ ID NO: 589244 - DNA, 292 bp, Homo sapiens
taggactaggcaggcgcggtggctaaagcctgtaatcccagcacttttgggaggccgaggaaggcggattccttgaggtcgagaattcgagaccagcctggccaacatggtagccagacatggtggcacacacctgtagttccagctactcacgaggcataggcaggagaattgcttgatcccagaaggcggtggtttgcattaagctgggaatacaccacttgcacttcagcctgggttgacactatcaagactcctgtcttcgtgctaggagcgcgaatatatactcagt

SEQ ID NO: 589245 - DNA, 628 bp, Homo sapiens
tgcccatatgtatgatttttttattttatttttggagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataattttggtattttcagtagagatagggtttcaccatgtgggccagactggtctcaaacttctgacctcaggtgatccacccacctcggcctcccaaagtgctgggattacaggcgtgagccactgcacctggccagtagccaaaacaatttttaaaaacaagaaccaaatgggaggagtcacactctcctcccactacctgatttctagccttctaacaaagttaatttaaactttataatgggctttaaacaaggttggatagataatgaaagttagtaaaagctaattgtcattgtcccagactgcactttgtgtctgaaagattaagtagaaccaggtatctatcttttcttgagtgcttcttgtacttccaacaagcataagatgggagtgctggagggagtcagtaaagatagtttcctagggaaggatggacttttgctc

SEQ ID NO: 589246 - DNA, 289 bp, Homo sapiens
gatatagtaccgcgagggaatagatgagagagatttataaccaaggcataatatagcaaggactaacccctatacctctctgcagtcatgaagtatctagaaataactttgcaaggtgaggcaaagctatgatccccgatatcagacgagctgagcctcagaatcagctagaacagcgcacccgtctatgtcgcacaatagtgggaagattataggtagaggcgacgaacctaacgagcctggtcatagcttggtctttgtgttagagatgtacatagttcaactttaa

SEQ ID NO: 589247 - DNA, 2151 bp, Homo sapiens
  misc_feature (1515)..(1515): n is a, c, g, or t
aggatgggagtctggtactgggcacgggaacgtgtgcagtgaagagactaggagtggtccgcagtggtccgagaaggccgtacggtcgttggtcggcactgcactcacgaattggtccttagacagttagcatacacctagacatcggacgatacaggcacgctgaatgcgtcgaagacatgcacaatcgctctgtggaggagtgcaacctggttggcagaggacttccaggaatctcaaccgtgagttggtcaccgcattacactggatcttcatcacagcacattgcgagtacgtgtaggcgcgagacattgcgtgcgcagtcctctgcgtaacgagtcacatcggtagttgagcatggcccgggttccagtttactaaaagggcagccattatgtacagaactatgtctcgttcattttgcgatcgtagctccctcctagtaatgcgactctgagctgtgatcccatgttcgaggcaagtcacacctcatagccatcccgaagacaaactgaggttagcggtaaaaagcccgcagacaaaccactatactccactagggagagaaacttaggagatgagcatttgtacagtacggcaataatatacacagggactttccgctatacagaagtttccagggttcgtttggataaacggctaattaagcaagggcgccaattgattgaatgcgtagtcgccacaagccaacaaccccctttgtgcgcccctttttaccatatgttacagcgacaggtggttgacgtgcaaacatatcaccgattagcacgatacggagaagacacaaagctgtggtttgacaatctgacaccccgtacagatgttacctcgtgtgatagttgtcccaacaaggggttgggtgaacgagattcctgttccgtcagaccatctgctctccctacattaaggagactgtgtccgttactccccaccgcaatagtcaaatcccccttatgacctttcgaacgacccgatagcgaagaccacgcatgaattgcccattccaggtcaacattgtgcctgtcattaccgcgagcggggtatactagatagtgccatcgtgcagaggcgcgtcatggcaacacgactgttcgcaccgcgccacaggttatgcgcacctccgttgtacgtagccagcggcgcaattagcatacaggtgcacctagcaacaccgatgaaacagacatacgttcgcgcactcgacgaaaggacagcatattaacctgtccacgcgacgcaacactacgcagggcatagtgcacatctactcccgatagcacgccaacgctgttatgacattacggtcctcgcttgacactagaccaatgcagaacgaacacagtcgtcgactgctgtcgagcgaaggaaacattgtgagatcacacacgcccaagactcggatacaccctcatgtggtgaccgtgtcaacagctaacacgctgagctggacttccgaccagatacaccttagctaaacgacactatggcccacgntgttcggccaacacgatttgtggaacctcaaccatcgaggacacggtccacacgacacatggtaggggtcatcttgtagacacgatgaagagcacaacctttgagagtaaattgtggaccaggtgacaacggaatcaccatttggagcgttgtcacacttgcccactgcacacgtgaacatgtgactcggagcttctagcaccggtaatctgctcctggtggactgcagtatattggcactctgccaatgtgcacacgatcaacctcgctttgaggatgacatattgtagaggcccgtcatcatcatccaatgcgtgacatccgcatcccacaggcgcagcccaaggagagacgcaggcccagaacatcaacactacagagtgacctagaacgcgagaaaggagcggggagtgacaacaccattcagcgacacccagtaggcgacacacgccgacaaacaggtcaacgcaaagagcccacagcacaagccgcacccgcgagtggcgcgaacacgaaccaccgccacccgcccaatgcgcaccacaagcaaaccgcacaactcagcggcagcacgacagcacccaccagccataacacgacgcacccaaagcccgcgacgacacgacgcgctcacaa

SEQ ID NO: 589248 - DNA, 437 bp, Homo sapiens
  misc_feature (67)..(67): n is a, c, g, or t
  misc_feature (320)..(320): n is a, c, g, or t
  misc_feature (355)..(355): n is a, c, g, or t
  misc_feature (422)..(423): n is a, c, g, or t
gccaaggcgttgaacgtcgaagatttccctgaccccgtcgcaccagcaagcgcaatgacggtatggncgccaccgattcggcagcgccggtcggcccgttccacaacggcacgggccagagccacgacgtcgtcaggaatatacccttccgacaggtccaccgctcgggtcagcaggtcgatacgctcggcaagatcgacgcgatgtcgcctcatcgttccccctgacgaggctcgggatccagaacgaccgccggttcaacgacctcagcgtcaaggcccggcatgttcgcttgtaactgccctattttggcaggctgnggtgcctcggcttcgggatcctgacaacgggttcngatcgtcacctgatcactgtgagaccctggcgcatcttgagcttaagtcgtggcttggagaagtcgnngctggaagtcattg

SEQ ID NO: 589249 - DNA, 97 bp, Homo sapiens
cgatgttgtctacaatgcatgtaataacgagctgggttcgtaccaagaccctgggtgaagaattggcatcgtggctcatcgacaacacaccgtaccg

SEQ ID NO: 589250 - DNA, 277 bp, Homo sapiens
attagctgcaggtatcagcttagggagggaaggctggtgtcacggtgagcctatcaccacactgctatgttgggtgtctgtctgggccccaggacagaggctgtggaagtcagggactgctggtcctgtgtgtctgcaagacttagccccatatctggcagagtggaggcttggtgagcatacgctctcacactcattctgcagatgatgcctggcatctgtgctgcatgttgtacacctgttgctggtactgagggggtacatggtggtgaaaagg

SEQ ID NO: 589251 - DNA, 362 bp, Homo sapiens
ccccacccagctccgctccgcttgggttccggcagaaccgccttgcggtagccatggagcaggctccgaggcgacactcctgtgatcgttgcggctggggctggaggggaggaaggtgaacatgtcaaaccttttaagccagcagcaaagcccaacagcaaacattcatcatgtctttcacacacaacctgcgaatctctctgtaaccataggtgtttgcattggcgccagcactgaccactggcacatgctaacataccctttccgccaggtcctctccatggcaagccagcatcaccgcattccagcaatggcggcatgcacacacagccatgcagccaccagtctccctcccagttcta

SEQ ID NO: 589252 - DNA, 277 bp, Homo sapiens
atggatcgaaaagtaaatcccactcagcaccatagtcacaggcatggaggggctcacacacaccatagccccagagatcagctttcattctggacctaccatgaaagacttctgaatccaggaagagaaactgactggagcaacatgttattcagaaacaggaccttgccctgatcactcaagatgcagttcagtggtcgtatcatggctcattatagcctcaaactcccaggctcaagcaatcctaccatgtcagccttcccagtagctggaacta

SEQ ID NO: 589253 - DNA, 107 bp, Homo sapiens
tgagaggtggaacatataccctgatgtcgaaaaatgtcgtaaaatcccacagacggaatattcaaaaagaggagaaagctcccgcgggagggaggcagcgagactct

SEQ ID NO: 589254 - DNA, 81 bp, Homo sapiens
ttttttttttgggggccctttcccacccccctcaggggggggggggggctccccctgatggggttttaaagaccctttaga

SEQ ID NO: 589255 - DNA, 317 bp, Homo sapiens
tcagtcggtcctgcagaacttactggaaatacaaagtagccagccaagggaagggtgatggcctaagccaccagctccagctttcttttctttctttttttttttggagctggagttttggctcttgttgccaggctcctgagcagctgggactacaggcatgcaccaccatgcctggctaactctgtattttcagcagggtttctccatgttggtcaggctgatcccgaactcctgacctcaggtgatccgcctgcctcagcctctgggattacaggcgtgagccactgcgcccagcctccagttttcttttcttg

SEQ ID NO: 589256 - DNA, 361 bp, Homo sapiens
ggccgaaggagtttttgaaaaaaaagtcttaatattcagcaattctttatcttcagaattaatactaatcatccagttatcctgcactgcaaatattttggtagctcagtccaacactgaaaaacaaaggcaataactgtcagtatatttaagagttgggttttttttttaactttaaaaagtctactcaattaagcaattctctctcaagttctttgtggagactaacttttttcctttataaattttagcgttttttctttctttctttttgagacacagttttgctcttgttgcaatggtgcaatcttggctcaccacaacctccacctcctggattcaagtgattctcctgtctcag

SEQ ID NO: 589257 - DNA, 692 bp, Homo sapiens
cgatgagagagagagagagagagagagagagagagagagagagagagagagagagagagagagatgagagagacttacccccacatatgtagccactctctataagtgctgtgccgttgccaatcctcctgtatgctatcccgttctgttcgctgaatttattcctcttttgtaagaccctccttttctaatcgacccttttcgtgtgctttttgaccagcttggtgagttccaattcctgattgcgctctttgttcgttgcactcattttgttccccatgtgtttactccaactcttgtttaggtctcctgacaccttggaatttttgtcaccaaatgttgttaacctcctgatgcttttgtattccctgggcctaatactatttttctcgtgttcttgaccagttttttgttgttcctgtcttcccgcccttttttgccttttttacctcatgctgcgcctattcctttttgttcttctaccttgcttttttctcttgaagcccttgcctactttcccagaggttttttcctgcttttcccttccttccgtttttttccccctttttgtgatgggttgacccctttttataccctacccgtcctcgtgtggccttgtggcccctccgccccctgtcctatcttttgtagcccctgtgtggcctgtttctgtctgtttcccccttttttgc

SEQ ID NO: 589258 - DNA, 84 bp, Homo sapiens
tagagaactctcaataaatatttgttgagtgaatggagtaaatggtggcctctactagtgttagtggatctctgtcagttccag

SEQ ID NO: 589259 - DNA, 483 bp, Homo sapiens
cgcattacagagatcctcagatgtacatatacacacatgtacacaacacgcacacaaccttacacccatacacacaccctcacatgcacacacgtcgatccaccacattgacacacacccccgaaaaggcacatatgcacgcgtccactcacacacacacgcacacataggtacacaaacaccctcacatggccatgtacacacgtccacacacatgcacacagcccttacacacatacacatatgtccagacgcgtagcaaagccttagcacacaccgttcacaaggcctatatacgcaaatgtcacacacgacatgcacgtaccctttcagcgagcacaaatagcatggtacaacccaacacatgcacacactcttacacacacatacacccattatacacataccctcacacacttatgcacacgtccccacactcgcacacatacgctcacaccttgtaacacacaatctcacacatga

SEQ ID NO: 589260 - DNA, 1134 bp, Homo sapiens
gaagaggcctcgcgcagaggagggagcaattgaatttcaaacacaaacaactgcacgagcgcgcatccaccgcgccggagccttgccccgatccgcgcccggcccgtccgtgcggcgcgcgggcggagacgccgtggccgcgccggagctcgggccgggggccaccatcgaggcgggggccgagcgagggccgtgagcggagcggcgccgccatcgacggacgcggcaaactttgggctctgtgctttcccggcccggcgcggagcccgggggcgcccggagccccgccaatgtcgacgatccaaccggcagaaggagtacaaatgcggggacctggtggatcgccaagcatgaagggctacccacgacttggccgggcccggatggacgaggatgccatgaggctgccgtgaaatcaaccagccaaacaaataccaagtcgttaagagacggggaacccacgagaccggccatcctgggcccaaagacctcttccgttacgaggaatccagggagaagttggcaagcccaacaagaggacagggtcacgcgaggggctgtgggcagatcgagcaacaccctactgtcacgggcttccgggctatcaagtcctcacagacagaagagctgtgtgggacaggagccttgaaccaagagcccgaagctgcagacgggtgacggtgatacgaagggggaatgcagaggggcaagcaggcgccgaaggcaggggcacgctgggtctttaatgagccacgccaaggcaacagaacgaacaacaggagcggtcgacaacgacacgcacggggacatgccggacggaccacaccatacaggcccaaggaggagaaacacttgaggcagcgacaagggcagccacctgaaggctaagggcccatcctatcgaggcaaccgaagatggcacaccgagaccgcactgagaggagggacccaaaggacgaagacaggcagaacagacaagcaaccagcacaacagagagcacggaaaagaaagagggtggacaaggctaaaggacaagaaagaaagcgaaacacgaccgaacaaagacgtggcccgacagatgaagcagcgcccggagtgggaaacacaacaaccaaatgcgcagatcaacactt

SEQ ID NO: 589261 - DNA, 441 bp, Homo sapiens
  misc_feature (18)..(18): n is a, c, g, or t
  misc_feature (405)..(405): n is a, c, g, or t
tgggtaatgaaaaacaantgtatggctatgaaaacacgaagaggaaaattgttgtggggcttctaaagaaagatgtaggggcccagccctactggctcaaaacctgtaatctcagcactttgggaggctgagatgggaggattgcttgagctcatgagttcgagatcagcctgggctgatacagtgagacctgtctagaactcccgggttcaagcgattctcctgccccagcctcccgagtagctggaattacaggcgcccaccaccacacccaactaattttttgtatttttagtagggacggagtttgccatgttggccaggttggtctcaaactcctggcctcaggtgatccacctacctcagcctcccaaagtgctgggattacagcatgagccaccacgncctgcctccacctggctatattttctattttttata

SEQ ID NO: 589262 - DNA, 308 bp, Homo sapiens
cacgagggggcgagctgtcgtccttcttcaaacggaccgagccccacagcccggtgggcttcctgctggatcgggccatcagctgggccaacctgccactcgacgagtggttgcgggaggtggtcagcgacgactccgtgctcaacaccgtgcgcgaccgcagcggcatgccgcgaagctgagccgggccgctcgtcgcgtcgatccggggcaggtcccaccaacggcatatgtcgacgaatggccgtccggctgattctcgccggcaccgagcgttcctagactcccggtgtcgaagcccgcgcgca

SEQ ID NO: 589263 - DNA, 713 bp, Homo sapiens
gccagccgggccgcgtcgcaccagaaccggaagaaggcggcccggcggcaccatagaaaaggactacacgcgcctgggcaacgagctccacacgaacaagcgcgtggcgaggagagcgccattatccccagcgaaacaagcgtccgcaacaagatagcaggttatgtcacgcatctgatgaagcgaacttcagcagaggcccagtaagaggtatctccatcaatgctgcaggaggaggagagagaaccgagagacaattatgttccatgacggtctcagcctgtggatcaggacgatcagttgacacgctagatccctgacacgtaaggaaagtgctgaagctttgggacttcggcaggtctgtccaacccttcagggtcactcagtcctacatgttgggatgaactttcaagaacgcctcggggacctgttctgaatttagttctgtagtgctgctattattttcaactaaatctgggacaacagcataaaatataaaagacagagagcaataaatgcaactgcaaataatgcctgctccaagcacgacacaaaaaacagaaccatccggcaaaaccaaaacaaatagaaacaccgacatacacagcaaacaaggacatgaaccagcaacccgcgatgaagacaaaacaaacgcgcgacgcaaaaagaacaaaccataccaccgaaggatactccacaccaacccggcaaat

SEQ ID NO: 589264 - DNA, 892 bp, Homo sapiens
  misc_feature (178)..(178): n is a, c, g, or t
  misc_feature (247)..(247): n is a, c, g, or t
atggaagattagaggtttgtcaacacaaagatacaggaagaatgggctgcagaagatttagatgttttccatttgggcacattttacttagctggagaactaggtttaaaacagcctgggtaggaaaattagaagcaagctggatgcagtggctcatgcctgtaatcccaacactttngggaggtccaggcaggaggatcacttgggcccaggaggtcaagcctgcagcgagctgagatcacaccantgcactccagcctggggtgatagaacaagaccctgtctcatataaaaaataaaaaagcaacaaaaatttagaatggaggagttgttcctccatggggttcgttcactccaaagatgggtgctgcatctcattccatattcctagtatcttggccacacttatggggttgttggttgctcgacgcagtcgcatgttgtagccaatgatagcttaggggccataggctgcccatatcgtagagcgaaacagccagtgaggactgctatggagctcaagtaccagagtcctctaatagcaccttgaatccattggttggcctatctcatgccgtacagacaggctgtgggtcctcttaacattggccattcaatggtgcagcgacgagagtggacaaaagggctcggaatggtctcattgggtcgacagtgaacgtggatctcgaagtccactggacagtattttaacaatagggcttaagaagaagggaaaaacgctggccctcgtgggctcaaagtcagtgtcatgggactcgtgtgaatttcccgaagctcagcttttttacacattccaagctctctatgttcaactctctggaaacttgacactatttacacacctggcccaaggcatatttaaataaggcca

SEQ ID NO: 589265 - DNA, 574 bp, Homo sapiens
  misc_feature (41)..(42): n is a, c, g, or t
  misc_feature (134)..(134): n is a, c, g, or t
  misc_feature (230)..(230): n is a, c, g, or t
  misc_feature (282)..(282): n is a, c, g, or t
  misc_feature (320)..(320): n is a, c, g, or t
  misc_feature (339)..(340): n is a, c, g, or t
  misc_feature (372)..(372): n is a, c, g, or t
  misc_feature (387)..(387): n is a, c, g, or t
  misc_feature (398)..(398): n is a, c, g, or t
ggtgtacgtgcccaccaccaggtcccctccatgctccccannctgccctacctgcccagcagcggctcttcccagcaagccagccccgtctccagccactccatctggactcaacctggagccgaaagcgccgnatacaaccccggatcttcccacccgcccgtgtcacctcgcttctccttctccaccagcactcccatcccctccacctcatcgcgggatgccgcggnggcttacagcagctccctgagcctttctgctaacgggagggagcaatacagncggggcttcggcagctcctactccagcccttacccggngtacgtgagccctgaaatnngcaccacttggacttcttcgcccttcgacagncccatgctgcacaanctgcagagcanagggacacccgcggccgcccggaatgccaacatcgaatttttgatgattattcagaagggcgagcatgtgtcaactgtggggcatgtcaccccgtctggaggagaagatggacagggactacctctgaatgctgtgggtctataaaagatgaaggcataacggtcttgtcaaactc

SEQ ID NO: 589266 - DNA, 139 bp, Homo sapiens
atccttgaagaacgaaagctacatgaggagagccccatgttcactcagttctctgactagtgggcagttttctggattgtagcacagtgaaggtgaagttcaaacactggcacattgtactcactgtgacaaatgtgaa

SEQ ID NO: 589267 - DNA, 790 bp, Homo sapiens
taaactaaaaaccgaaacttttgaattttttctccccaaaccaaaacgctgacactagcccgtaagttccccttaacaagtgtttattttctcttacaacagaaagctgtgggacagaggatacaatacacagcccactctcaaccagggggtggccaacattctcgtgtttaaaagagggaggggagtctcaaaagaaaacaaaacccccctctcgcgccacattcttcccttatattcaccctcccttaaaagaccaagagggaagaaccattggaccacccctctcctctccgtgattaaacacatgtgccacgtgtgtggctcagtgtgtgtgcgcagtatacaacgagagaaaaaaagaaacacacctataaagaattattgttgtacacacccttttattttctctttataaaatctctctctctatatatataacacaccattatacacctttctccaagaacaaactctcccacaacccgtgacacattgtgctatatataacaccaaatctctctcatttctcacaaaaatatatatctctctccgtgatataatatatctctctctcacaactctctctctctctaatatattatctacaaacatcttgagacactctcccaagagagagactgtgtgtgagcgccacaccctgtgggcgtaggggacaatactttcacagctgtgaggacctctcacaggagggcggacacacaagagaggcgcttgtgagagagaaacaaagaaagctctcaccaaacagtgtgggcgagacacacaa

SEQ ID NO: 589268 - DNA, 346 bp, Homo sapiens
agcctacaggatctcactaggtcactcagtacaaaacgaaagctctaccacctgccaggccctccatgacttggcttcatgtctgacttctcacactcacacctgtagccccactggcctcactcttccttagacaggctgtgcagactcctaccccaggtcctttgcatttactgttcactttgtctggaaagttctccccagatcatgtgttactccttcactgctgaacctttcttaaatgtcaccttctgtaagaggcttttcttagccatcttcaaaaatctcacctgcaaataccacccatacttctgtccccttgctttgtcttttctcttcagctctt

SEQ ID NO: 589269 - DNA, 328 bp, Homo sapiens
gactagttctagatcgcgagcggcctccatcaaatggcggatgacgccggtgcagcgggggggcccggaggccctggtggccctgggatggggaaccgcggtggttccgcggaggtttcggagtggcattcggggccgggtcgcggtcgtggacggggccggggccgaggccggtacgtcggggggaaggccgcaggataaggagtgatgcccgtcaccaagttgtgggccgttgtgttcgaaggaccttgaagatcaagtccctggaaggagatctatctcttctccctgcccattagggaatcagagatcatgtgatttcttccct

SEQ ID NO: 589270 - DNA, 921 bp, Homo sapiens
  misc_feature (11)..(12): n is a, c, g, or t
gtaaactgttnnttcacgtgggcagtcggcccagcgtcgtctcccgtgtatatgaggtgcactctgtccgggacctgtgcctccggatgcagcgcgctccctggttgaccacggcccaagggaacttccgttatcctgggcccctgtttttaagcccggattctgaggtaattttgggaggggttagcgctaaatatctaatgtgggcgcggtctataactctctgtgatattatgccgtcctccccgcttttgtgaaggccccgtgtggtccgaccggcaatactcctgggcgccccccgattcaaccctgttcagagaggccccccgttggcaacgagctttggcagagtggcccagctccctaattagcccctgggggacataattgccccccaaaggggaatactcccttaattgtcccgcagatcacttgctcgctcgcaacttttcccccgggtaatatttcttgggagcattcgctccctgtttcaaccctgtgacaacgccccccgtgggggcggttaacaaaatagattggggggcaatttcataaaaataaggggacaatccaggtatgcggaccgagattaaaaaagtgtcttgaaatccctggaggaaacaagcgctgggagcgctttcaaaatccccctagtccccttaaaaaccacatcccccccgaccaaagttatgcctgaaatcgcccccccccgtgtattgaagagcattactcccccaatgctgtgtataggctcgttcaagaacaaaatggctcgccaccaatgattcacctcataagcaatggaagtttcgaatgcttcccaccactcggcgatcttattaatcctgtcgcaaacctggtcttttctgaaaaacatattttctcttcaataaaaaatctctaatcaacctcaacaaaaca

SEQ ID NO: 589271 - DNA, 554 bp, Homo sapiens
gtatgtgaggctcaagttagattaggtgggaagggctacctagaagcggtgcaggtgaggtacccatgtagagaggatgggccatttcagctggggtgggtggatctgggacacctttttcactatctggagaaaaagacacataggggtggtccagggctgcggtggtcacagagaagagcggacagcaaatgaccaggcggggcagggctgcttcggtgtgatcagagaccttcacagcggggagtgaggccttacgccagacctgcctctccgggtcccagccaggagctccgggccaactctgaagagggcacattcccttagcttgggcatataaagagggcctgaatttaaatgtaaaacggagtggtaaatagtcaacaaaagtcctgatatttcttgggtgtgaggtaagactccttcacagggcctggcgagtgacctaccataaatccagtctgcggggagcggggccacccaccagaacaggccctatattatggggggccaaaggggttcactgcttaagtttatcagaccctatgtgccgg

SEQ ID NO: 589272 - DNA, 515 bp, Homo sapiens
  misc_feature (1)..(1): n is a, c, g, or t
nattttccccccctcaaaaggaacaaaaaggggggtcccccccggggggggccgctcataaaatatgggttccccccggctccaagaatttgggcccggagaaaaaaaaagaaaggaggaagttttccccgggtggttaaatggggaaagagaaccccggggtggcccctcctaaaaaaaaaccccaacccctgtgtggggatccccccgccccccccgggggaaggggggtgttccttttaattaaagaaacccacctggggggaaagggataaaaaaccattttggccccggcaaaatttcccccggtgggggcccctggggtcaaaacaaagaaggttgggggttcccccccttgggggggttaaaacccccccaacccaagggggggggtttatgttccggccccctagacccctttttggttttttaaaaacccggggggcaaggggggctttcccaaatggggccttttttttttttaaaccggtccccccaaaaaaacgggggccggg

SEQ ID NO: 589273 - DNA, 190 bp, Homo sapiens
cacagtaatgatgttatcaatcagtgatgaactgcataggacggtggtcccattatgattataatggagctgagaaacctctatcgcctagtatatactatactgtacttgctgttatcatatggtgatctgaccatgaagtctcatatctgtagcccgagtctggagagtagtagatgtgatctctggc

SEQ ID NO: 589274 - DNA, 271 bp, Homo sapiens
accggtagagcggctagagcggtctgaagttcttgacttcctgtgtgttaccaactgtagaacaactaacagctcctacaagccaattccttaagtggttcactgtttccatttttggccccatagcgtctcttctccatatagtagctgcactggcacagtgtctggcacacagcaggtgtctgctcaagcatatgttgaaagtataagttatttaatgaaggaatgagaggtgaagaagagcagaaggggcgccatgagaccgctctta

SEQ ID NO: 589275 - DNA, 208 bp, Homo sapiens
  misc_feature (132)..(133): n is a, c, g, or t
  misc_feature (208)..(208): n is a, c, g, or t
ctcctccgagctcgctgttcgtccgggttttttacggtttaatttccaggacttgaacttccatgttcctttgaaggaggaaagctcttcgttgggagggctctaactttaacaacccacgagcgaggcacnntgaagagccacattcagcaagtttcggagcctatctctctaggtgtgtctgcttgtcaaagagcccggagactcn

SEQ ID NO: 589276 - DNA, 359 bp, Homo sapiens
  misc_feature (171)..(171): n is a, c, g, or t
  misc_feature (181)..(181): n is a, c, g, or t
  misc_feature (330)..(330): n is a, c, g, or t
ggcacgagccggagtcctcctggtgttggagggctggtgttcctggcgtgcctgggcaattctggaattggaggcatcgcaggcgttgggactccagctgcagctgcagctgcagcagcagccgctaaggcagccaagtatggagctgctgcaggcttagtgcctggtggncaggctttgnccgggagtagttggtgtcccaggagctggcgttcaggtgttggtgtcccaaggagctgggattcaagttgtcccaggtgctgggatcccaggtgctgcggttcaggggttgtgtcaccagaacagctgctaaggcagctgcaaaggcancaaatacggggccaggcccggagtcggag

SEQ ID NO: 589277 - DNA, 498 bp, Homo sapiens
attaggagaaatacctaaggtaaatgatgagttaaggactgcagcaaaccaacatggcacatgtatatgtatgtagcaaacctgcacgtgtgcacatgtacccgagaacttaaagtaaaatttaaaaaaaaaaaaaaaaaaaaaggccggagtggggttaggatcaatttttcaaaaacctttactacggggtgatcaattaattttttattgggatcaccaattcgtggaggaagaccagttacgaaatctagcgggctgaccacgaaacattctccactccgagggagaacaagccagaaacttctctttcataaagttaacatttaagggtgactaggctgggtacaaattctggaagtatggtgaatttgggggcaggaattctccccttgtgataaggctggtcacttcacgggatatatatattggggcccaattgggctccggcaattagggtttggacaagagggccttcacgaactggggggatactgg

SEQ ID NO: 589278 - DNA, 632 bp, Homo sapiens
cgcaccagatatgctcctgctctgagaaggtgggtatatatacacacatgggacatactcactctcaagggctgatgagatgctgaattttctttgggggcattcattaattgtgccaactgcagcgactggagcaagtgtggaagctgtctgtgctatagacacacccagatgtgcctgggttctcattctatggccttctttgcgttccaagtcaggggacactcggttaatgagaaagcgactggattgaggctatggagaggtagggagagctgagttctgactctacctgtgcagaactctctgtccccatgtgtacctggactggaacagactgtgaatatatgcagaagggttcaagaactctggtgtgtgacctataagaggcgcaggtctctctactggaaagtctaaggaacctgtgggaggatgcacgaggctgaaaggatgcacctggcatatctctcactgtgctcttaccgcattagcaacccccaactctttgggcctactttgtcccccatgcgcgaatacccctgctttggatgctgtggctttttccgcgttgtgtctaaagacccttttttccacggcatgttggggttcccctgggccttaggggtttgggt

SEQ ID NO: 589279 - DNA, 464 bp, Homo sapiens
  misc_feature (55)..(55): n is a, c, g, or t
  misc_feature (458)..(458): n is a, c, g, or t
gtgggtggagatggtgccactggagtgacagagcgagactccataacaacaacancaaaatttgtgaaagaaaaggaaagtgaacctgaagttcaacggtcaaatttttagtccccatattctgaattggcaaggaaaagccaaaccaaattatacaaagataaaaatatatatgaaaagtgagaaaacactaaagccaaacaagaatgacccagaatcaattaaaaaaagggaagtgacagtataccaataaatgggtcagaaataaaagcagtaaaaaactacagttaattacagttgctgaaaatgaaaatatctttgttaaatttaattcaatgggtaagggaaaaaatgacatgaatgaaataaaatgttatactttttaaaaggcagagagggagcataacaaaggttttattcttggaccaataagggaaccttctaaattaccaaaaaanaaaaag

SEQ ID NO: 589280 - DNA, 275 bp, Homo sapiens
  misc_feature (69)..(69): n is a, c, g, or t
ggaagatttgactcgggcccggcacctccaacaacattcaagcctaacagtcctgacctggccaagcantgcaaatctgcttctccacagcctgcttttcatctcagaccagacactccagtttccgtgagagggcaccacgtgattcagggactcctttggacaacacctttgttgggggttgtgacacctttctgaacgctctcccctagttcagatcactcagtccctagggtcagttccaagggggcttcagacaaaggcccttacacaca

SEQ ID NO: 589281 - DNA, 263 bp, Homo sapiens
tgggtaggggctacctggaggtataaaggtcagaaaaatctgcgaagaacaaaacttctgaggtaatacctaggatatcccgtatcgaaggcctttttggaccaggtggtgtgtggtggccttggtatgtgctttctcgtgtacacactcgcgccatcattggtatatggtcagtgtgtaggttagtaggcctagtatgaggagcgttatggagtggacgtgacactcacaatgacaagactaaccacaaccacctgctttta

SEQ ID NO: 589282 - DNA, 980 bp, Homo sapiens
gagcgcaagacggtaaagacaccaggctaggaggcacggtgcggacgccagcgaggcaagacccgacatgggcctggcggatggaacgagggctgcaagactccggggcaggcaggcacggtgcaagacggccagcgaggccacgactgactacaatttaccacattgcaacaaggcaacaaccaggtaattcctacaactctcttttggacatgtcaaacaccatggacacattggtactttctcactactcgaccagggttggtcttcccaaggaagcattgccaacgctatccacggctgcccccttccggccaagtactcgccctgctcttcgacgcagatcctggctttgggcacccgaggccctccggtcagttcacacagaacaacggcaattggcatgtgccctccttccaagagaactgttgttccaagtacgctggtaacccaacgatttgcagaaaatggcatggcccttggcgctacccccttgtgcgaccgacgaacttcaccgttggtacgaaacggtcatttttggcaacaggcccatttggcccttccgtgagcgcaacaatatttgggttaccccccctaaaggaaagcaccttttttggcgccacgcgtaattggacctccttcctcattgggaacacataatttggcccctcacagcgatcgtctacacagttcccgttagcaagaggactagctttgtagtcacgactttgtaaaagcgattctaaaccacggtgggaggacacttcgcagccgcatcgaactttttactttcgcccctttctcccctcgtggaaatgcaaaactgtgcacagcgtccaggtggtggacaacctcttccagaagagttgttggtgccgacaccttaactctcgcctatcatcttgtgtcagaaggagcaataaactcagaggggacctctgccgtcagtttcatgttcgcatcacagctcagtataagcg

SEQ ID NO: 589283 - DNA, 484 bp, Homo sapiens
gatccagcagtagaacgagcatcatgccttgtcatcagggcaggtttccatacccacacatcaccatcctcacctccagcatcttcctcagccgtcccctgggattacatcaaccgccagtgcgggacagactgtaatgctcaccagcagtgcctgaagcatgaagtggagaccacatactcaaggtttccaaagacttaatcagagaactgtctcatcgctgatcacagtgaacacacgggaactagactgaaatggcgcaacaactcagatcaagactttcggcaatagtagacaaagtaacagagatgagaagcacaaacagacaaggcccaatcatccgctccattccagtaacagagccagataggtaggcacaacttataactacacgttcacacgtgatcaaccagacaatgaagcacagttgaagggtagtccgtagcaaaagcccaggcaaatatccaacagcggacatcccaca

SEQ ID NO: 589284 - DNA, 399 bp, Homo sapiens
  misc_feature (91)..(91): n is a, c, g, or t
  misc_feature (95)..(95): n is a, c, g, or t
  misc_feature (222)..(222): n is a, c, g, or t
  misc_feature (241)..(241): n is a, c, g, or t
  misc_feature (244)..(246): n is a, c, g, or t
  misc_feature (283)..(283): n is a, c, g, or t
attcattcatttattcgtttgaccaacatctacctcaagggctttttgcccgcgattaaatgacatcatgtaagtaaagcttctagttcantgcntgacatattgtaaattcaaactttcattaaattcttattccattccagatgccggaagacacaaaataaactaaaaagtgtttgttgacgtggaaggaggtagatttgttcccattctagaaatganaaacagagatttggggaanatnnntaactatcccaagcccacacatacaatgagggactgnatgagtattcacgacttgggtcttttgctggccagagcccatgctctttccattctgctcctttaccttacaagcctgggtttacagagtcattccttcccaggagtaccattcat

SEQ ID NO: 589285 - DNA, 1292 bp, Homo sapiens
  misc_feature (471)..(471): n is a, c, g, or t
cacacgagtgtacagatgtgtcatcatcccccccttatttgttcatggacgctctattttgaggtttcataaaaatcaaattggttcaacaaaaataatttggccaccacgggactcggtgaaaactctttaaatatggacaaaaatgtgtcccgcacaatttgtgtgaagttgttaatatagtgtgggtttaacccggaaatatgtgtaaaataagttagtctttaaatttatgggggaacccccctgtgagtagatgaagcgctctccctaggggaaaattaaaaaaggtaaactccccatgccacttttttaaggaggtttccaattaaaaaagtgtgtttgaaattttttttttttaaggaatgagttatatttaaacctcttttgatttttctgggggccaccctattggtgggtcttatggttagagagtattttatcctactccccccccccccctcggagagnggagaaaattcacgcaaaatggaggttttaaacccccccacgctgggaaaataacacactcttaaaatgttcttataaaaggcggggctctctctttttcaacgtatagtgtgggagactcttttatagaaaaagtgggtttctcacgttatgtttataaggagaagcgtacaccacatctcttatgagtcttacactttttataaaaccggagtggcccctttctcttaaagagaattaaacgccaaaaaaaggtgaaattttgtctttacaagaaaaagtgtttgcgcttttctccccaaaaaagggagtgaaataaaatgccttcttccctacacacgccacaccacatatatgaggagaagaaaaaaaaaagggcttatattctaagaaatttcggcgaataatttgtaccacgccaacatgttataggtataaatatatatatgcccgctctcccgtctgcgtaaaaatatgtaaaaaaggcctctgagattggaccacaagagaattatacccctggtgctataggtcacacggttgtttgttttgtctcccttgagacacaacctcttggagaaaaaatggagatttgaccacaggaacacatataatcacaggttctactaaacccaaggtgtgtgatttgggaatattactcttttgtgacaccaattgagattataataaatggctctaaaataactcttgtgcacctcttataaagccacaaaggcattgtgaactttaatttgtttattactgtataagtatatgttataatagcttttatcactttgagaattaaaagttactaatga

SEQ ID NO: 589286 - DNA, 301 bp, Homo sapiens
cttagcccgtaagaggatgatgactccagcctctgtaggtacctgcttgagaaaactcaatgctgccaggcgaacttactgttgttccaggcaaaactggtgacagtgagataggcctggaatacctctttgagccgcagttcctttagacaggttgcattgtgggcccgggctggtggctcacaacctgtaatcccagccactttgagcggctgagttgggtggatcacttgtcataggcgttcacgaccgggctggtcgacatggcaaaagcctgtctctactaaaataccaaacttag

SEQ ID NO: 589287 - DNA, 1976 bp, Homo sapiens
  misc_feature (1645)..(1645): n is a, c, g, or t
tgtggtggcagaacaacaccccacgtgttggggtgtgatcgtataagaaaagaggactcgggtttgttgataggaaggacggaccagtgtgtgttgttcacagcgcaagaagggcgtgtgttgttgcagcagaaagtgatcgaacatcgaacgagcaaggtggtgggtgttgtcgctgcaacagcacagcgtgtcgctcgcctgttagtctggccgccgccctcccgccatcacagatgtttcaccgggcgggctctgagtgtttatctttgggtgcgggggaaaaagagtagtggaaggaagatccctcgtggtttggtggaagaaaaaaaagagatgtgggcggccacacacacaggctgctcagtagagtgctagtgtattaaaagaaaggcttgtgttggcaccacagagggaagagccccccgcacctcccctgtgtgtttatgtaggggggcacccccccctcctcccccgggtgtaatatatagtgaataaagggggttttttaacccgcgggggtaagtagaaggtgtttatcgcccactgtttatttgccccccccaccacaggtgttgtcggaatagcttccgcctggagatagtgggaagtagtggtagaggagtatataatatatataatagggtgctcggcgggctcggtgttgcgccccccacaccgtctgggggcgtgttcttctttctgcatgtagtgtggaagctgcaggaagaggatgatttgtgggaagattgtgataaaaattaggtgttgtaaggagccaccacaagcggcctccgttctcgtgccttttctccttgtgagagagtggcccccccacaacaaggggtccatcaacaataggggaagacccccccccctcttttcggggcgtgtccaacaacacctcggtgcgcgccccacacacaagaggagtgacgaccctccttgttgtgttgtgctttctgtggagtagggaagactattgtggataaaagccgggcccgaccaactaagtggtcgtctcctccgccgcctacatcttgatgaggggacagacacaacaaccactgctcttctctcctgtgggggggcgacaccttgtgggcacaacaacataatgtcttttcttcctggggagagacgaccacaactccgtggtgatgaagataataaaaggaagacgccgcgcgtccttgtggtgtggtacaccactcctgttgtggtgttgatcaccttcaccaccaagaagaagtgatgttgtcgggtctcttgttcccccctcgctgatgagagaagattatctcctctactcttctctacagacgccacccttttctactgtggaggagcgtcgtcgcacattgttctgtcactactcacactcggggagaatatgtggttccacacacgcgcgagactctggtgaagaccacaacagtttgttgagaggagagagagaaatatgagcccctctttgccgccaccacaagtggtggtgtcactaccgcacctctctgtgtgtgggagagacaacacacacacactgagacgacacgggcgtggccgcactactgtctctgctgagagagttctctgggggtgttctctctctcagagagagccacacagagagagacttgtcgcnctctgtttccgcctgtgagagtgtccacagagtgtgtgtgcacaggtgtgtagacttcacgagagtgtcacaaacacacacatgtgccggaaacatggatctcctggccacacgagagagaacacccagaacagctgtggttctgagaagatacacttttctcctgtgggagaggggcccttcccacgcacaaggtgggccaaagaccccttctcaatccagggccaagaatctttctaaatgaacacattttttgcccatcacccaggctgcctgcacctgccctttagggaaatgggggtccatttaagggaacctggaccaatttgaa

SEQ ID NO: 589288 - DNA, 412 bp, Homo sapiens
  misc_feature (67)..(67): n is a, c, g, or t
  misc_feature (88)..(88): n is a, c, g, or t
  misc_feature (139)..(140): n is a, c, g, or t
  misc_feature (286)..(286): n is a, c, g, or t
  misc_feature (332)..(332): n is a, c, g, or t
  misc_feature (375)..(375): n is a, c, g, or t
  misc_feature (411)..(411): n is a, c, g, or t
gacataatttgacatctcacagtaagagaaagagctgggatttgcacgaggggtctgcatttacaanttcagtgttcttttcatctcngtgctgctgtccctttggtggtgaaaaaaattatctatcagtccccttgcnntctgccatgtttctctcaagcattgcctggctgagaatagttgcccaacagttgtgaatttccttctcttcctgtttcctgcttctccgatctggccaagtttcttggctgcaggcatttacagactatcaaaattctctaaaacnagttcaaaccagtccctgtgtatgagcagaatatagaatctgtcanaactgttggcacccttgataatcatgctcttcttatacagctnattgctttttttctaaaattgtgggcctaacctcana

SEQ ID NO: 589289 - DNA, 210 bp, Homo sapiens
ccagcctcgctcgggtgtagggattgcatagaaagcaaactacacagtcttgactgtgtagtttgttttagggtttagaggctaccgattcatgtcggaagatggtcagaaaacccacttccataggacgtcgtttcagaggcaccttggcctagtccaccctttaggcacttgagaaatcagagtcctagaaagatgacactaagcacc

SEQ ID NO: 589290 - DNA, 859 bp, Homo sapiens
gatttcccctattctcaggctacaccctagaccaaaacctacgcccaaaatccatttcacgtatcatattgcatcgggcgtaatatcttaactttcttcccatcaacgacatttctctggcctatccgggaatgccccgacgttactctggactaccccggattgcatacaactcacagtgaaaacaactccctaatcattcttgttagggcttcatttcatgttcgtcgtaaaccatgccaggtatagtgacttagagtaaacttttgtacatggcacttttggaagacatgcccttgtgccgactttccgaagaggccagagagagattggttcctcaccattagttaagaaccagaattcgcgcattctccacttaaatagcccttggaacgctcggaacttacttattgcgaaattgacacaccacgcaactcactaaactcatcgatcgaatttccagacaagaaaacgccctgtagtcaccatgaatagagtctacgtagcaagataacagagaaacgagcaattcggaaaccctcccattaagctgcgtttccaagggcctcaatccccccacatgtgttcggtctccacttgtgagccttttctcccccagaccaaagaaaaattatcccgttatacattcccttaggctccagagcaaaggaccaaggagcatttaaagggccagtacaaaggagtactttgcccctccttacttgccctcggttaacaagggtcccttctgtaaccattacggttttccccacaaaagccctatctttgccaatgtggagcgttcgaatggcgccctagcatacctttgtatccgtcggcacaacatgttaaactcagt

SEQ ID NO: 589291 - DNA, 457 bp, Homo sapiens
gggtatttctttcttccttccttttttttcatggctcactgcagccttgacctcctgggttcaagttatcctcccatcttggcctcctgagtagttggaactataagcacgtaccaccatgcctggctaatttttaaattttctgtaggaaatggagtctcggctgggcaccgtggctcatgcctgtaatcctaagactttggagagctgaggtgggcagattgcctgagctcaggagttcgagacaagcctgggcaacatggtgaaaccctgtctctactaaaaatataaaaaattagctgggcgtggtggcacgttcctgtaatcgcagctactctggaggctgaggcatgagaattgcttgaacctgggaggcggaggttgcagtgagccaagattgcgccactacactccagcctgggcaacaggctcttcccatctcactgactctgtctca

SEQ ID NO: 589292 - DNA, 241 bp, Homo sapiens
ctctcgaccccaatctcggactttgctaggccaaggcaggcggctggcaggtgtaggttgtagtgagccgagatcacgccactgcactccagcctgtgccggagagtgagactccatctaaaaaaaagattaaaggggcacaaaatgggtactcaataaatattttaatgagtaaataaacatacttaagtaaaacaagttaaccttatttacagcaaaacacagagggaagaggtcagcg

SEQ ID NO: 589293 - DNA, 365 bp, Homo sapiens
tgtggtgtaccggctcaattgtttctcaggatagcttcggctataatgggtctttttagtttccatcaaatttaaaactttgttccagttctgtgaaaaatgccattgctaattcgataggaattgtgttgaacccatcaacacattttagtagtatagacatttcgacaataaataccaagaacatggtatttactcttttcaacctgtctgtactcatcttcgactttctttcattagccgtctcgcacgctttttcagcaatacaggctctctcgctctccctttacgggtaaacacccaacagctacggcgctaccgcagcctcgaacttcgctacatcactggctcactagcctgctctc

SEQ ID NO: 589294 - DNA, 441 bp, Homo sapiens
gccgtgatccagcacacgagaaagatgcaggttgggagctagaccagtctagtcttttcacgtttttctgcctgcttatagtctagcctcgctggcctgctgatgacatggtggccacccagatgattaagggtgggtctgcctttcccagcccacggactcaaatgttaatgtcctttggcaacaccctcacagacacacccaggatcaatactttgcatccttcaatccaatcaagtttactctaagtattaatcatcgcagaacccattccaagggcagaagtttacagaggaaatagttaggacctcagccagctccagagtgtgcatggatcagataacaggggtgaatttcctcacagcaggcggaaaaacaaaaaaaaattccctattctgagcctccaccctccctgtgcaaaaaaaaacaaaaacaaaaggg

SEQ ID NO: 589295 - DNA, 397 bp, Homo sapiens
acttgatgacatgtgtgatatactagtacaagtctcccctaaacacttattattacaagggcaagagaccttatagagagagttaccggaccctctagtgataaagtaacactcatacggtataaatgaatcttgtgcattgatgcatgcactggagaaccagcatacttctgtgatatcctcgccaagtatatatcttattaatcagaagaacatccgcaaccccagttagggacattcacaagaagacatacgtcttcagtgtcagtctgaaatcaaggaagactaagaaaaatccgatgaaggaaactaaagagaaccaactaatgcgtatgtgattctggctacaatttttactataaatacattatcgggacaatggcacactgaatgagat

SEQ ID NO: 589296 - DNA, 133 bp, Homo sapiens
gtctccagataggggacagctggcagtctgtcacttgtcctaactgagacagcacagccaccctagctagcaacattagtaacaagtctgaacaatatatacttatagaatccagtcaaagatacacaatctg

SEQ ID NO: 589297 - DNA, 882 bp, Homo sapiens
tgaaggggttaccttacagagccactgagaatgatatttataatttcgttctcacctcttaatcccatgagagtacatattgaaattggacccgatggcagagttaccggtgaggcagatgtcgaatttgctactcatgaagatgctgtgtctgctatggcaagaagacaaagctaatattgctaacacagcatatgtggagctcttcgttgaaattctactgtcagtgaacaaagtgtggggtgcttacagtatcacagctatgatagtaacttttttatgaattctacagcagggccaagtgtgtggcgcttatggtagccagaatgatggggagggatggggcgtatacaacccagtctagttatcggaaggtcctgctaggccagcagctggagtggtggtataatggaccgtggttatcggtggtcacgagcagtatgagtggatatgaccaagtactgcaggagaactccagtgactatcagtcaaatccttgcttaggtagagaaggagcactaaaatagctactccagatatataaaggctgtacatttgtgggagtggaactagaaatgtgaggggatgtacaagtatatccagtatgatgaggtgaaatgggaaatataattgattctgatcactcttggacaagcttcatctttcttttatcttgccttactcgtattcttaaggaagacgagctcaatgtgtagcaagatgtgcccttacagggttggttgattgctgcttactgtcacgttgggattcaagattcgtttccaaaacttccagctccgtaactttgaacactgaaacattcatctaggaccttataacaggttccggattgccattaatgttaaacacactttagttctc

SEQ ID NO: 589298 - DNA, 186 bp, Homo sapiens
tttttgggggggggcccccccgggaattggggagccccccccccccccccaggggggcccctttggcccccaagggggtttttttttttcccccccggtttggggttttcggggggccccacttttgccggggaaaaaaaactttttttgggggccccccttaagttttttttttttcccccccca

SEQ ID NO: 589299 - DNA, 281 bp, Homo sapiens
atctacatccgtgagtatagtaaaaaacaaaaaaacaacaaaaatagtaaaataaaaaacaaataaatgtaaaatagaaccctgggaaaaaagaataacagcaaagtacaaaaatataaagcatatcctttctttaatttagtaaatatctttactagtagaaatagctcaaaatagtcagttctaagattaagtaacaaaattgataactagagcaaggaaacgtaatttgggattataaaattcttagcttaataaaaattccttaacaatgaaagacg

SEQ ID NO: 589300 - DNA, 770 bp, Homo sapiens
cgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgccctggccgtgtgccctgcctgcctgctgctgctcggtgctgctgctgctccctgctgtccctgtgcctggcctgctggacttgtgccgactacacctatgacctggctggagtgaggactgactcgtgagcccctcaactacaaagacccctgcaaggctggctgcctttcttggggacattgccctggacgaagaggacctgatgggccttccaggtacagcaggctgtggatctcagacggcacacatgctcgtaagtcctccatcaaatgctgcagttccaggaaacacttctacccccagctgccagagcaccaacgggcagcctcagaggggagcctgtgggaggatggcgaggtagatcccgtagccggcgggcggcgacgtccgaccagagcgtgtgtggcccgatgggtgtcatcccccttttgtcatttgggcggaaacttcactgtgtagccagaggtgcagtcttccgcgcagggccatgaggcactggggagaaggcaccaccttgttgtcaccttccctggagcggcactgacgaggacagctatattgtgttccctatcgacttgcggtcgggaccgccccttgactggccggcctcagttgctgcctacgtggtcg

SEQ ID NO: 589301 - DNA, 134 bp, Homo sapiens
tatgacatgaaccggtgatctcattagctgtccccacattaggcttagaaacagatgcacttcccggacgtctaaaccaatagccactttcaactctatctcttccctcatgacagatcccggcgttctgtcat

SEQ ID NO: 589302 - DNA, 278 bp, Homo sapiens
  misc_feature (10)..(10): n is a, c, g, or t
  misc_feature (172)..(172): n is a, c, g, or t
  misc_feature (198)..(200): n is a, c, g, or t
  misc_feature (204)..(204): n is a, c, g, or t
  misc_feature (225)..(225): n is a, c, g, or t
  misc_feature (228)..(228): n is a, c, g, or t
  misc_feature (235)..(235): n is a, c, g, or t
  misc_feature (238)..(238): n is a, c, g, or t
  misc_feature (250)..(250): n is a, c, g, or t
  misc_feature (257)..(257): n is a, c, g, or t
  misc_feature (272)..(275): n is a, c, g, or t
aatccttatnatactttcttatttttcaagatgtaaatacatactagaataaactctgtagaatatacaaaaaatacatattttcccatgaaaaatttctttataataaatagaagggaacacgtgtgtggctgatccggataatgctccgagtctgcttaggttttcaaantgttgaattaatttaaatctcttgannnaccnggggacttccttctcccctanaangtcgaantanataatacatgangcaatcngccctcctgagtggnnnnttt

SEQ ID NO: 589303 - DNA, 342 bp, Homo sapiens
gcctgtccgacgaacaggcgactctcgactcttcttggcttcactagctggggctgcagcagcagcaggagcagctgtggtgtgaagaagcacaggggcagcagccacaaaaggcagatggatcagccaagaaggccttgaccttttcagcaagtgggaaggtgtaatccgtctccacagacaaggccaggactcgtttgtacccgttgatgatagaatggggtactgatgcaacagttgggtagccaatctgcagacagacactggcaacattgcggacaccctccaggaagcgagaatgcagagtttcctctgtgatatcaagcacttcagggttgtaga

SEQ ID NO: 589304 - DNA, 886 bp, Homo sapiens
  misc_feature (176)..(176): n is a, c, g, or t
cgaggatgctgcgtcctatacagtcggcaccttcgggtcccaggctgtgctcgtggccgagaacaggggtgtcttcgaggtgcgaggacgcaggatctcgtccgggatgtccagggcgtgagatggcaagcagccgttggaggcgctcacagagagaaccctggtgcgaggagggncccggtctgggtggggactctgagcgctggaggcatctattcagcatatgcttggacatgcatggatgatgactctcgttctgatgttgtggctggaagggtaggatagcacactaatgaagcactgcatgcaatgcgctatgaaaactgcctgcgataaatctatatgctgcatagatagcagtgtaggctaccatttgacatactctccactgtgctggacctttttggcgtggactgtgcctatggatagacatgcacgttgatgccattgcgtgcattcgcgcccggattagaacctgttcgagctcaaaagggatctgcaagattagcatttgaaagcctcgagacgccttgggtgacgcaagggtaacatggaagcgacgagtgcctagatggtcgccgattatatccgactgaaggccctcgtatgcgcgcccgtgtggcgttcccggggaaagcgcgtatggcgtagcaatagggagggattcccaccttgcacgcgtcgcgtcttgctttccgggcggttgggggcggtcctccttggaagcgggctgcgctcgaactagtttggcgggctcccacgccttttaggtgagaggccgcggggtggggaaccacccggaagccgcaggtccccttgggggcgtagggccattggggaccgtattcccacgggagcatgggcgtccccgcatttcaatggaccg

SEQ ID NO: 589305 - DNA, 115 bp, Homo sapiens
tttgtggggaagctgtttacagcgttctcccgctgtgtgttattggggtcagggttggttgaaaaacggcttggcccaaggcttgggaacttcaagccccaggagagggtggagg

SEQ ID NO: 589306 - DNA, 192 bp, Homo sapiens
acaccacctgagtccttgtatagcttcctttgaggaacgtctgttcagatcatttgcccatttttaaattttttttctgttgaggtattttagttcattatatattctggatatataaatgagtagtttgcaaattatttccctctcattccacgaggtagtcttttcacatctgttaatatgtttcgctgt

SEQ ID NO: 589307 - DNA, 381 bp, Homo sapiens
  misc_feature (221)..(221): n is a, c, g, or t
  misc_feature (350)..(350): n is a, c, g, or t
  misc_feature (352)..(352): n is a, c, g, or t
tttttttcaggttcctgtatcttcatgtcgagttgctcattgcccaacgtagaggactaggaatcaggattcggtggctatatgctggaggctggacgcgggagcgcggctcgcctcattgcagttgttggcagtgatggagagatagcatcgcggctggagagtctttccatcgtgttccactgtcgcagctacacaccagatatgaagactacaagcancctcaaaaggtcttttcatttgttcagcatttgaaacttcttcctgacaccagaggggctcttcttagctgtctttttcctgggttattcctggtaaactagctgatatttgtttcaaagcatatgtcncnaataaagtgccagtctctcttaaaaaaaa

SEQ ID NO: 589308 - DNA, 127 bp, Homo sapiens
cggcatcttagcggctgctgttggtgggccgtccgctcctaaggcaggagatggtgccgcaaagaagacgaaaaggcgctgagtgacactttggctcacctgtattaaagtggagacgtctgggaca

SEQ ID NO: 589309 - DNA, 277 bp, Homo sapiens
gctccacttggttgccaggctagagtgcactgggtgtgatcccggtcacacaaactttcaagccatttcccaggttcaagccattctcccgcccagctcatgagcaggtgggactacaggcatgcaccacaatacctgatttttctttttctttttttttcctgtagtagagatggggttcaccatgtgggctaggctggtctcgaactcctgacctcaagtgatctgcctgcttcagcctcccaacgtgttggacatacaggtgtgagccaccgcg

SEQ ID NO: 589310 - DNA, 342 bp, Homo sapiens
gcccaagaagtctcgtgtccacgtggcttgggctcctgacttcaggtccagccaccacagccgcggtcctgccatgatatgaacccgagaagacccaggccagataaagccggcatccacagagtccagaatattcccatgaggggtcccgacttccttctccagccgcttcgaatacccgcttaatagggtatagctcttcacaggaaaagccagcatccactgttgaaggaccctggggcctctgatgaccaatgggccagttatgacagccatcgcgtctggtgtacacaccacagtagtgggtccctctaaaggcataggtggccccatgggtgtcag

SEQ ID NO: 589311 - DNA, 599 bp, Homo sapiens
aagctcttgaaaaggggaggtaggaggtagggaagcagtgcatgacccctggacacagcaggtcaggtgtccttcagtgagcatgtggtgctgggcacaggtttgtgagcaggcctctgagcagggaagggagggggctggaatcacacacaggggtggaggccatcactgtacctcatccttcgcgagctcagaggcagctcagaagggcatcttgagcatgaggctgttcaagaaatgcaggccttcttcctgggggcccttctgctcctctggctcctgggcaaacatgaagatcacagttttgtgctgcaggcttgatgttgcagctctgccagggtccagcacgcactcacggccctcagcacacaatgcaccccgggcacagaaagcccgttgtcgctgaggtccagcttcctggcgatgtgcagctgggatgcagactctgccatcagccgacagccttcatcttccagctggttccctgagaggtccacttcctccaggtgagggccttcccggagcagggctatgagggcctccgcatcgtggactggagctgacacttctgcagctgagcgtcagcttctgtctgagcc

SEQ ID NO: 589312 - DNA, 87 bp, Homo sapiens
ccccctctccccaaagaaaaagtgtcatgcccccttcccacccaccctcactccccaccaaaataaacgtttccttaaaattataaa

SEQ ID NO: 589313 - DNA, 336 bp, Homo sapiens
catgaagcgatgaatgaagcgaacagatttcggtcattttggttctcaggggtttgttataattttttatttttatgggctttgggtgagggaggtaggtggtagtttggtggttaataatttttaagttggcgtgatgaggaataagttgtaaaggagtatgggcggtaattaatggtggaaaatagaattgatccagtactgcgggcgggtaggccctaggatttgtgggggccatgaattgaagcgaacagattttcgttcatttttggttctccagggttttggcataattttttatttttattgggctttggtgagggaggtagggggtag

SEQ ID NO: 589314 - DNA, 80 bp, Homo sapiens
  misc_feature (42)..(42): n is a, c, g, or t
  misc_feature (47)..(47): n is a, c, g, or t
ctggcaagagctactttagttactatcaccaataacattggntctgnggcacgaatgtgtgctgttaatgagaaaataaa

SEQ ID NO: 589315 - DNA, 108 bp, Homo sapiens
tccgcgaggcagtctcgaagaagctctggggaaaacaaaaaacatatcacggaaaacaacactggagtgaggagaccgcagagagtgactgggtaggaatcctagaca

SEQ ID NO: 589316 - DNA, 342 bp, Homo sapiens
tccccttaaatccccacgatcactcagctactgtctctccggaatgtatgaccacagatacagtgcgacagtgagttcacagtgcagagtcaccacaggccactgtgtctcacttgagagtgcctgccgtacaaacgtgaccgatgaacgacatttaccacttcttctactcctctcaacccgtttgagagtccatattgagcattggcccagcatggatagagtgacgtggtgactgcagatgttagagtttcgctaactctatgaaagcaccagctgtgtgcagtctaatgtccctactggacagggtcctatattgcagctacagtatatcatcgtaga

SEQ ID NO: 589317 - DNA, 428 bp, Homo sapiens
agcctggtcgattctatgaggatcttgattgggaaaccttcgcgttcttgtcacacatgtatctatatatatatatgatgtatatatatgtgtgtatgtgtatatatatatatgtgtgtgtgtatatgtatatttttgagagagagtttcgctcttgttgcccaagctggagtgcaatggtatgatctcggctcagtgtaacctctgcctcctgggttcaagcgattctcatgtctcagcctcccaagtagctgagactaaacacgtgtgccaccgcagctgggtaaattttgtgtattctaaagtagagatagggatttccactcgtgttggacaggatggtctccatctcctgacctcctgatccaacggcctcgtcctcccaaagtgctgggattacaggtgtgagccactgcgttcggactaca

SEQ ID NO: 589318 - DNA, 930 bp, Homo sapiens
cacttttctggttaacaggtcaaaatctctctgttctctatctatataacatatcaataatttatccacgtgcgtcgtggtgcctgcctgtaagtcccagctattcaggaggctgaggcaggagaatcacctagaaccaaaggaggcggtatgcagtgatgccaagatcatgccactgcacttccagactgggcgacagtgagattccatctcaaaacaaaagcaaaacaaaacaaaaaacctgggaaagacttctcatattcacgagctgttcaggaactactctgaatatcatgctccaaccattactaatctgttcacttcaactcaacatacaggagtactgaatctgtttcgtatcatggatccttccggcaatctgatgaaaccatgtgcctctttccatcatcatctccctaaacacgtaacaacttcacacttcagagaaatacaaagaaaactagcatatcaaatagtctctctgctacactcgctggagcctctgacagccccaggttaacacacccttactatacaacgctcatgatctcgtctattcaggcccccacacataatccatcccatatattccatctccaaatagcgatagccatactttccctcaaatagtaccagactgctgattatcctactcaccttcacccttcggtctttccactctacgctatacactgggttcttgacgcaacactataagctctaactcacgcatcctggtaatccaatgcaccaccccgaaaccagcccttactagactacgatccgaccgcccagccacgtgagacccggactccccgaccaacgccaccacgcacacaacaccaccggccacacgcagaacaaacacacgcccgcccaccaccccacacacacggacaccaccagcactatcacccatcctacagaaca

SEQ ID NO: 589319 - DNA, 225 bp, Homo sapiens
tgcgagtatgcctccgggttcagcgattctcctgcctcggcacccaaatagcagagattacaggtgcaccactatgcccagccagttttttcttttttgaattttagtagggacaggggtttcaccactgttggccaggctggtctggaactcctgacctcaaatgattcacctgcctcagcctcacaaagtgctaggattacatgcatgaatcacgagctggct

SEQ ID NO: 589320 - DNA, 267 bp, Homo sapiens
tggcccgaggtggattttttttaaggaaagggtgaggaaaaaagaaaggaattttaaagtttaaacgtccccaagggggtgcttttacagggaaggttattttgttttaaacattgaaaagttgtggttaaaacagttaatttgtatgtaacaggggatgctttcaaaaacaattactgacctatgctttaaaacaagaatggtttgttacaaacccaaactgtccctttttgtgaaggggtttgaaaaaaggattccccgttttta

SEQ ID NO: 589321 - DNA, 161 bp, Homo sapiens
atcagctgtggcatggtgcagtcatctgaaggctgaactagatatagagatccactttccaacctactcacattgttgttagcaggcctcctatttctcccaaggtgagaaccctttcatcatgcgtaatattttttgtgttttctcaaaaatcatggtca

SEQ ID NO: 589322 - DNA, 120 bp, Homo sapiens
agggagccggcgccggctgcgcagaggagccgttctcgccgccgccacctcggctgggagcccacgaggctgccgcctcccgccctcggaacaatgggactcggcgcgcgaggtgcttgg

SEQ ID NO: 589323 - DNA, 145 bp, Homo sapiens
acatcatgcacgcaaaaatgcatgctcaaaacgcttagcccagcacacacccccacgggaaacagcagtgataaacctttagcaataaacgaaagtttaactaacactatactaaccccagggattggtcaaatttcgtgccacg

SEQ ID NO: 589324 - DNA, 500 bp, Homo sapiens
  misc_feature (310)..(310): n is a, c, g, or t
  misc_feature (313)..(313): n is a, c, g, or t
  misc_feature (315)..(315): n is a, c, g, or t
  misc_feature (323)..(323): n is a, c, g, or t
  misc_feature (364)..(364): n is a, c, g, or t
  misc_feature (449)..(449): n is a, c, g, or t
  misc_feature (454)..(454): n is a, c, g, or t
aaaataggaaacgatgaagtggccctcctaaacctcgcccttggaactttagcccctaactcaggaggatgtatctatgtgctgtctgccctgttgctgtagtcagcacccttttatactcaacggaaaaatcagtgcaaggactatttgagttggagggctcgtctttctgtagcctattgtggatcatgatggtctgctttaaaataacggggatgtcggccaggcgcaagtgcacgcctgtagtcccagcaatttgggaggccgaggcggacggatcacgaggtcaggagatcgagaccatccctgntancngggggaanccccgtctctactaaaaatacaaaaaaattagccaggcatnggtgggcgcctgtggtcccagctactcgggaggctgaggcaggagaatgcgtgagcccggaaggcggaggttgcagtgagcgggngtacncactgcgctccaccctgggcaatagaagcacagtccgtctcaaaaa

SEQ ID NO: 589325 - DNA, 184 bp, Homo sapiens
  misc_feature (2)..(2): n is a, c, g, or t
  misc_feature (134)..(134): n is a, c, g, or t
cntttgtagacctgaagctggtgtgcagtggtgcaatcacagctcactgcagactcaaccccccggtccaagtgatcctcccacctcagccggttaattttttacttttttggtagcagcatgggggtctcacngtgtattgctcacggctgtatctcagcactccgtgggataacggcagtcc

SEQ ID NO: 589326 - DNA, 190 bp, Homo sapiens
  misc_feature (79)..(79): n is a, c, g, or t
  misc_feature (85)..(87): n is a, c, g, or t
  misc_feature (89)..(90): n is a, c, g, or t
  misc_feature (109)..(109): n is a, c, g, or t
  misc_feature (111)..(111): n is a, c, g, or t
cgcgggcggctcaccagagccggggcctcgaaatatggctgcggcgggaggcgccgtcgcggcgcccggcccgggcggncccgcnnncnnccccgccgcgccctgagcncnccctcccccgcttcccccgggtccccttctccaggcaggaagatgtccaagccccgcgcggtggaggcggcggcggcgg

SEQ ID NO: 589327 - DNA, 613 bp, Homo sapiens
  misc_feature (55)..(55): n is a, c, g, or t
  misc_feature (97)..(97): n is a, c, g, or t
  misc_feature (171)..(171): n is a, c, g, or t
  misc_feature (185)..(185): n is a, c, g, or t
  misc_feature (215)..(216): n is a, c, g, or t
  misc_feature (231)..(231): n is a, c, g, or t
  misc_feature (340)..(340): n is a, c, g, or t
  misc_feature (346)..(346): n is a, c, g, or t
  misc_feature (356)..(356): n is a, c, g, or t
  misc_feature (362)..(362): n is a, c, g, or t
  misc_feature (439)..(440): n is a, c, g, or t
  misc_feature (447)..(447): n is a, c, g, or t
  misc_feature (471)..(471): n is a, c, g, or t
  misc_feature (475)..(475): n is a, c, g, or t
  misc_feature (495)..(495): n is a, c, g, or t
  misc_feature (510)..(511): n is a, c, g, or t
  misc_feature (519)..(519): n is a, c, g, or t
  misc_feature (534)..(534): n is a, c, g, or t
  misc_feature (554)..(554): n is a, c, g, or t
  misc_feature (579)..(579): n is a, c, g, or t
  misc_feature (581)..(581): n is a, c, g, or t
  misc_feature (590)..(591): n is a, c, g, or t
tatgtctcgaatcgtaattgatgcagttaaatcatcaccaactccaggaggcttntctcagtcctcttctcctccttctgcagttaggggcagacanctaccctctcccactcccttagcagttctgtacttacatctccaggtacttaacatctccagatggcagtgaancattggtcattttncttttctagcttatgtctttcatctccgtnntctcagggctgggcncatggtaataacattcattgcttcgttcacttattcaagaggagctcggttaacaagttagatccatctcctattcttacagaccttataatctttttaaaaaataatnttattncatttatttntggagncagtctcactctgtcacccaaggtggagtccagtggtgcaatctcagctcactgcaacttccgcctccggggttcanntgattcncctgcctcagcctcccgagtagcngggnttataggctcatgccaccanacccagctaattttnngtatcttnagtagagatggggtncaccatgttggccaggctgntctcaaacttctgatctcataatcngnctgcctcgnnctctcaaagtgctgggactaca

SEQ ID NO: 589328 - DNA, 310 bp, Homo sapiens
  misc_feature (112)..(112): n is a, c, g, or t
gggcgagtgatggtcatatggtgatagggtcagggatagttgtctctgttactatgacaccctcattccatcaagaagataagcaactgctataaaaagtatgaatataagnattttatatttggccaggatttaggataagacctctctgatgtcaagtatgtactgaaagcaatttgtgtagggaagcagcaaataagatggcgcagagacagtagaacatcctcagggcgccagtgcttccaggcactcctaactggctctgtgactcgaatgtccacatgcacacaaacccacaaacaaaacaaaa

SEQ ID NO: 589329 - DNA, 804 bp, Homo sapiens
cgaagattatcaattgtctatattcatattaattagagtatataaaaagactcggccgctacggggtttatttttttggcctctatatgacgagactgaggaaacctcattctgactccctaagggacctttgggggaaaggcgtcccaaggcccctaattgggccttattgtaaatatcattcattgggtatagcgcaaggagacatcatcccacatgttggcgaaaaagctgtgttctaatgcagattctgttcctctctgcgggtcttcacaccctttatcacttcttgtgctgctgtatcctgacctgacaggccacgacccctatccctgtactaggtaaaacatgcggaaagtcacttggttccacgagttgttattgtataactctataacaccaagtggataaaccttaagaattcacgccctttgcatccagtttcatgaaaaaataaccttgtagctccctttattctcctaggccgataatgccctttatcaagcgacagtagaagattaaggtccctttatcgtactacgctatactagatattactaagtttaatctactccgttactctttatacctcatctttagtaccggctgtcacacaatccacatctttccgtcccctttgaattccgtccaaaaaatcatgaagtactaatttattggcacgagtcactatactcactccctcgtaatactgttattcaccgcctcctggcctccccgatatttctatattattctatatccaacccccccggatgatcctcccttaaattcacgatgtgactc

SEQ ID NO: 589330 - DNA, 850 bp, Homo sapiens
  misc_feature (84)..(84): n is a, c, g, or t
ggggccacgcctccgggattcttggggagggcccccgaattgcgacacaaagactatggcgggcgcccccgcgatgggaagtanaaccaggagcggcgtgcgcgaacacatcgcgccccaaacaggagaaataaaggggaggacatcatgggctttcccgcgcccccgccgcctaggctgcgcgcacgatggaatctcccgcgcaatgccctcgggcagagacatcgggccacacatactccgggcggttggtcaaaagcttcacgaacgccgacccccccccccgagagacacgtcagacaagacttccacgttcgcccgccccccccgtgagaggccccacgcagcagggaaacagaagcaggggaacgcggggcagattattctcggccgccctcccccgctggtagaggcacacacccacacagcacagatccgacgaggactcgccgcgggagacagagccaccagtttccccccacgccgcccgcacggtgttcaccaaccagacttcgttgcacaacgcaccgtccgcacacatatagcaacccgcgggtggagaggaaaaagataatgtctccaggagtagcccctctttaagagggagacctctgtggggagagactgctacaagtttagtgttcttctctgtacatgtatagaacaccacatcacagttcaccacgcagaagttaaagtaggacgcccccaacgcacgctaggttttaacaggtcactatatatgtttgtgcgcatatcattaaaagacattaacatattgttgttaataatgcaaacaaatacaagactgaaaaaaacatatttgtttgtggggggccccaacaaaaca

SEQ ID NO: 589331 - DNA, 295 bp, Homo sapiens
  misc_feature (1)..(1): n is a, c, g, or t
ncccggcggcgagggattcccaatgacgctggtcgagtcattcagagtcggtacgccgagcgttgtcaccaattcgcttggtattgccgacgactgcattcagtatggtgccgcagaagtaaccgacgggtcagcctcatcaatggcggacgctgtaattcggatcttgaccgacaaacaacatgcgcaagcgctcgtgaggaacgcattatcatatctgtcgaagatgaagaccttgtggccctgggatgcgaagtgccgcgccatagctagcccgatgccgctagcaccgcca

SEQ ID NO: 589332 - DNA, 1130 bp, Homo sapiens
cttccgttgtgtcgctcgtgttttcccccggtgggttgctctgagcctctcttgggggggagatgttgatcccctttggtgcgctggcgacagagtggtttggtgcgagaaccacgggggggttatacgaggtcgtgctctgtctctttagcgtgccgctggtgtctccgcacaggggggggtctacaacccgcagggatcgcgcgcccctcctatggggggctcgggcgcaccagaggcgttgtgtgacacgtgggaccttttgggggagagagatggaagtgttgggatgtggggtagattaatcgcccgtgtcccacagggggcaccacgtgggggcgcccccgagtgggggctccccccccccccccttgtgagaggaggtcaacaccgggggtctccacctgggatattctgtagtattttttatcagtatggggaggggagtccctgcaggtggccccccccggtgtttagtcgcacgggttttatgaacctcataggcgtctctgggagaccctcggtgtgccaccctcgagagagggcgccccctctgggggcctctccccccacacgtttgttttggccgcacagagaacctcggggggtctgtgcacacacacagtgtcctgggccgccttcgcccacaggcgcactatatctctctgcgcgttaagcgccctcttgtggcgccccccctctccttgtggagagtactccccctcctctcccctctctgagctctccctgtcggtgcgcaccactagcttgttgtgcgccggagctttgttctcaccacagggggccctttgtggagaggagagcggacctgtcccctgccccacaatgtggctttcccccccacggggcacacctgggcccccgaggttttttttgtgtaattttttcttgggcgctgcccaccctcccgccccacagggtgtctgtggccgcgagggccccccgcggcacggcccccccacgtgtcatcccgggtttggttcttggggcggccccggtggcccccctcgtgatcccccccctctgcccctcttggccgcgtgcacctgaggggtctcacttcttggggccggtcgtttttttccccaaaaaaattttttggaaattta

SEQ ID NO: 589333 - DNA, 1621 bp, Homo sapiens
  misc_feature (1)..(1): n is a, c, g, or t
  misc_feature (1279)..(1279): n is a, c, g, or t
nctatgaaataggagtgtgcttcgttctgtgcggttgtggttctcgtttatcgtgtgtgctcctatcaggtgcgtggtgttcttttggcccgcgggggggtgccagtatttttcttatcacgtggtccccaggaggggttgtttgcgggtagcatgtgtgtttaacacttgttttgtgggccagcgtagtccaggggactaatacacccggggttactccctggggtctcgtagtaaaccgtgtgttgcgccttgtttgcttgctgtccgtgtgccacaaaccgaaccgctgggggtccccgtctgtgcacttataccggccccgtcgtttaccgccggttgtggtggggccgaattgatgtcctcggtggcgaccattgtgggtgcctcaccctttggaggggatgagaaaacctgttgtgctccggtggtcctcccacctctttgtttggttggcgcccgcgttcctctcccgggttgctatccaaggggttttacccccccgggagggaaacccctccgtgtgcgcccctcttacactttttggtgactgcgaaaaggcatggggaggtaaataattgggtgtgacatggtccaccttcggtgcccctccaagtggaagggacgatttggtagtcacgaattgtctgttacaccccgacccgctcggttgtgctgcacagtgacaccatgggcccccccgggagcccccccgcctcttgtggtgatagcgtctggaccccccacgagggtgaggacccctctcgctcggtccgcgagtcgaggggtattctctaatgcgggccccccgtgtgcctctccccactcgaggtgtcctgcgcgcctcctcctctcgcggggtctttctttgccggacgtatgttttttcttgtcgggttcgcacgaatcttcgcactcaaaagggggccacgcgcttgggggccctccccacgcgcgcgcgaaacgttctatacacacccagtgtctcgcagtgtgtccttcatggagacagttatcccttcgcgcgggcacgcaccgcccgtccactcgcacagcatgtggaacacatgggtcgagagtactcttgtgagaagatgatttcccacgcccgttctcgggagcgcgatctcgaggggacacccacagagcgcgtgatggtctcacactcgtgcgcggcgctctctctttgggggaccccggtctcttataccccagctgaccacactctctctgggagtgtcccctgtgtagtttggcgagagtgtctcacgggatatcncggcgtctcttcccccccagagcaccacgatttggctcccctgtgggacctatccgaccttaccaccaccctggtgtgtacacctggaccttcctggggcaccccgagagagaggagtcgccacgagcgcctccgctctccgaggcacgtagagtcttgttctatagggcacagcgggggacactctcccccgcaatcggcgggcaaaccccctctccagtgtaccgacaagactccggtcttcaggggattttctctgtcctacttagcgcatgagttggcgctttattccacaccggttaaggagattggggcccattaatggtgcctgaacccagttga

SEQ ID NO: 589334 - DNA, 283 bp, Homo sapiens
agctgtcctcacggttcgtgcccatcaagccaactcccataacggagcgaggctggcagcagttcacttcgatacacgcattgtcctggcgtaaattagtaactctaatggccttcttctcttgcccgggggctcttatgcttcaaacacgaagggtcagtgccttttgatcggaagcggtcccatgtactacacacggtctcaatccctcccacttctgtcaagtctatagaagcgtgctcatgtgcatgtttcacactttttcacaggaccacatgatgct

SEQ ID NO: 589335 - DNA, 262 bp, Homo sapiens
gtaaaacccagcccatgacccctaacagggcccctctcagcccttcctaatgacctccggcctagcattgtgattttcacttctcacttccattaacgttcctcatacttaggcctacttaccaacacacttacccatataccattgatgcgcgatgtacaggagaagcacatacaaggccacacaaccacctgtccaaaaggcctcgatcgggatatctattatactcagaatttttctcgagatttctagctttacatca

SEQ ID NO: 589336 - DNA, 462 bp, Homo sapiens
ggtccacccaagggggtctatagtaacacagaaaactacagctatatataacataaaatacagctttaactattagtgatgcttaaacaaagcaaactatgatgcaatatgaatcaacttcattaattggacaagtccagctgaggcacaaattacgataagcactaaaacccccgcatgatgtgcaacgtgaaacctcacaaccccgagcaaggttctttctagtcctatgggctcatgtccaagttccataaccagaaaaagccactagtttttacattgttcttagacttttttactagaggagacgcacaatatatttcacccaagtctgtatgggatttgcgcacacagacaactttttctttgtgtgaaagatgatagcattgatgtcacagccttcattggccagctgccgtgtgaagcccataataaatttagggttgatggggtaccgagctc

SEQ ID NO: 589337 - DNA, 317 bp, Homo sapiens
ccggcaccgcctgcacctgcccttccgcccgccctccggacggccgcagccctgcgggtctacgctccagacccaccccctgccgacccctgcgctgctctgccgcctcttcccagagcgcccaccttgccagagacgtgtccgccgaacaagcagcagatcgccgcacgtacgtcaagatcaacgcgtccaagataccaggtcagacgatacacacaaacagaacgatcaagggaccaatactttataggacactgaaacctagagaaatgcaaacacaaggacagaacacagagaaaactaataaacgaaaacaa

SEQ ID NO: 589338 - DNA, 1402 bp, Homo sapiens
  misc_feature (569)..(569): n is a, c, g, or t
ttctctttctcttctgtcgtctcgtggtcggggttgtggctggtggtcggccggggggggaggggcgggggcgggaggggggggggagggggacgacgatacaatacgtacttctcgtctatgcctggcacgtgattctagttcctcgctctgctgcggcgtgctggctggttgttgcttgcctgcgttggtgtctccgattaagattgtgctggctgatgattgccgtctctggtccggcgtcacggcctccatccatttttggtttgttgtttctcgtcgcgcctcgttgcagttttgttcctcgtcgtggtcgtgtgtgcacatcgcggtagttttctctagcagagttttgttcttctccttattggttactctaccgctggggtctactcggcgagttatctgtgctgccgctcttttttgcaagctagcctacgcgtttttgctgggcgcggcaactcttttgtggtggccgcccacaacgtgtgcgggcgtgcggcgggcagccttgttgtggggccagcacgaatggcaccggccgccggcgccgcctcgtgttcggggangcgtcgcgttggtgccttcgcgctcctctccgcactcttttgtgggtggtggtctctgtggtgtcgtcggtgtgcgcgcccctgctgggttggctgttggaaatcaccggtggggtttgtctggctcatatgctgtcttgctgggggtgggcttccccaccgttggttggtggttggttccaggggcgtgatgttctttttcttgcttttgtgcgcggccactaccccccgtgggcccccctcccctgttttctttggaggggcgcacccttaattggtggggccacattttccgcctcgcactagctggcccccccgcccacattggggtcgggggtgcgccttatgtgctgctggaaaaatattctgtgcgaggtccactctctatgagacccgcccgtccccggcgccccttggagaggtttctctggaacagaatacgacctatgtgtttctttttggggaagcttgttctgtctccccgccctttttgtggtagaaatgtgtgtccccacacctcgctcgcaccaggtttatgtgtgagctccttttcacgggtctgccgcacacagcttgcgcgcttctttttcgcaccactcctctcgcgaaaggcacgcctcgtggtaacacaccggcccccctcgtgtcttatgcggattgggtgaaaatttaggttctgctgatcccccggcgctctttgatctccatgactgtcccattttctccctctcttctttcgcgtgcacaggcccccctgtcttacaaacgattttcttctcccccaaagcaactccaccccatttgtgttctgtcctatcaatgatacacagaaa

SEQ ID NO: 589339 - DNA, 1616 bp, Homo sapiens
  misc_feature (765)..(765): n is a, c, g, or t
agcgggggtcctcgtcgtcttatgtgccatcccgttctgtcgcgcgatcgatttctgctgagggcggaacgccttggcatgcggccggctactgtgtttgaggatgcagctcagttcgcggcgtcgctgaatctagctgctcggaggctcttgatccttagtgagtcggcctagatgatacagaatctgaacagttgtctagacccccggatacggatgagtcaggcacgaatagcagcactgcgatgatccaatgaggccgtgctcctggaaagatgtgtcctggtattcgctccggtaggcaattctttcgtcactttcggtcgatttcgatgcgcacagtagtcttacggcactcgtattggtctccccgggtaagtcacaatgtgagctaatctgtagaggcatgttcaaatggattaacttgaactagtgaaattaattgaaccgaagatgtgcactttcgcggcaatcgcgaagggagcgaaaagggagcgtggtacagcaacagggatccgtttgcattgttgcccacgatggacttccccttttgtccctacaatttccaggagacgtaccccgtagagacctcgttgaacagtggggatgtccctcacaggtgccaagcccccaaaagcaaagaccgagttgttgccttcttccttgcgaattgcgatgaggcgttacgcgtcacgttcatggcggccacacttcaaggaacccttcttccttttcctttgcagaaccaccagttgaagtctgtgntagtcgtgtgagcacaaagggccttgcaaattactgctgtgcgagttaaggcgaacaccagttgaactgacgcggttctaattatcatagaaggcacgtgccccgttgttacccccacgttccagtcgattgcctggagggaaaaattcccatttaggggtgtttctctcgcggcatgcgaatatacagggaatcggttcccggacatgcggattttcatcgagttagaaaacacggcttagccgggtaagcgtgcgccggagagtgaagaggggtctccttccgataaattgcgcgagcgagcatctgtttgaccgcttgcacgctccgcagatggaggcaaatagaggtttcgttaaccgcattacggcaagggaaatttagtctcacgtagagagacaccgattggggtaccacggaaatgttcccttttgagagctagtgtcctccattacaacatgggcgttttggcggcaccaacaggcggggatactaagcgcgtgggagtgaccgtcatactacacaagaggggaagtctctcccgaggttgttgcaccacggactattgctctatgggaagaggtccgtcacatggttacgaagcgccaaaggagtggccactttataggggcacaccttgtttgcctatattgtggccacggatgagtaagaggggtattataagcgcacgcccgactttttggtgccgccctataagggagacattgtgctttgcgcatagagcgtttgtgagacaagacactacaccgcgcggtagaggcagtttcttccggcctgcagagtgtgtgtgcgtcgacagcaaatagtgcttcgtcatgtagtccatattc

SEQ ID NO: 589340 - DNA, 688 bp, Homo sapiens
  misc_feature (307)..(307): n is a, c, g, or t
  misc_feature (311)..(312): n is a, c, g, or t
  misc_feature (314)..(314): n is a, c, g, or t
  misc_feature (317)..(317): n is a, c, g, or t
  misc_feature (338)..(338): n is a, c, g, or t
  misc_feature (350)..(350): n is a, c, g, or t
  misc_feature (353)..(354): n is a, c, g, or t
  misc_feature (362)..(362): n is a, c, g, or t
  misc_feature (397)..(397): n is a, c, g, or t
  misc_feature (410)..(410): n is a, c, g, or t
  misc_feature (414)..(414): n is a, c, g, or t
  misc_feature (416)..(416): n is a, c, g, or t
  misc_feature (420)..(420): n is a, c, g, or t
  misc_feature (434)..(434): n is a, c, g, or t
  misc_feature (445)..(445): n is a, c, g, or t
  misc_feature (448)..(448): n is a, c, g, or t
  misc_feature (463)..(463): n is a, c, g, or t
  misc_feature (503)..(503): n is a, c, g, or t
  misc_feature (508)..(508): n is a, c, g, or t
  misc_feature (514)..(514): n is a, c, g, or t
  misc_feature (545)..(545): n is a, c, g, or t
  misc_feature (550)..(550): n is a, c, g, or t
  misc_feature (598)..(598): n is a, c, g, or t
  misc_feature (602)..(602): n is a, c, g, or t
  misc_feature (679)..(679): n is a, c, g, or t
gaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatattccgagctgggnagtnntnaanaaattgggttctatgacatanttgtcgcaaaanggnntgctgttncttaaagcattatttacagtaggaactgggtgagntaaaatcctgttncccntncagntttgcctgcttgangcctggaagcntgntgtgggtgaaggagntgacaggggtggcccagtgaacttttccagtaaatgaagncaagncactgnaataagaaacctcctgaactgggaacaaagnatctncaggcaagcaagaatgcccacaccaacaggccttatttttctgtgtangtantcaactgtatctcccccacccttgggattagagttcctgctctaccttacccacagataacacatgttgtttgctantgtaaatgt

SEQ ID NO: 589341 - DNA, 162 bp, Homo sapiens
ccggccgtttcgttgacctcttcaccaccatcaaggccgcacttcttcggggtcaacgggattggtctgaaggtcgttgccaacgccggcgccgggttctcctggcgtgacccggacccgggtggcctcaactcccagacctggtgggacctcgccgtccat

SEQ ID NO: 589342 - DNA, 142 bp, Homo sapiens
agcggctggtcgggtcccctccccgccggtcccccgcccccatccaccgggctctgccaggctcaggagcccgatgattcgctgcccgccagtaccgaaccctgcttcggctcctcgagggcccggggactctccgaggacc

SEQ ID NO: 589343 - DNA, 227 bp, Homo sapiens
tttttccccccccccccccccccagggggggggggggggggggggtgaataaacccccccccccccctttttgggggcccccccccctttttttttttgggtttcccccagattttttttttacgggccctctccccccaattttttttttggccccccccggggggttgaaaaaaaaaaccccccccccttttaaaaaacatttttaccccgggggggttttttta

SEQ ID NO: 589344 - DNA, 317 bp, Homo sapiens
acctactcattttagaaataaatgtaaaggaaagagtggacgagtatatagaacctccatcatgaaagatagagacatgagtcggaaactatcaggatattctatagaacaaccgggctgatagggtgaaaaaatcaatgttacaggaaaaagaaatatgtatggggtgtatgggcagtttctgtgctatagtcaggagacataacaactgaatgcataccaactcaactatgaatagattctgaacggtcccacagtctggggatttctgaaaatggaccattagaatgtcagagaattcgtgtttattttcttag

SEQ ID NO: 589345 - DNA, 160 bp, Homo sapiens
gcttgaggatcccgcacggtggttcataccgaaatcagcaacaactatttagctgttccccaaccttttcctccgaccccctaacaaccccccgatacagcgaccaggtatgaacaacagtgcaggtatgaacaacagtgcaggtatgaacaacagtgca

SEQ ID NO: 589346 - DNA, 187 bp, Homo sapiens
gttaatcttcagatttttgaataatttatttcaggtgtcatatatatatattgagtggctgaaaatatattttgtacctaaaattaataataattgaattataaaacctacctaattgtcacagtagtcaactacctaaaatgtttctaattattgggacactgtatatatgtattaatgttagtaa

SEQ ID NO: 589347 - DNA, 266 bp, Homo sapiens
aaatggtatttaccattcattaagtgaaagtggatcatcataaaggtcttcatcctcatcatcttcacattgagtaggctgaggaggaagagaaggggtaggtcttggcagtcttaggagtggcagaagcagaagaggtggaggaggtggaagggaagggaaggggaggccagggaggcaggagaggcaggcacacttggtgtccatgttacagaaatacattataatttttcttccttttttttttgggcttaattcctctaaaa

SEQ ID NO: 589348 - DNA, 334 bp, Homo sapiens
tgtgtgtccacctgtgtttgtcttggtgtgttcgtcctggtttgtgcgtctaggtgtgtgtgtccaggtgtgtgtgtctaggtgtatgtgtccatggtgtgtgtgtcccggtgtttgtgtctaggtgtgtctctttgtgtcgagctttttgggcttcttgcatgtgtaatttaacatttttcagcaaattagggagcttttcatctattatttcttggacattttttctgtttggaactttatttctgcttctatctctctcacatctcctctgatactctcattaaggatgtcccaagcttctattcatatttcttaattatttttccctctc

SEQ ID NO: 589349 - DNA, 776 bp, Homo sapiens
gcggctccaccccttccacgtcatccgcatcaacaagatgttgtcctgtgctggggctgatccaggctccaaataggcatgcgaggtgcctttgagaaagccctagggcaacatggtggactagggtttctacgattggccgaagtatgatcatgtccgatccgcaccaaatgcctgcaggaattaaggagcgatgtgaattggaggcacctgcgacaggaggcccaagtgtacgagatgtccatggactcgccgagaagcatcccaccatcttcaaggaggagagttggggactgtacacctaagttcccaagtgcttgatgaaatggtgaagaccatggatggttggagaggccgggtcatcccagactgggctgtgggtgtccagtacatggccagtgcgttggaccatctggaactagagatggtgaggtcccctgcagttctaatgagtggcttccaaatgtgtctggcgcgcgcatcttaatactcacgcaagtgaaaattcctacttactgtacgcaccttaccgaaaggtgattaaaagaccttgaaatccatgaagggcaggggagaatggcttcataaaaaagtctagtaaaccgcattttggtacgcggcggacgaaaatggaaggattacttgcatggtagggatgcaaaaattggggaagataacagtggacgtggtcaccggaagaaagagtcggggagacaagatttataaaccaccgggggttgcgggcacactggttccaaaagaagtcaggagcgaag

SEQ ID NO: 589350 - DNA, 419 bp, Homo sapiens
  misc_feature (7)..(7): n is a, c, g, or t
  misc_feature (14)..(14): n is a, c, g, or t
aatgggnaatttcngattaaaaagtcccccgtacttgtgcccaactttaattagcttggggagcaaaatcttatatggagtgttgtggaagggtggaaagatttctttgaaaagtttattcacattgtagaacagcaaatgacatttttacagtatttttttgtaaagcaaactattttgtgccttgaatttggtatatgtgtattagtgaaacattgtaaaagtgaatttctacctctgtatctatgtgtaccatcctcttgtaaattactatgaactactatgtgattgcttctgtttgttcgttctaggatgtcttttttaaatagtgaccaatgtttaaggctgttaaaataagccaacttttacaaatcgggatgttttctaaagaactgattaaatacgtacataactgaaaa

SEQ ID NO: 589351 - DNA, 469 bp, Homo sapiens
  misc_feature (23)..(23): n is a, c, g, or t
  misc_feature (29)..(29): n is a, c, g, or t
  misc_feature (195)..(195): n is a, c, g, or t
  misc_feature (235)..(235): n is a, c, g, or t
  misc_feature (294)..(294): n is a, c, g, or t
  misc_feature (309)..(309): n is a, c, g, or t
  misc_feature (322)..(322): n is a, c, g, or t
  misc_feature (338)..(338): n is a, c, g, or t
  misc_feature (355)..(355): n is a, c, g, or t
  misc_feature (360)..(360): n is a, c, g, or t
  misc_feature (446)..(446): n is a, c, g, or t
  misc_feature (464)..(464): n is a, c, g, or t
ggtgagcgttccagcttccgganccggangggcccggcgtacccagcccccagcccgacgtgaccatgctgtcccgcctcctaaaagaacaccaggccaagcagaatgaatgcaaggagctgcaggaaaagaggaggcgagaggctatcgctgcagcgacctgcctgacagaagctttggtggatcactcatgtnggtgttgcccagcctacatgaaccagagctggaccatgangtgaagaccctacagtccaagctgccccatttgccaagcagacagccattggatcggantgtggagaacttcancaggcattcaagnaattgggatttgagantggctcgagcatcgagnggacngcgcaccatgcatgcacggatatgttacaaggcatgcatctgcccttctagcctgttcctccccaacctatcctctacttaccgcngggaaggaggagctgacncttgt

SEQ ID NO: 589352 - DNA, 218 bp, Homo sapiens
gacgaccacatgaggacacagggagaagacgccgtctgccagccacagagagagaccccagaagaaaccagccccgccagcaccttgatcttagacttctggcctccagaactgtgggaatctaaattcctattgttgaagcttgtggtactttgctgtagaccgggcttaacggaccaacacacatcagataacacatggctggacaggactgtttc

SEQ ID NO: 589353 - DNA, 285 bp, Homo sapiens
tgatcgagccggtccagcggaccgaaacatgacgtaatacacagtgcttaaatatgaaacaaaattattttataaaaaagcaaaagactacagactatatacaaaagggacctggaatctgtaaggtgattccaagaaacgaaataagtagaaaatccatggtgaaacctgaacattctacctctgctctggagaagggctatcatacaacattcagtcagctgaagatggatgggtagaggtgtgtctatacataaactgcagtcattttggctggttccgctg

SEQ ID NO: 589354 - DNA, 768 bp, Homo sapiens
catgaggagaaggtatttcaaactggggaagagtcataatcctggggatgtttcacatgtggtcagctttaacccttctacagacacgggccctctcctcggtgaggagggacctcgggcatgtgtggggtggtggtgggtgggctcccctctctcccttatttagcagaaagtggtgtggggcattgagccaggttatatgacttgggatgtggtgctccgtgcacattaacaacctgtggtgagaattacaacgtgggaactaggacaatgtgcgggaaagcattattctctcagtgagggcggttaaccaaagaggcttgggctatcccaagggatctcgtggttggccgggcacgggtggctctcacaccgtgttaagtgccagcactttggggacggccaaggggggttagatcactggcaggctccaggagttcgagcccagcctgtggccacctgtgggtgaaacccgtgttcctctactaaacttacaacaattagctgggcagtggcgaggatgggtgccatgataatccccagctacgtggggaggctgagcacgggcagaaatgctggaacccgggaagcatagtttgcagtgagccgagaattgcccaacagcacctccagcctgggttaacagagcaaggactccacctcaaaataaaataatccctaaataccccagcgggctccggggggttaccaaccccagtaaaacccgcggggtgaaccgggtcccctaaatttggccttattgtgcga

SEQ ID NO: 589355 - DNA, 144 bp, Homo sapiens
cgaggcgggcgatctagaggatcgtttgcgggcctttcacgcataatgtagatcaattcaacttaagagctaacattaaataattatctgagtatcttaggtgtcttataaaataaatttgaagtagatgagtttatactcaag

SEQ ID NO: 589356 - DNA, 361 bp, Homo sapiens
aacatgacaaggatgctcagtgtggccaccgttattcaacatagtactggaagttcttgctagagcaatcagacaagagaaagaaataaaaggcctccacattggaaaggaagaagtcaaattatccttgtttgcagatgatatgatcttatatgtggaaaaacctaaagactccacaagaaaatgattagagctgataaattcagtacagttgcagtatacgaaatcaacatacaaaaatcagtagcatttctgtgtgccaacagtaaacaatatgaaaaaaattagaaaactaatcccatttatagtagccacacatggaaatttaagtacctggggaagttaaccaaagaaggttatt

SEQ ID NO: 589357 - DNA, 404 bp, Homo sapiens
  misc_feature (290)..(290): n is a, c, g, or t
  misc_feature (327)..(327): n is a, c, g, or t
  misc_feature (349)..(349): n is a, c, g, or t
  misc_feature (354)..(354): n is a, c, g, or t
  misc_feature (385)..(385): n is a, c, g, or t
tcaattatatccatttttccatctactctaagcctgcacccatgcaatatacacctggagaaaaatgctgagaggtctcagtgttgctggacactaatttcaagtgggcccttgttggcgtgtggtaatccttcatatttccttaataaattgattctcccacttttcaagacaatcattaacacattaacaactctctcctcaaacttccagtgctgcccctggaattttttttttttttttttttttgaggacaggggttcacttttggcccagactgaagtgcagtnggagcaatctaggactcacttgcagcctccacctccnggggtttcaagtaatttttcanggccntcagcctttggggagtaggctgaggtccccngggggcacgtgaccagggg

SEQ ID NO: 589358 - DNA, 127 bp, Homo sapiens
ccagagacggcggacaggacagcacgagcaccccaacgacctccctcctagcatgatcgacccgctgcatggaacaatgctagactaccctccatgctggacaaaaagcctttcatttcaacacagt

SEQ ID NO: 589359 - DNA, 116 bp, Homo sapiens
ccgggtgcccggtctcatgacatttccttgcagaggtttaaggatgggcagctgtcaacgcgggaccagtgctgctactgcctctgcccctcctgccaccctttcccctttaaata

SEQ ID NO: 589360 - DNA, 769 bp, Homo sapiens
gccaaaaccgttcaccatggaaagaaaaaagatggtcaaggaagcccagagggagaaaagaaaaaaacaaaattcctaaacatgagaaaaaaagaaaggagaagacagccaagaccaataaaggcaaatagaatgagaaccatattatggacagccattttcctcagtctcttttctcgcctgaactcttaagctgcatctggaagatggcttattgggtttaaccatatcgtcatcgtcggcccttgtttgtaaagaccggtttccaaatcgtcctcatgtaactgctgcacaaagctctcaagttctcgatgttacatcccgcccctcgactctgactggtgtatgacagaggatctatttaatctactatacttcaataacgaattttgtgcatgttcccccccgtaccctattgctcccccgtcccatatccctccccaaacctgtagatccgcaagtcctccccgctctatataataatattacttccctaattgatttattctcgcctctccgcctaatatttaaagttctcccgtctgtccgtccgcaccatctctgcacaacatcctattactccttcctatttcactcccccccttaccttatttttaccacctttccccccaccctcttttaatatcttacaccttatcatatggtgtcactcccatcttcatctatgccctatacgtccaaatacggtgctctatgctaccgatttatcctttatatcttgtcccctctcattcacccaactacctcg

SEQ ID NO: 589361 - DNA, 533 bp, Homo sapiens
  misc_feature (238)..(238): n is a, c, g, or t
cgcaccagcatcctgcacaagagccagcaaagagaggcgcgcgtggaattaaaatccggggtagcccccggcttctcattgagcacccaccaccaatcaatgctcagcagttggaacgtgggaccaagctaagaaggcaaacccattcctgcttgccgacttccggcaagtcagacaggttgaagaacagaagagacgaaaccctccaaaggaagaggggcatcatgtcttccaactnttcttccgcgagacaatggaacgtggtgcaaggtagacatgtattacaccgctgctccatgagagacatcagtcagactatccaatcccctagctcttgaccattattgaaatcgcttctcacagatgcgagacttcactatgaatgaacacgtgaagatatttagagtcgaggtggcagctcctttgctatgacgataagtgaagaatactatagcccacgtcattgaagcgcgcccacgcgcttgtccaagtgattggataaaactgtaaaactatacaccccaaagcccacc

SEQ ID NO: 589362 - DNA, 188 bp, Homo sapiens
aacaggaaccccacccttttcagccgggggaaattttttttgacccaaaactcaaaccgagtcaacccaaagttccaagttttttgcttttttttctgggggtgggttggtttgtcccaaaagtcagtttgcaagttgaaacttcatgaaattatttgtagcagaaataaagtacattgtccaaatca

SEQ ID NO: 589363 - DNA, 214 bp, Homo sapiens
gggtcgaatcagagctgtagctgccagcctacgtcagagtcacagcaacgcgggatccgagccgtgtctttaacctacaccacagctgacggcatcttaggatccttaacctcctgagcaaggccagggatggaacccacaacctcatggctcctagtcggattcgtttctgttgcgccatgacaggaactcctgaggcatgtatttttctggg

SEQ ID NO: 589364 - DNA, 367 bp, Homo sapiens
tgaggatccccgacctatgcctgccccttccatcttcggtgagcctggccgcccagtttcaccctctttgccgccatcgctcatcaacagggttcttgagctccaaattttcctccaccgcttatattccttctctttctgatgattcgcagcctctcggcagcctgatcccgctgttccaggcccttatccaacttgaccttcagagcctagttctccttccgaagctgctcacacagggtctgcagaatgcaggtgcgctgctcattcttgtgcaccttgtatgccaggcgcatgaactccagggccatgcggcccaggtgggtgaagagctggccgtggtccagctcctcggcacacacactca

SEQ ID NO: 589365 - DNA, 617 bp, Homo sapiens
gctatcaagctggcagggtcaccaaggtcctgggcaggaccggttctcagtggacatgtgcacgcaggtgcgctgtggaattcatggacgacacgagccgatccatcatccgcaatgtaaaaggccccgtgcgcgagggctgaagtgctcacccttttgtgagtcagagcgagaagtcccggaggttgcgctgagcttgggtgctcgctgggtcttggatgtcgggattcgatcgcacttggtcgatgggaatggtctgtcgagcaggtctgctccttttttgtatgtgccgtcaacaccgtaactgagatgctcctttaaatagagcgttgtgtttcaagttaataaaaaatgaaaaaattaaataaataagagaaaggaaagaaaaaaaaggagtcgaagggggcgttggtaatggggcgggtgcgggaagaagggcagtgctagttgggaagggtggaaaaagggcgcagaagtgggtctatcgtagaacgcacgtttgttttatgtgcgcagggggggataataccggggggggcgccatttagagtgggggtgtgtagacctattgggaaaacgcgagggttgaactatggggttagatgatgtgagcacaa

SEQ ID NO: 589366 - DNA, 137 bp, Homo sapiens
gtaaaactgctcaggccatcaagggtatgcatatacgaaaagccacgagatactgaaagatgtcactttacagaaacgtgtgtaccttacgagttacatggtggcgttggcggtgtacacggaccagcatgggactg

SEQ ID NO: 589367 - DNA, 112 bp, Homo sapiens
  misc_feature (1)..(1): n is a, c, g, or t
  misc_feature (26)..(26): n is a, c, g, or t
  misc_feature (34)..(34): n is a, c, g, or t
  misc_feature (39)..(39): n is a, c, g, or t
  misc_feature (91)..(91): n is a, c, g, or t
ngagaaaaaagtttacaatacactgnagtaggtnccaantgcgtgatggacgtgaggaaagactgccaacccactttctaaatccctaggnagggtatgtatgtttctgatc

SEQ ID NO: 589368 - DNA, 1761 bp, Homo sapiens
ggccaataagcgggtctgtcatccaggtcgctgatagtacactccatgttgcgcagggctttggacccttgtggaaccaagtcggctcttgaggctcgaagattgtgcgcgcatctgggatcatggaggacgccacccagaatggcgagactgcgtcgactgaccgatcatacagtcgcattatgtgtctgagtgcatcgggtgctgctgtgggcatggaggatgtcatccgggacgaggggtctcggatcgaaagggacgacgacaccttcgcgcaacagttcatagaacgtttcacactcgcggaagaccactagtcctcgcatatgcgtacagagaaacgcctcgaggcacattgccgtctgttgcttcgagggccgaatcactccggggtaccaggaggggataccccttcattggcgagcaggtagcccaacttggagttgcggtccgaagtagtatacgcacaatagttacgccgggctaagtagaatactccaacctcggagtttgacgcgcaccatggcgggatagcatacaggttcaccctacgcgtatggcgagatggtaatgcagcgcccccagggcactagacctggcgcttgaaagaccggggacggaaatccctgtggacaacggctgcgctccttttggtgggacatatggccgattccaccaatgggggtgctaatccaggcaattccccggttccatgagcattggaccacggtccgcgaacggatacaagccgcagtacagcctggtgggcacagttgaccggacaccagaattcgttttaagacggccttaggaatagcccttagaggacacggacgccggtgtttgggccacgatggctgcgttttgtgaaaggcaatcgactgtttcaccttaccacaagcgaggcgagggaaaatacacgaaggcaacgacgccacaccaacggcctggacgacgcggtggaaatagcgccgacgttacaacacggggttcgaacaagttttcggcaagcagcgcgaaaggaacaagcatattggcaggcagcacccttagtcatattgctcgggtagagaccatttgtggtcacccgggaggacaccgacacgatcccaagcccaagacagggggcatcctctgaggccccccacttagttgtgtgaagggagccccaataagtaacgttacagaaagttcacaggttgacaggacaagtggaaacttgcgcaccaacaaccacttgttgcgaagagagacaagagggtgagacgccacacgtttgagtaggccctaacaggcacgggacccgaatttggaacacagtgtatcaccggggaccacactttttgctcatatgggcttttcaggtgcccctcttgtggtggttatagccaacacatagcttctgtacacaggcaagcagaaattggacccacacgtgtaggcacgggtggacccaggaaagtgggacttcacccgtggattccaaaagggggtagcggcgaatagcgagctacacggttaggcgctcacaacatggtggaagccgcacccacagaaaagatgggtagggacgacacaagaacagaatgcaggtcctattatgttgtgaaacagcccattactgcagaggaacgcgcacgaaagcagtgttggatgtacccccaatatcgaagtggtacccctccagcaagcccactagggtgaaacccaagccccccggtgacagcgttgctatgagaagagagccacacagagtactcg

SEQ ID NO: 589369 - DNA, 190 bp, Homo sapiens
taaaatcggtttttatcccttgcccatgaaaaaattttgggaaaaaacctgcgtgggggtattccggttttgaaaaaaaaaaaaagggccttggtttttgttgaaggccggattttggataaacctttatgttggcccccctatggtcagggctggaaactaaaaaggacctggttttttggccgctgga

SEQ ID NO: 589370 - DNA, 100 bp, Homo sapiens
ttaaatgtcctttgtccaatgtgaccatttattcatattgttttgattaccctcgtgttactacaaaatggcaataaatactatgggattgtttgtttta

SEQ ID NO: 589371 - DNA, 102 bp, Homo sapiens
caggtaattgaggaagcagcttactattgtagttggtgtgagatggaggaaggagctagggaaataaaaacctgtacctccatgtgcccacagaatccttct

SEQ ID NO: 589372 - DNA, 110 bp, Homo sapiens
ggcggtgaagagctgggtcgactcaggctagttcttctggagctcaacttcttgccaaccacagtgaccaagctgagccaaacagcagctaattctggcgcgtgacatac

SEQ ID NO: 589373 - DNA, 140 bp, Homo sapiens
aacttttgctttcctgaaatttatccccccctttaaaaatttttgcttgcaagcccctggataggttgtgttttaagggtgagctgcccaattttccctgccgggggtcctataaataaatgtttttttttttcctgcca

SEQ ID NO: 589374 - DNA, 115 bp, Homo sapiens
tgtgatcatctcccagaaagagagggctagtctcatgagaaaacccagattttcttggcttagtccaccttgacagctaatcactggaaatgggtgtgggctggtaacagtcctc

SEQ ID NO: 589375 - DNA, 709 bp, Homo sapiens
  misc_feature (53)..(53): n is a, c, g, or t
  misc_feature (56)..(56): n is a, c, g, or t
  misc_feature (65)..(65): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (80)..(80): n is a, c, g, or t
  misc_feature (108)..(108): n is a, c, g, or t
  misc_feature (115)..(115): n is a, c, g, or t
  misc_feature (124)..(124): n is a, c, g, or t
  misc_feature (252)..(252): n is a, c, g, or t
gttttcagaacttttcttgtcaccccagggcgaatacagagtggcaggtggtnatnttggggggnattnatnttntananaactgaaaatctgaactgggtgcctgtncccgtcnagggttacnggcagatcccgtggacagcatcaccatgaacggagaggccatcgcctgcgctgagggctgccaggccattgttgacacccggcaccttttttgctgaccgggcccaaccagccccattgccaacatcnagagggacatcggagccagcgagaactcagatggcgacatggtggtcagctggtcagccatcagcagcctggccgacattgttttcaccatcaatggagtccagtaccccgtgccacccagtgcctacatcctgcagagcgaggggagctgcatcagtggctttcagggcatgaacctcccccccgaatttggagagctttggattctgggtgatgttttcatccgccagtactttaccgtttttgacagggcaaacaaccaggtcggcctggcccccgtgggttaagcctaagttttttcagccccctcccaggaagatttggcctttgtcctgggccccctttaaatggatttaattttcctgactgtttttcccaggggagtgtggaggttttggccctgttccctgtcctaccaataacgtagaataaaaacataaccccctgaaaaaaaaaa

SEQ ID NO: 589376 - DNA, 112 bp, Homo sapiens
tccaacaactctccctggttcaacctgtaaaaagtgggtcgattgctgacagactgggtcttccctccctgcatttcagacataccagttactgaaagcaaatcagttttaa

SEQ ID NO: 589377 - DNA, 850 bp, Homo sapiens
  misc_feature (850)..(850): n is a, c, g, or t
gcaggtggatcacgagatgaggggttcgagaccagactggccaacatgtgaaaccccgtctctactaaaaatacaaaaattagccaggtgcggtggtggacacctgtaatcccatctactcgggaggctgaggcaggagaattgcctgaacctggaggtggaggttgcagtgagccgagatctcagacacagcaatctgctgtgtctgaacttatacaattgcactcttggtcagatactctgtaccacaactgggtctcagattaagctgggggttgaagactaatcttgtttcggagagaggagcgaccaacaaaacacaccagacgacatcgagaaccgacgagaatcaaaaaaatagacacctaaacagagagccaccaagccagaacacagaaaggacaaaacaaccgacgacacacgctacagagaaagaaccgaacgcgaacgaaaaaacgaaagcaaagaagacgaagaacaaacagaaagcaaacacagcgcagaaaacaagatacagagaaccaaagaagcaaaaaaaacagaaagaaacgaaggaagagaaaaaggaaaagagagcgcggcgaaagggaagggaacggacgcgagcgcgggaccaagccacgaacagagacgacggacaacgcagaaagcagagaaagcaagacccgcgcacacacacaggggaagccgcgcagccgcaaccgcgcgacacacacggccccacaacacaagcagaacgagcaggggcagaggccaagaccgaagccaggacgcggagaagaaaaagagagaggggaaaggggggagaagaagaaagacggcgcgcaagcgatgaggcggcaagagggan

SEQ ID NO: 589378 - DNA, 952 bp, Homo sapiens
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaaatcagttcgtggttgcattgtggatgcaaatctgagcgttctcaacttggttattgtaaaaaaaggagagaaggatattcctggactgactgatatcgtacatgctgactctccggcgcgacacgtggggtcaccacatagaagcagacttaagacaagaagtactcggcaagatacatcttgtgcaagtcttcatcgtagagaagaagagtagatgtcgcgtccagttatgtatggtcaaggaaaagcgcctgtataaatagaagaagggtaactaaacctaggaccaaaggcactccgaagaattcagccagtctttgcttacatcgcacgtgatccttgcaagcacgaaacggacaggctgctcatttgctcgtgaaagagagcgagcgtacccgagacacagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactc

SEQ ID NO: 589379 - DNA, 483 bp, Homo sapiens
ggggagcccggtaatcgcataaaacttaaaactttacagtcagaggttcatttcctcttcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaggtgggccgcttgggccaagcggactttagactggggcaggttaaggcagggggccgaaattggggctaactgggcaaattggcccaaaggggggcggtttaaaaattaacgggccggggtttaacaacgtcgggacgggaaaaacccgggggtacccaaactaaatggcctggaagaaaatccccttttggcaagtgggggaaaaaccaaaaaggcccgaacggatggcctttccaaaaagtggcgcaccctgaagggcaaagggaaattggaagcggaaaaatttggtaaaaatccgggtaaaattttggtaaaaaaaggta

SEQ ID NO: 589380 - DNA, 1437 bp, Homo sapiens
ggggctatgtgacctgcgctaagcggaagctggcgctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccagccctgctcactgcagtcacaggggccattccctgttcaccagcacccaaggcagcaactggcagcaacagcacaagcagcaacacatccagttacagtcggttgccattgctggcatgcgaacatctgcagcgattcatccaacatgtgcgttcattggtcaaacaacaaggcagcagcaaggcatcatatccatggcacatgcacctgcatcacatcaccagatagccaatcgaccagccttggagcccccgaagacagcagcgtcagccagcacatccagcaacaacattgttccaatcatcatcatcacaagaccagcatgcatcgtccggcgcagatatagttggtcaaagcaacaagcccgttcaacataacagcacaggtaaagcaacaccctacggcaccaaaagaccagcccaacagatcagtcacgcgaatctagggattcacataccaaacgatggtccctgccagacaccaaacggacggcgatataggctcatgacagcaagcagcagtcaccaaagaacaacatcacagagacagacggcctggccagacttactggcctcaaacctaggcgcacacgacgacacggacagggacggcataccgggcagacacgccgccagtgcaacacaagggcgacagcagaccgcacgaacacttgacatccttcggaggacgctgtactacattcgacacgacctcgaatgccaggcacaggcaagacgtaagaaataacacggaggtagcacaaacacatagagtgaaggaacacagcaactctgcacaccgagacagacacagggggacgcgaccgaaccagaaagaaacaaataccactacagaaggagggcaccaaaacgatgcagcaccagaacccaccacgaactgcatcgtaaccacacaaggggggccccaacagaacgcatagggtagtatgaaagcaataagaaacaaggcacggagagattgatcaaccgaggagtacctgtggcaaaacagctagacacggcgaccatgggaccgcagcacacgatcagaagtacgtgaggacacaaacacgtgcaacaacagacctaccagaaacaaagccacgaggacgatcagaatacacgacagagcaggaaacaa

SEQ ID NO: 589381 - DNA, 915 bp, Homo sapiens
  misc_feature (204)..(204): n is a, c, g, or t
  misc_feature (278)..(278): n is a, c, g, or t
  misc_feature (290)..(290): n is a, c, g, or t
  misc_feature (325)..(325): n is a, c, g, or t
  misc_feature (328)..(328): n is a, c, g, or t
  misc_feature (377)..(377): n is a, c, g, or t
  misc_feature (384)..(385): n is a, c, g, or t
  misc_feature (387)..(387): n is a, c, g, or t
  misc_feature (398)..(398): n is a, c, g, or t
  misc_feature (409)..(410): n is a, c, g, or t
  misc_feature (416)..(416): n is a, c, g, or t
  misc_feature (431)..(431): n is a, c, g, or t
  misc_feature (455)..(455): n is a, c, g, or t
  misc_feature (476)..(476): n is a, c, g, or t
  misc_feature (479)..(479): n is a, c, g, or t
  misc_feature (526)..(526): n is a, c, g, or t
  misc_feature (548)..(548): n is a, c, g, or t
  misc_feature (614)..(614): n is a, c, g, or t
  misc_feature (631)..(631): n is a, c, g, or t
  misc_feature (893)..(893): n is a, c, g, or t
gcttaagattgaaacagactattacaacaatatttgagatttcacagagaactgcatgcttttgttattaaaagacttttgttgaaaaatttgacctttacctcttatgaacgaaagaaatatagaggtttcaagcatttttgccagcacagagtcattcacaacaaccttctagatgcttattttccaccttttcctacaganggtaatattcagttaccagagggccatctccaccactgaatgattcagagcttcagagctcaaaagtgatcagnactcacaaattngcataattggtccaaagcttgatttagatgtttgnggngcagcaaacatcaaataatataatgccaaatagaatattatagtctctntggggtnntngctcatcggcnacggccgcctnngactgngattttctgtgcttngtttctattagtacaacaccttcnttcttaatgcttcttggggcntcncgggttttggggattgatgtgtttttggcgttccgcagtgatggtcnctttcgaaaactgcgatatacntctgcatgttacactgacatacaacacataagtgttttgtcacacatcaacttttagcctcggatnatagaatacgaagggcnacactggacataacaccacagaacttttgaatatccccttttcccaattgttaacaggtagtacttttttctaaagagaaagtgatgaaaaatccaaaatttctgcatccagtgtttgactccaactttctactttatcgtctcctggtaccaccatatcctgatgcagttctggttttcgtgtctgagtttgaacataccgaatagctgcccgagcctccatgaaggggtgagtaagcctattccacgtgccagggtaggngggaggtaggacgggtatacac

SEQ ID NO: 589382 - DNA, 1489 bp, Homo sapiens
ctctggtgcaatttcgatctgttcgagctcgtattcctggttgttgcatcgaacatacaatcgaagcagacacagtgctcgttgccaaggcccgaggcccgaacgatatatcgtgtcggctagagtgtctttgactatgcatgttgcgcagttgggatgtcatgcgctacgctgccccaatatctgtgcccatgctgacgcggtagcagctggtagctcatcgatcgtgtactgttttcctgaaatttcagatcggtcatattcgaccttattgactcaaaaggaggcggccaggtatcagaacatggggacagtgaacctagaatagtataacatagaagtataacatagaagacaatatcatgtaactcaagaccaggcgcatctaagaatatcggatgtggtgacgttcgtaacggatgattctgatccctggtatccattgtagtacgccgtattaaagggtatgttcaaagatactgtagaaaagcgaaaaaatgcaaatcgagagaggtagagagaagttaaagtggaccgtttggagggaatatatatacctattgtggattgcaaagatgttgcttcaagcgagtaatggatcgatattagaagaagtagagtaacaaataattagaatataatacttacgtagaaggactttgtggtgcgtaaagacaattattgcgaaggaggaacatactaagagttggaaacggagattactattcaaatacgaagaatgctggtaaaacaggttttaacttggtttcgcaaggttatggtcagattgaacagtggtagtctggaatagaaaatgtaaaataagttgggatcggggtggctgaggaaatttgctccctattcaaggaggttagatttgaccaatttttgcaattgaatttgcatctttaccttgatggggggagttaataaattgaggaaatttggtttggaaactaagtttattaacattaaatgtgtgggctaattggttccaatgacaaaagtaattttgacgtagtggggagtggcagtccacggtttaaacttgcgagaaaagaggtggacatttttggaaggttaatagatacggggtgtgagcatcaaaaacgtggggttcgtgcaaaataaaataagccaaaagttttggtttgacgaacacgatttaaacgacaattacgcgaatatgggggaaaaagaggataaaggtgggagagagcatggaattgttggagaacttggtaacggtacgccagggtctgtaaacggggagggaagttcgcacaggaaattttgtgcacgtatgtagaacagtttgttttacaaggagaagggagggtaacaaaatttacatagagtgggttacaacgatgtgtatgaaagagctctgaaagtatacgggggacaaaaaagaggcaagagatagttgtggaagagagtatgttagcagtgaacagcatatgagagaggagagggtgttaaaataaag

SEQ ID NO: 589383 - DNA, 369 bp, Homo sapiens
gcttaagattgaaacagactattacaacaatatttgagatttcacagagaactgcatgcttttgttattaaaagacttttgttgaaaaatttgacctttacctcttatgaacgaaagaaatatagaggtttcaagcattttcgcgagagggttgtcagtcacaagaactttttaaacgatgatctgtcacatgctcgtacggatgctgatagtctgtaaccagtacggcgatgatcagcaatgaatgattctagagcctacagagctcaaaagtgagtctgtaactcaactaaatgtggctatgaatagtctcaatcattgcatgtgaggcggatacagccggtgatgcctatatgaatcgaacctgtc

SEQ ID NO: 589384 - DNA, 202 bp, Homo sapiens
  misc_feature (67)..(67): n is a, c, g, or t
agcggagagttgttgcaaagtgctcagcactaagggagccagcgcacagcacatccccctttcggancgagccagcagcagcagccacaccgaggtatgatgccgctcacgaggatctgcttccgatactcaacaggaactctcggactctggcatgaacggatgctcgtggtgaccggatgtggtcccaatgccaagcgtc

SEQ ID NO: 589385 - DNA, 423 bp, Homo sapiens
tcttcctctctgtttgcttatggcacaacagagaaatggggtaatttttcaggagggtggagagaaacacttgaaacttgtggggaaactctatgaccagtgtcatgacaccctagtacagtttggtggatttttagcatcaaatctaagtacagaagattatataaaacgagtgccttcaattgatgtgctctgtaatgagtttcatacaccacacgatgcagcattttttctgtctaggccaatgtatgcacaccatatttcgtcaaaataccgatgaacttaaaaaatcagaaaaagggaagtaaacagcaacataaagtccataaatacattacatcatgtgagatggtgatggctcctgtccatgaagcagtggtctccttacatgtttccaaagtctgggatgacatcagtcctcag

SEQ ID NO: 589386 - DNA, 785 bp, Homo sapiens
tggggtaactcctttaactaaaatagttcaaatcaaggtttttaccacactatcaaaaagttctatttcttctggtttccccagcgtcagaggggttgaatagaaggtaaaaacgggccgggagtccacggggctcccagctctaaacgggcggccaggggcagggaaggggggggctccaggtctcacggggggcaccttctacagaaaatagacgtagcgggccggggcccgggggacagaacaccagacgtgtccagtccatctccaaaaagcagcacaaatacttggccccacagtatggaaagaattatacaccttcatacgggtcgtggagctcagggcatttagtttaatgaaaacaagaacaacaaaatctcatgcagtatagtgtatctcggggttcccctcaaggtcttccccagcaacaaaacaaagtgtgaggggccccctttttaccgctcttataaaccacggtggtgggggttctgctatggaaacctctggggtatcaacaaggaggtgcgcccctctctacaaacaaaataggtggcgtccccaggaatgtggtttctcgggagagggcgcccagtgagtaggcggcttcttggggccccactcgggggcgtcgtgaggggagacagaaggggagaagaccactccccatttcgtgggtgcccccggggtggaggacactttgaggaaccccaagatgttgcccaatggggcccggaggccggggaggatacccaaggaatccaagggatttcaaaaccttttgagag

SEQ ID NO: 589387 - DNA, 548 bp, Homo sapiens
  misc_feature (1)..(1): n is a, c, g, or t
  misc_feature (4)..(4): n is a, c, g, or t
  misc_feature (23)..(23): n is a, c, g, or t
  misc_feature (30)..(30): n is a, c, g, or t
  misc_feature (36)..(36): n is a, c, g, or t
  misc_feature (38)..(38): n is a, c, g, or t
  misc_feature (40)..(40): n is a, c, g, or t
  misc_feature (45)..(45): n is a, c, g, or t
  misc_feature (91)..(91): n is a, c, g, or t
  misc_feature (106)..(106): n is a, c, g, or t
  misc_feature (111)..(111): n is a, c, g, or t
  misc_feature (120)..(120): n is a, c, g, or t
  misc_feature (127)..(127): n is a, c, g, or t
  misc_feature (169)..(169): n is a, c, g, or t
  misc_feature (172)..(172): n is a, c, g, or t
  misc_feature (186)..(186): n is a, c, g, or t
  misc_feature (206)..(206): n is a, c, g, or t
  misc_feature (211)..(211): n is a, c, g, or t
  misc_feature (213)..(213): n is a, c, g, or t
  misc_feature (219)..(219): n is a, c, g, or t
  misc_feature (223)..(223): n is a, c, g, or t
  misc_feature (232)..(232): n is a, c, g, or t
  misc_feature (235)..(236): n is a, c, g, or t
  misc_feature (247)..(247): n is a, c, g, or t
  misc_feature (251)..(251): n is a, c, g, or t
  misc_feature (254)..(255): n is a, c, g, or t
  misc_feature (266)..(266): n is a, c, g, or t
  misc_feature (273)..(273): n is a, c, g, or t
  misc_feature (280)..(280): n is a, c, g, or t
  misc_feature (295)..(295): n is a, c, g, or t
  misc_feature (305)..(305): n is a, c, g, or t
  misc_feature (308)..(308): n is a, c, g, or t
  misc_feature (312)..(312): n is a, c, g, or t
  misc_feature (315)..(315): n is a, c, g, or t
  misc_feature (354)..(354): n is a, c, g, or t
  misc_feature (363)..(363): n is a, c, g, or t
  misc_feature (379)..(379): n is a, c, g, or t
  misc_feature (433)..(433): n is a, c, g, or t
  misc_feature (462)..(462): n is a, c, g, or t
  misc_feature (474)..(474): n is a, c, g, or t
  misc_feature (478)..(478): n is a, c, g, or t
  misc_feature (482)..(482): n is a, c, g, or t
  misc_feature (525)..(525): n is a, c, g, or t
natngttaagggatttttttctnatagctntaattncngngcttntttgtcgaaatgaaaactgaaaacaagtttacaaaacagttgattnctaatcgtgttttgnaagcngttaggggntccccgncccccaatagacccgttctggggtttcccccagataaatttnacngcccccgcttcagngtttttcaaaatacaaaagnaaaangngggggntgtntttttcggnggnnaatcgggcccntgcnggnnggggggggganagccacntcccccncagggggggggggcncccggggggntgngggnctnggggggccgcctgcccggcttgcccgcgcccctgctggnggggccccngacatcctgccaaagngtctgggcgggcccgggtgtggggggcggcgggccccctctggccccccggcgnccggggggcagagggggccctgcgtcccntaggctgcctgngggngggnggggcggcctgcgcgcgatagtggggtggctgtgggctcccancctggcccctgggaaccgtggga

SEQ ID NO: 589388 - DNA, 393 bp, Homo sapiens
tgaggacccccaagcccgccatacacagctgacacccacccactgagagagcggttatttatttatttatttatttatttattcttattttttgagatggaggctcactctgtcatctaagctggagtgcagtggtatgatcttggctcactgcagcctctgcctccgaggttcaagcgaatctctgcttcctgagtagctgggattaccggcatgcaccaccacacctggctaatttttgtattttcagtacagattggctttcgccatgttggccaggctggtctcaaactcctggcctcaagtgatccacccacctcagcctccctaagtgctgtgattacaggcatgagccactatgcccggccttctgggtgtatggacggcctttgt

SEQ ID NO: 589389 - DNA, 337 bp, Homo sapiens
  misc_feature (1)..(1): n is a, c, g, or t
ntcttctcccgaaaggttatctgctgtctgttcacactgagaacctgtaccccacagagctcgctccaacttcaaacctgtgtgccctatctcggcatgtttctgcacgtctcccccattctctttactgatcttcaagtactctgccacaggaccagcaaccagcgagtcaaatgcctgcacatatgaacctgctcctgcttttaaagccgtgtctgcatacccacggtgcatgtcagagtgtatgagatactgcctacaggcggccctgtgctctctactctctttctcccatattgcgcatgtcagccattatggcccacgtgctgcggactgc

SEQ ID NO: 589390 - DNA, 224 bp, Homo sapiens
tacttccacagggtgtggcaaaacaatcgaacaggggaaagaatagtcctttcaacaactggtgcagagatgattggatatctatgtgcaaaagaatgaagttgaactccttcacaccatatgcaaaaattaactcaaaatgtaccaaagacttaactgtaagaactaaaagcatgtaactcctagaagaaaacagaggagtaaatctttctaatcttggatta

SEQ ID NO: 589391 - DNA, 806 bp, Homo sapiens
  misc_feature (426)..(426): n is a, c, g, or t
  misc_feature (529)..(529): n is a, c, g, or t
  misc_feature (734)..(734): n is a, c, g, or t
  misc_feature (743)..(743): n is a, c, g, or t
  misc_feature (748)..(749): n is a, c, g, or t
  misc_feature (756)..(756): n is a, c, g, or t
  misc_feature (765)..(765): n is a, c, g, or t
  misc_feature (776)..(776): n is a, c, g, or t
  misc_feature (782)..(782): n is a, c, g, or t
ggacgcgtgggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgtnttttgggcataaaccctttgaagttccttgtttcattgttaaattaaaattttttttttttacttggatggcttaacatttttgcaagaaaaataggaagatntgaaagatgatgtcttggttggtttatgaaatgcatatggcttgtcagaggctcattcgaccaggtaaaagccattggtttaaagaacatggtgctttgcttctagggttggtagctcctgattgccctggaggttctggatgaaggtgaacacaggcttgttaatgtcagtctgtgctgaggacctcaggcacttgaggttgcnttttgagcntgggnngcagganctttctggnttggtgtggtntggaangaacacagaaagcaggtcatgtga

SEQ ID NO: 589392 - DNA, 182 bp, Homo sapiens
tgttttcatgtaactaatactaacataagttcttctatagggtgatagataggtccaattgggtgtgaggagttcagttatatgtatgggattttctcaggtaaagtgggtgtttgagctttgaacgctttcttaatggggctgtttaggcctaactaatgcgcgctgttttaaaattttct

SEQ ID NO: 589393 - DNA, 414 bp, Homo sapiens
tagtctgctacggctgcaaatagcagtgatttcggacagcttcttgtctgcaaagcagttagcccttgatccatagtgtactcgaagcgttcagcatgtcacagttcggtctgcatttagcgtctttagtaatgagtcacttatagatgttcactcatcagcggcccatgttaatgcggcttcagccctctcattcacgagctccacatgtcatcatatgcactctgcagtagacagtgaccttagactatagacaccagggctataatgtcctcatctagcccttcagatatacctatgacctagcctcctacatgttgcctcataaatgctccacacccctgtaatgatcctagatatagatcaatatgacgtctataatggatacacagcacgttgtcataaacgcgtgag

SEQ ID NO: 589394 - DNA, 641 bp, Homo sapiens
  misc_feature (426)..(426): n is a, c, g, or t
  misc_feature (529)..(529): n is a, c, g, or t
ggacgcgtgggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgtnttttgggcataaaccctttgaagttccttgtttcattgttaaattaaaattttttttttttacttggatggcttaacatttttgcaagaaaaataggaagatntgaaagatgatgtcttggttggtttatgaaatgcatatggctggcaaacctaattcaacagtaaaggccttggttaaaaaaacggccttgcctcttgttgggcccagaattc

SEQ ID NO: 589395 - DNA, 138 bp, Homo sapiens
ggaccctgtatacggaaatacagaaagtggttctcactttcagtatgatctcattgcagaataaacaattgtcatataaatgtagctgggtacaatggctcagacctctaattccagccactcaggaggctatggctg

SEQ ID NO: 589396 - DNA, 573 bp, Homo sapiens
  misc_feature (355)..(355): n is a, c, g, or t
ggacgcgtgggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcttctgtacttgatcaagattgctttgacccgggtaccgactcgatgtgctgctcgacatngtagggaagggacctatctacgtgcgcgtgatcggcgcgctcatatcatagtgtttgcgcaatgccactaataagatcgagaactgaaggttagggcataggaagtaggagcttggggacatgtattgatatgtggctgtaagacctctttttgataagttgccttgtctaatccatgtgtttaagactttagaagaagtccttggggtattgtgaac

SEQ ID NO: 589397 - DNA, 211 bp, Homo sapiens
ccccagggggggggttttttttggggtttttccccaaaggggggggggttccggggtttttggttaacggggaaaaaaaaaacgggcccgggggggggccccccaaagtttggggtccccgggggggtttccccccccccccccccggggggggatttttttccggtgggggttgggaaggttccttaaaaaacccccctggttttgttta

SEQ ID NO: 589398 - DNA, 564 bp, Homo sapiens
  misc_feature (375)..(375): n is a, c, g, or t
ggctgcgtgactgaggccagagggcccgtggagaaccactggagaggccagtgactgcacgagaacgccaggcaacttactaactctagtcaggcggctcagaatctggccacttccacatcggcgctgcaaggaaacacaaggctcagttggaggcagcatggggtctgaggactcgggggtgcagaggaggggggaccacgggcgagctgccaggagacctagaaccctggagcactcggagtcggcacacagctggggctctggctctccctggacggcgcctgcggagcctgcctcacttgcgggcctggagggagccaggagcctgcctcagctgcagacggccccccgcagagcccgggcagagtgagngactgtcactggggccagcaccgtgtgcaagcccaggttatctagcaggcgactgagtgccgagaaaatacctggcagaggtgggcacaaggcggggcccccacggcaaagacgcacgccgggaaccggaaggaggtccatacccaactcgtgcaataaataaaacttttattcaaacaagtaactgca

SEQ ID NO: 589399 - DNA, 567 bp, Homo sapiens
tcgcgcagcttcagccttgctcccctcccaaagtggcctccccggagcggagcgcacctagggtcctcttccgtccccccagccagctaccgttcagaccagcagcctcggggggcaccccccggcagctgcactccctcccgtcagccctgcagggtccccaggcatgactctcttccgatcctgggagactctccactcctcgcatcatcttgctactgctcacaatctggcagtcccgctcgtgcgccggaatttcagggaagagccacgtccatgtttgctgtggtgttcacgtgaccgatatctggacctcttcaccaagctacatctcactcctacaacacgtgtatgaaggtggtctacatagcctgctccttcccacacggactggttgcttaatagcacgtaccagagctagttacagatgggaacacatgacgcgtcacgagtggagatccttgatacgaccccaaaacgccaattcctgggagtgtcttggtcaaatcaatgagtacaccccctctggaagataccttctggacctttctacacatacttaactgg

SEQ ID NO: 589400 - DNA, 833 bp, Homo sapiens
  misc_feature (644)..(644): n is a, c, g, or t
cccccaaggttcaggagcatttttctacctaatcttccagaatttgttgccgaaaatcaacaacagaaaggcagtgaaagaagacagatccatgatctgcctgtggcctggctgcccgtgggccaggatgcctgctgtgaccaccagggagacacagggaccaacgtcctttgtgaaggatgcaggcactggctttgcagagccgccctcctagcaacttggggatggaagggtggtgggaagcaggacccgcccagacacaggtgtaggcgattggaaggtgtgggcaagggccccctatgagggcagagggcctgctcctggacaccctggcacatcccaaatatacaccaggcaccaggggagtggcccactcaacccgtgaggaaatggactcagacccggactccagagtcccactggaattggacccataatggccctgtggtccccggagtgagcgtcagctcaaacctggacccagcagccctccaggtctgcagatccacactagggatggagccagtgtcttgggtccacgttgtggggcttgggggacagaaagggcaaggtcagactaacagcacagccaggagcctgcctcagctgcagacggccccccgcagagcccgggcagagtgagngactgtcactggggccagcaccgtgtgcaagcccaggttatctagcaggcgactgagtgccgagaaaatacctggcagaggtgggcacaaggcggggcccccacggcaaagacgcacgccgggaaccggaaggaggtccatacccaactcgtgcaataaataaaacttttattcaaacaagtaactgca

SEQ ID NO: 589401 - DNA, 139 bp, Homo sapiens
cgtatttctccatcgtcgggcgcaccagacaccagtggcgtcatggtgggcattggccagaaggactcctacgtgtggcgacgaggcccagagcaatgcgtggcatactgaccctgaatgtacccccattgatgcatgg

SEQ ID NO: 589402 - DNA, 82 bp, Homo sapiens
tcataagaaaactcatcatgcagtaaggaaatcccatgaatgcagtgaatgtgggaaggttttatcctccaaaaaaaacttt

SEQ ID NO: 589403 - DNA, 157 bp, Homo sapiens
tatattccttgccctcatagaattcatagtttagagagcaaaactcatagtattataataccacagccatcatcatcaatattctactccactgtattccccccttttctctatgccgggtcactattcttagtgctttcctatctaagtattctgg

SEQ ID NO: 589404 - DNA, 215 bp, Homo sapiens
ttatacctggaaacgggaaggagacgctgcagcgcgcggacccccaaagagacacgtgacccaccaacccgtctctgacatgagtgcctcctgagtgtgcttgtgccctggtgcttctaccctgcgtgagatcacacttgaccttgcagcgtggatggctgaggaccacaactcagtggcactgacgcttgttggagaccagacccacgcaggag

SEQ ID NO: 589405 - DNA, 494 bp, Homo sapiens
catgcctcttttcttcatgagtcagttcttgcaacagctgtttttgtataaattgtacatttcatctacggttacccaactttgttggtgttcagtagtgcatagtgattctcatactaatccttgtcatttctgttacaatcagtaatagtctcttcaggttttgattctagtaatttgaccagttttttcgtggtcaatctagctaaagtttggtctattttgctgacttctgcaaagatgtgatgtctttagtaaatgctctctgattttctctaatgtttgtactctttcatctccactctaatctttattttttccatccttctgctagcattgcatttagtttgctcttctttttttctagtaccttaacatgtacagataggttattgatttaatatctttctcttcttcaatatatgtacttacatccataaatttccaacttcataatgctttcatgtcatcccgtaagttttagtacattatgt

SEQ ID NO: 589406 - DNA, 117 bp, Homo sapiens
gataaacttatgcaaggcgtgtgagatgtcccccatgctgtaaatgcaggtctcttggtatttattgagctttgtgagtgactggtggaagcaggacacctggaactgcggcaaagt

SEQ ID NO: 589407 - DNA, 645 bp, Homo sapiens
  misc_feature (5)..(5): n is a, c, g, or t
  misc_feature (134)..(134): n is a, c, g, or t
  misc_feature (141)..(141): n is a, c, g, or t
  misc_feature (158)..(158): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (167)..(167): n is a, c, g, or t
  misc_feature (179)..(179): n is a, c, g, or t
  misc_feature (186)..(186): n is a, c, g, or t
  misc_feature (190)..(191): n is a, c, g, or t
  misc_feature (194)..(194): n is a, c, g, or t
  misc_feature (230)..(231): n is a, c, g, or t
  misc_feature (238)..(238): n is a, c, g, or t
  misc_feature (241)..(241): n is a, c, g, or t
  misc_feature (264)..(264): n is a, c, g, or t
  misc_feature (289)..(289): n is a, c, g, or t
  misc_feature (308)..(308): n is a, c, g, or t
  misc_feature (350)..(350): n is a, c, g, or t
  misc_feature (352)..(352): n is a, c, g, or t
  misc_feature (372)..(372): n is a, c, g, or t
  misc_feature (408)..(408): n is a, c, g, or t
  misc_feature (428)..(429): n is a, c, g, or t
  misc_feature (461)..(461): n is a, c, g, or t
  misc_feature (465)..(465): n is a, c, g, or t
  misc_feature (471)..(471): n is a, c, g, or t
  misc_feature (482)..(482): n is a, c, g, or t
  misc_feature (486)..(486): n is a, c, g, or t
  misc_feature (494)..(494): n is a, c, g, or t
  misc_feature (500)..(500): n is a, c, g, or t
  misc_feature (502)..(502): n is a, c, g, or t
  misc_feature (507)..(507): n is a, c, g, or t
  misc_feature (511)..(511): n is a, c, g, or t
  misc_feature (516)..(516): n is a, c, g, or t
  misc_feature (518)..(518): n is a, c, g, or t
  misc_feature (523)..(523): n is a, c, g, or t
  misc_feature (527)..(527): n is a, c, g, or t
  misc_feature (531)..(531): n is a, c, g, or t
  misc_feature (552)..(552): n is a, c, g, or t
  misc_feature (561)..(561): n is a, c, g, or t
  misc_feature (577)..(577): n is a, c, g, or t
  misc_feature (643)..(643): n is a, c, g, or t
cagtnatactccaaacttacaggttacttactatctgataaggaatacaagatgatagaccgagaaaggcttgaggcaaacacaactattggaaccaggttaccagtacatttaaacactattagaaccttgtnatcaganaacttacatatcacctnccntncncncgctcccccccncccttcntcgnnccnctccatcttctaactcctcaatggctatttaagtcnntcccctnccnggttaaacattaagactagggantaccgcccccccccccccccccccncccccgccccccccccccncccccccccccccccccctcccccccccccccccccccccancncccgcccccccccccccccncccctccctccccccccccccccccccccccccccncctcccccccgcctgaaganncacacctcgctcttgagtccaatcccactctntctncaagcnttatcaaaagncgtntacctggncattcncnggatngtangcatnangaagntagntagngagaaagggaatagggacggnatacaagancatccaacaacccatncaatatgaatgttgttcgcgatagtacaaagatagtacaattgaaaagcaagctgaagttaatgantt

SEQ ID NO: 589408 - DNA, 193 bp, Homo sapiens
acacctacctgagtctgggcaacagagcatgaccctgtctcatttgagagaaaaaaagaaaaaaaaaaaaggccggcgcagtggctcacacctgtaatcccacactttgggaggccgaggagggtggatcacctgaggttgggagtttgaaaccagcctgaccaacttggagaaaaccttgttctctactttt

SEQ ID NO: 589409 - DNA, 191 bp, Homo sapiens
ctgctcggcccagacaagctttctggattcaagatgtaccccattgactttgagaaggatgatgacagcaactttcatatggattgggggggggttgtatccaaccttcgggccaaaaactatgacattccttctgcagaccggatcatgagcaagttgatcgcaaggaagatcgtcccagccattgccac

SEQ ID NO: 589410 - DNA, 439 bp, Homo sapiens
  misc_feature (51)..(51): n is a, c, g, or t
gatgatatgctaaacaaggagtggatttttcatgcctcctctttttgaccnatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcgttgcccactgcggcttccacctcccgggttcaggagaatgggatgagcccgggaggcgaagcttgcagtgggcc

SEQ ID NO: 589411 - DNA, 302 bp, Homo sapiens
tatccagctaagcatttaacacccttatcctttattatagatctctgccaagtagttccttcagcctcaccttgagagaagaccctccatgtcttgcatggtattttccacaaggtcttcattgcctctgttgcatcccctttctctgacatcgtctctgtatctctttctgcttctgctccaacctatctgacccccttgttgaattttttttccgtaaagcatgctcctgcctcagggcctctgcacttgctttttcttctgcctggaatgctcttcccccatatggacacgaatgttca

SEQ ID NO: 589412 - DNA, 795 bp, Homo sapiens
  misc_feature (2)..(2): n is a, c, g, or t
  misc_feature (13)..(13): n is a, c, g, or t
  misc_feature (51)..(51): n is a, c, g, or t
  misc_feature (110)..(110): n is a, c, g, or t
  misc_feature (125)..(125): n is a, c, g, or t
  misc_feature (171)..(171): n is a, c, g, or t
  misc_feature (257)..(257): n is a, c, g, or t
  misc_feature (289)..(289): n is a, c, g, or t
  misc_feature (293)..(293): n is a, c, g, or t
  misc_feature (314)..(314): n is a, c, g, or t
  misc_feature (316)..(316): n is a, c, g, or t
  misc_feature (332)..(332): n is a, c, g, or t
  misc_feature (338)..(338): n is a, c, g, or t
  misc_feature (344)..(344): n is a, c, g, or t
  misc_feature (346)..(346): n is a, c, g, or t
  misc_feature (350)..(351): n is a, c, g, or t
  misc_feature (358)..(358): n is a, c, g, or t
  misc_feature (370)..(371): n is a, c, g, or t
  misc_feature (379)..(380): n is a, c, g, or t
  misc_feature (393)..(394): n is a, c, g, or t
  misc_feature (396)..(396): n is a, c, g, or t
  misc_feature (407)..(407): n is a, c, g, or t
  misc_feature (411)..(411): n is a, c, g, or t
  misc_feature (414)..(414): n is a, c, g, or t
  misc_feature (423)..(424): n is a, c, g, or t
  misc_feature (777)..(777): n is a, c, g, or t
gnatggctgaggntcctgtagaccacaactaggggcattttctgggcacanaggtaaggcatgcctgggggctggaggaggctggaggaggatgcccaagctccccacantcctcaccccagacnggggaagctggatatcctccgtgttgtcctctccccatagctggtntgaggctgtggtttacacgcaggcacaggtaggcgattctgagcatcaacgcagatggaggggagggtgagccgtcgtgggagaantggcccaagaccagcacctggctggtgtcgcnagcnccggctgcattggtgggtgangnaggtctggctggagtntgggtntgaagncntggnnggggaangttgtgggggannaaggagcnntgggtgtgaacannantgtggaggaanaagnaantagtggtgnnaatgggaaaaaaggataaaggaataaggatgtaaaaaatgagtgagttttggagtataaaaaaaaataggggaaagtgggtgagaagtggaaagtggtaaaaaaggaagtgaaatttaaaagggggaaaaatgggaatttataaatggaattaaaaggaagaaaaggggaaaaaagaggaagtggggaagatggagttattgggatggaagggaatggtggaagaattattggaattaatgaagggaatggattgatgggataaggtaaaagtgttatgaggtaaaaaaaagaaataagaatagaaaataagtaaaacaaaaaggatagaaaataaataataaaaaaggatanaaaataaataaaaaaaaa

SEQ ID NO: 589413 - DNA, 756 bp, Homo sapiens
ttcgtcaaccacgccgtcgcccacgcgtgggccacgccaggcctcctccctgaggctgcagccccaggcacgtggggggcactgtcctcacgcagcaggcactggtcatgttccattgtcagctgcctccacctgcacagactcctgtctgtggagaccagaagcttccagaaccatctgttggtgctgctggtggctgtggcccatagtgttctggaaccacctgccctggtcccaaatgtgcagtgtgagatgtgcacacactcagggccccgtgacctggaagccgcagtcgtgtccccagcaccttgggaatgagcctgtcctctgtgtgaaggagggggtggttctcaaaccactgactcttggtgctcaggaggggcctgctgctgtcctgggcatggggtggtcattgttcaagactgaggcagactcagtctttgaaagggtgcagaggccaggcgcggtggctcacgcctgtaattccagcactttgggaggccaaggtggacagatcatgaggtcaggagttcgagaccagcctggccaatacggtgaaaccgcatctctactaaaaaataacaaaaattagtcgggcatggtgatgtgtgcttgtagtcccagctactcaggaggctgaggcagaagaatcacctgaatctgggaagcagaggttgcagtgaaccaagatcgcacgactgtacaccagcctgggcgacagagtgagactccgtctcaaaaaaacaaaccaaaaag

SEQ ID NO: 589414 - DNA, 258 bp, Homo sapiens
cccaaccccccccccccctttggtaatttttttaaaacaaattttccttgcagccaaaaaacccttttttttaggaaccttccggttaaaaggaccccatttcttgtttactttcttaaacaaaattttgactttttccacccccacgggggaataaaataaaaaggcccccaaactttttccacccccacaaggatataaaataaaaaggcccccaaaactgttttgattttaaaaaaggccattttaaaattttta

SEQ ID NO: 589415 - DNA, 982 bp, Homo sapiens
gcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgcctgcgcccggctgtcaagggagtacttctgttgttcctggcccgggaagcatcgagcagtgcagtggaggagatcctgctgtggttggttgcggccctgttggaggactggctgagatccgagtgacgtgtggctgcttaccgaggtggatcacctggaacaatgagaaggacgcggctggtgctggtcacggagcaagtccctgcttatctgtaaactacgacttcatcagtctccagtgccagcaggttggtgcggatagcgctcaacgcagtagacaccatttcctacggagaattccatgtttccccctaaatcgctcaacaagcgagaaggttagggattcgaatccagtgggacaagcaaagtcgtacattccttcataaccagatggaatccctggtctaccaagtgccctatgccactttcacagaacacccgatggctggcgcagatgagcacgacagcatctctgtgtcaggttggaaagcttcaagggtctgttaatccaagctgtcaaaacaagccaagaagaaggcctttgccaggaccaggcgaatggcgtgctgatccttggagagccccagtgtcatcgagacctacgtgggactcatgtcctttcattaccacgaggtcgaactgggctactccattaccaggggcacaataggctttaagccgctggttctggggggctactccccttcccaaaaggcacggatgtggggctggagaactggacgcctgcaagcatcatgctgcctgtgacgtgacgagtggatctacatggggactagaaacaagatct

SEQ ID NO: 589416 - DNA, 946 bp, Homo sapiens
gaccctggcgcgtgtgaccctgtacacgtatcctgaaagactggagggtccttcaatgctctcatcgctggctcagtacagcggggctcaggtccgcgctggtcgtcctggatcagcccatgttccagttttggtcgcaaagccgagatcgcgagctgcgcatggatatttctccgcaaatttcctgccaggcaaggtcccagcatctgagggtgtatgatggattctgtgtgtaagagagcaaacgccgttgcctactatgtagagcaactgaggagcgtgcgggggaagatactactcagatggcatgcatgccacaggtggctgcagtgtgcgctgaggcttcagctcgattgcctgatatcgtgccctccaagtactagtaccctggggtgttactccagactatgggcactctaatgcagcacataacagaatcatggccagcttgagaatactgcaaagggagggaacgttgaaggcggaatttctgggggctgtctggatgcgttagcttcgaaggaacagagtgcacttgtgtcttgggtgtgcgcgatacagaaggtgacatttgagcatggacatcagctagatcttgtctagtcacccatggttagtgagctctactaaggcatggttctagaggccttctattccctgccatggcctttgcccaaataccaaatgcgctgagttcctcagcctgcattaactcagtccccagtttccgaggctagtcttgtggcagaagtgagaacttgtggtgagacagattggccccagtttgatggctaacaacagtttgccgaaaacccaagctaaggacggacacacgcaccggacaagaggaagggtccacggtgaagagaagcaagaaaccccaggctgagcgggaaggagacgaatggggggttgccctggtcctgaggaggagatgatgcctgtg

SEQ ID NO: 589417 - DNA, 394 bp, Homo sapiens
  misc_feature (392)..(392): n is a, c, g, or t
gcctagtatttttcagtattaagactgatttaattcccatttccagaagagaaatatacatatacacaggactagcctaaaggcacagtttaaaaatacccagcccaaggcccgggtgtggtggctcacaccccataatctcagcacttgggaggccgaggtgagcagatcacctgaggtcaggtgttcgagaccagtttggcccaacgtggtgaaaccccatctctattgaaaatttaaaaattagccaggtgtggtagcagtcacctgtaatcccagctactcaggaggctgaggcaggagaattgcttgaaccagaaggctgaggttgcagtgagccgagattgcaccattgcactctagcctaagagacagagtgagactccatctantt

SEQ ID NO: 589418 - DNA, 323 bp, Homo sapiens
ccccccccccccccccccgggggggggggtttttttgggggggtaaatttttttttttcggggggggggggggccccccccccctggggggttttaaaaaaaaggggaacccgagggtttccccccccggggggggtttttcccgggtttttttttttcccgggggccccccccggggggatttttaaaaagggggggtgtgggtgcccccccttttccccccccctttttttgggggggtttttgttttttttttttcccccccccccccccccctcccccccctttttgggggggggggggttttttttggggggggggga

SEQ ID NO: 589419 - DNA, 849 bp, Homo sapiens
  misc_feature (19)..(19): n is a, c, g, or t
taggctagtacgaggcggnggtgaatcggccgaggtgccctgtagtccagctactcgggaggctgaggcagaatgcttgaaccccagaggcagaagttgcagtgagcagagatcacaccactgcactccagcctgggtgacagagcaagactctgtctcaaaaaaaaaaaaaacaaaaaaaacaaaaaaaatttcttcatgtaaattttaccgggcttgaaaagggcccacactcgggattacggacggttcttcaaatagtatggggctggggcacggggggctcatggcctggtaatcccggcacttggggaagccagggcaggcaaatcagtggaggtcaggagttcgggaccagcctgggccaacatgggtgaaaccccgtttttactggaaaatggcaggataacgctggggttgtgatgggcaggcgcctggtgggtcccatctacttaggaggctgaggcaggagaatcacttgagttgtgggagcgcggagggtgcagtgagccgagattggagccacaagcactctaggctggggcaacagacaggactccgtctcaaaaaaataatttaaaaaatttagggccaggcacgggggctcaatgcctggtaatcccagcacttgtgggaagctgaggcgggttggatcacctgaggtggggagtttgaggcagtctgacaaaggagaaaccccatctctactaaaaataaaaaactagcggggtgggtggtcgcatgcctgtaatcccagtactcgaaaggtgaagaggaagaatgttgacccgggagcggaggttgggtggagcggaaagcattgctcagtgggaaagagtgaatcttctc

SEQ ID NO: 589420 - DNA, 297 bp, Homo sapiens
ggtgaatatttagcttcacaagctacacctccattcatttctgccattcctgaacagcaaaaccaaggattttgatgcaaattctccctgctggaacatattccctgatcctctcaacaagctcacctctctaagctgctcagctccataacctgctcatgagttctttatctttccttatttagaaaacgtaattaggtaaaattaacagcaggacatatagggttaattcacagcctttggacagcatttaggtacagccatttaggaacagccatttaggtaacagccatttag

SEQ ID NO: 589421 - DNA, 123 bp, Homo sapiens
acggtctatgaagtggatccccctaccccacttaatgcgtgggatatgatttgtcaaagaatgcttcatgcccaaaataccagcctgtatagcagtgttacactgtatgatctgcggcgcacg

SEQ ID NO: 589422 - DNA, 864 bp, Homo sapiens
  misc_feature (453)..(453): n is a, c, g, or t
ggtttggtgcacgtgggcctcgcctcccggtgtggtgtttgagatggacgcgttccgggttttgttcccccgtcctcaatcttccgtgtgctttggtgtcgagcccacagatcgtcttgcttgtagggcttatggtaaacccgtgggtcttttcccccgagggcgcccggctttgtgtgcaaaggttcctcgcgggttgtcccctggatgccggcggccaagcctctttagggagctgaatgtcttctccagcgaaaagatgtgagcgacagctcgtggtccaccttgttgcgccagccacccacgctgctgcttctggggagactggcagttcgcgttcctccgtccggccgtagagagtttggtgtcttcctcacccggggagttcttgcctgaggtcaccaagaagttacaatcgttgtgcggtgagagattgctatctgcgcgaatggngtctctatatagctggccccttcgcctaagagtgaaaagatagttcaggttgtatatatacccggccccccgttggggctatccctccgctcgaggatcgctcgctgccccccttggggggggcccacagggcggggggtgctccagaggcccaagagtttggagcccgcagcgccgcgagtaagacgacggtcgaaacctcctcgtctctgatcatacacccaaaatgtagtccgccggggtgcgggtcgggcacaccgtcatgggcccacacgcgactacagagcggggaggccggaaagagaggtgggggaacccgggcagccaagactgataaacggacagacattggggccgcataatgcccacggggggaaactcaggggggccccctcgtttctaacaagacag

SEQ ID NO: 589423 - DNA, 217 bp, Homo sapiens
ccaccaagtttgaacatcattcagcaagcacatagaagattcacaacagagaaattagttcaatgcaaatgaaactgctggacaatgaacgctttggaaaatcataatagtcagattcaattgagatgcagtagcccacaaagcattcttgtacaaggagctcacagagttattgcagaacatcagacaacccagcaacagatgaaaacaagccaaa

SEQ ID NO: 589424 - DNA, 386 bp, Homo sapiens
gaaaaggggcatggagacaaactggatgctagttcttctatacagataaacacatggagttcagactagttacacgtcacttctaaagcaagcacgaacgagggacacgagagcaaacctgtacattcactagcgaatttgcagtcatttcagatttccactaggtaagaaaatacaattttgcgttagtttttccgtgctcgggtgtatgaaaaaaaaacccagccgacatgcagcaacgtctccagcgcttaggtccgtaaaaatgttctaagcacagaagtacatgtggaagaattctctcatcattttttgtaaaacaaagcgttctaatattttacagaacaagataggacagttttttttttcttttaaagaagttgaac

SEQ ID NO: 589425 - DNA, 952 bp, Homo sapiens
aagtcgtgctttaagttgtctcccacgaatggttgtctgggaacacaccatttggggcgagacgcgttttatgacacccgctgccttccttgcccaagctgcgtgcaacttgtgttccacccaggccgcaatattcctctgttcccgggggacacctaattaccaccgccccgcgtaaaaaaaccctatttcgcagggggggactcgaagaccccctttatgcgtgtgttgtcgccgcgtgactctccaggcaccaggttcttacacgcccccaaatgggccccccttctctttcacgggggaccattccccacgaatgagtgtgtattgaggacaacctttccgggcaaacccggcgaagtacctttgagttcatggtgattaaacacattcgatcccccgggccttccattccaatttcgggctaccactcccccgggccgtcttaagtcgcaagcggtcttatcctctcttctgcgttttggattaattccggccaaggttttgtcgccgccccgaatggtgcgaaccccggtgtgtggtcttcctcctctctgacgtcccgcactcgtctttgttgttcactccctcgattgctccagattgctcctcccctgggggacatcgtacgatccctccctcccccctgggggggaacccccacacaggaaatctgcttataacaccggtcacataaaacaataacttatctttattaagtcatcttaatataccaaacaaaataatcataatagattatctcactattagtgccacacagtgcctgccagaagacgtcttcattctccgtatgcaataagacacgcaaagagcaccctccagttctcagaaactctctcctaccgaccttcttcactgatgtatcgaagtgtaccttcgacctccacgatctccaaataccctttgctttctcaaccgccccacatgacaa

SEQ ID NO: 589426 - DNA, 430 bp, Homo sapiens
cccctcagcacagatgtagagttatagtactagagaggatccgtgatcgctttaagcctgtcctcgagctcaataggcaagcctgttatgccttcatactctgcgtccggtactccatggtttatggatgcaatgctgcctataatctctacttcaggaagctacgaggggcctaatcagattgagggaaggaacggtatgtcttttcttctggaggccggcacctggttctgtatccccctggagcagcctttttgaaatacctaggcttataaacaatgcttctcttcctggatagttctcttgtctggctgctcccctttttaccgcccccagattgataagtaatgaaagtgcgtggcagtgagggtcaaaggacagtctacatatgtgattgttccataataaacttctggtgtgagtctttcta

SEQ ID NO: 589427 - DNA, 772 bp, Homo sapiens
accataggaagacataaaactttaaaaggcaactcaatagatgatggaaacgcacttacaagtggtgaccaaaatttttaggtgaagtcgagcactctaattagagaactggaggaacctacatataacacttaacttcccctaccctgcccctccccaatgagaataccatgacaaacctagcttttaaaaaatattttaagaaagagaatgaactgtggaatttattggcaggcaatggaatgtgtccaatgacacatgctgaggttctgaatacataagtgaagcttttgtacatttgaattgggtcccgcttatgttcttgaatctgttactgaaacattcctatatctgtttgtactatttgcaaacccctttgtagttataaattgtctgactagttcttcccttgttaatagatacactaccagttgagagactcagcatgatcaacaagatagagcgactgttggcatcttaataggtaaccgtgagttgattcagtatcttgagagtttacagtttgtgttgtctaacaaaaagttgaaaggttctagttatataagtgcaacatttctgtatactgtacacagtctataataactgacactgtcagtggtcgagatctctctgtgtgttatacttccagggtaatacttgacacgtattcagaatcttacaatcatccatttgatatccgatcacaattaccgataaaaatcccttccaaccctttcgttgcctcaggacgcccataaagctttttttcacc

SEQ ID NO: 589428 - DNA, 568 bp, Homo sapiens
gaggtccagggttcaagacatcctggccaacatggtgacatcccatctctactaaaaatacaataagttagctgggtttggtgttgggtgcctgtaatcccagctactcgagaggctgaggcaggataatcgctcgaacctgggaggaggaggtggcagtgagctgagatcgtgccattgcactccagcgtgggcaacaagagtgaaacgtcgtctcaaaaaataaaaaaaaagtccgggctcgatggctcacacctgtagtcccagcactttgggaggccaagacgggtggatcacgaggtcaggagttcaagaccagcctggcctagatggtgaaaccctgtctctactaaaactacaaatattagctgggcatggtggcatgcacctgtaatctcagctactcagaagtctgatgcaggagaattgctaaaacccaggagggagaggttgcagtgagccgagattgcaccactgcactctagcccgggcgacagagcaagactccgtctcgaaagaaagaaagaaaggaaattccccaggcaagtacctcggctgatttcataaa

SEQ ID NO: 589429 - DNA, 351 bp, Homo sapiens
tgtgttgggacgcctcatccctgcacccaggggccctggcattgtttccgcccctgtgcctaaaaaactgctcatgatgggtgggatcgatgactgctacccctcagcccgggggtgccctgcccccctgggcaactttgccaaggcccccttttatgccctttttaagacctacagctacctggcccccgacctttggaaggaggctgtattcccccagtctccctatccggggttccctggccccctcgtccagaccccccccagagtttccgtgcagcgggctcagggtcccgctgtgggtaccacatagggttttttttccagaaaaataaagtgaatttagggtga

SEQ ID NO: 589430 - DNA, 143 bp, Homo sapiens
tgtgttatgtcggggctgtcgagctagtcgggactgtcgggctagtcggggatgtgggctacgtcgggcgtgtcgtggctagtcgggactgtcggctcgtcggtggctgtctgggctagtcggggctgtcgggctagtcgggg

SEQ ID NO: 589431 - DNA, 402 bp, Homo sapiens
cccgtgccttctttggcagcagtgacaaatccttgtcatatcgagatggcttttcctcctcctcttcaaacatcttttagcagcaacagcagctcaaggaactggaattatttcaaagttaaaatgcaggctttgtagaccctcttagacagacagattcaatttcaaaggaaactttctttggctgggtactcagtgagtggtacacagggatttggggaagtaaatattcaactgttcctggttgtggagaaaaggaaaagcagaagtgcttttttttattacctctccccaacgcacaatttgtttcctttcgtttcttggaatttgggaagatggaggaaacttaagtgggggacccacctagcctcctgatggatgctgggctcactttaaacctcc

SEQ ID NO: 589432 - DNA, 629 bp, Homo sapiens
  misc_feature (274)..(274): n is a, c, g, or t
tgtctctgtgtctgcatctgcgtttgtgtgtgtgcaactctctgtggtgtgtgcttgcatatgtgtgagggtatgtgtgtttctgtgcgtctgtgtgggtatatgtgtgtatgtctgtgtgtctgcgtctgtgtgcctgttggggtatctctgtgtgtccatgcgtgtgcccatctgtgcagtgagcaccttgaaataggccgcccaggaggcagagggtgcaccttgaaattgggctaggaggcggagcctgcgccttgaaataggccgcccnggaggcggggttgcaccttgaaataggctgcctgggaggcagagctcgcaccttgatatacgccgcccaggaggcagggcttgccccttgaaataggccgcctgggaggtggggttgcaccttgaaacaggccgcctgggaggcggagcttgcaccttgtaataggccgcccgggaggcggggcttgcaccttgaaataggcctagaaggtggggcttccaccttgaaataggccgcccaggaggcggagtttgcaccttgaaatagactgcccaggaggcggaggttgcagtgagccgagatcacgccactgcactccagcctgggcgacagtgagactctgtctcaaaaaaaa

SEQ ID NO: 589433 - DNA, 245 bp, Homo sapiens
  misc_feature (38)..(38): n is a, c, g, or t
  misc_feature (224)..(224): n is a, c, g, or t
cttctggttactctgaggatcccgtctaccctcggtgntgcagtgctgggatcggcgtgagccaccatgcccgcccctattttttaaatttgttgtagagacaaggtcttgctatgttgcccgggctggtcttgaactcctgtgtctctgtgtaaaactcccaaatgtgctggtgattctagtgcgtgagcctgccttgcccggcacttgcaccaatttctctngcatgcgtctccactcccacg

SEQ ID NO: 589434 - DNA, 256 bp, Homo sapiens
tgtctctgtgtctgcatctgcgtttgtgtgtgtgcaactctctgtggtgtgtgcttgcatatgtgtgagggtatgtgtgtttctgtgcgtctgtgtgggtatatgtgtgtatgtctgtgtgtctgcgtctgtgtgcctgttggggtatctctgtgtgtccatgcgtgtgcccatctgtgcatgtctgcatccgtgtgtgtgtgcctgtcgctgtatctgtatgtccatgtgtgtctgtgtgtgtccatctgtgcat

SEQ ID NO: 589435 - DNA, 412 bp, Homo sapiens
gaaaaaaaaaaaaagaaaaagaaaaaaagaaaaaaagaaaaaagaaaagaaaaaaaagaaaaaaaaaaaaaaagaaaagagaaaaagaaaaaaaaaaaaaaaaaaaaaaaaagaaagaaaaaaaaaagaaaaagagaaaaaagaaaaaaaaaaaagaaaaaaaaagagaaagaaaaaaaaaaaagaaaaaaaaaaaaaaaaaagaaaaagaaaaagagaaaagaaaaaaaagaaagaagaaaaagaaaaaaaaaagaaaaaaaaaagaaaagaaaaaagaaaaaaaagaaaaaagagaaaaaagaaaaataacaaaataacaaggctctaacacactggggaactaactctctatctactactactatatctactaacactactatataaatatatctctctatatactata

SEQ ID NO: 589436 - DNA, 345 bp, Homo sapiens
cacgagggtgaccaggactcctcgtcggtgagtgaccccgagggacccattgctgcacaaagtgctgtccttcgtcagggatgaccccgactttgagagcgagggatcaggacacacagctgagggcggatgactttcccgtgctagatgacccctccgatgtgactgacgaggatgaaggccctgccgagccgcccctagcccccaagatcactcgccccgccttcatactgaataatgactcggacctcttcgggctggagctggaggaggccggacccatagacagcactgaggaacgtaacgagggaaaaaccccctctaaggacaatacgaatactaccc

SEQ ID NO: 589437 - DNA, 797 bp, Homo sapiens
  misc_feature (32)..(32): n is a, c, g, or t
  misc_feature (71)..(71): n is a, c, g, or t
  misc_feature (80)..(80): n is a, c, g, or t
  misc_feature (144)..(144): n is a, c, g, or t
  misc_feature (165)..(165): n is a, c, g, or t
  misc_feature (173)..(173): n is a, c, g, or t
  misc_feature (204)..(204): n is a, c, g, or t
  misc_feature (214)..(214): n is a, c, g, or t
  misc_feature (260)..(260): n is a, c, g, or t
  misc_feature (283)..(283): n is a, c, g, or t
  misc_feature (288)..(289): n is a, c, g, or t
  misc_feature (310)..(310): n is a, c, g, or t
  misc_feature (315)..(315): n is a, c, g, or t
  misc_feature (367)..(367): n is a, c, g, or t
  misc_feature (370)..(370): n is a, c, g, or t
  misc_feature (385)..(385): n is a, c, g, or t
  misc_feature (398)..(398): n is a, c, g, or t
  misc_feature (418)..(418): n is a, c, g, or t
  misc_feature (442)..(442): n is a, c, g, or t
  misc_feature (460)..(460): n is a, c, g, or t
  misc_feature (464)..(464): n is a, c, g, or t
  misc_feature (482)..(482): n is a, c, g, or t
  misc_feature (488)..(488): n is a, c, g, or t
  misc_feature (494)..(494): n is a, c, g, or t
  misc_feature (506)..(507): n is a, c, g, or t
  misc_feature (549)..(549): n is a, c, g, or t
  misc_feature (776)..(776): n is a, c, g, or t
gtagtttggtaccgtcgtggggcatggttggnttcttctcggggtttagctggacggctggctgtgcggtnatattttcnaaaacctgtttgttttatacaaaagaatataccctaacacggtagggtctcataatgccttggngggccccaatttggtgctttnggattttnatgttttgttaacaaattttcaaactcgggngggtttaggnatgtcttcatattgggttccttcaactctgcgtccttttaaggggncggtttcaatggcggtagtggcnggganngtcttctcattggtgggttcnggggngccttcatttcctctgtggcctccatttaggactggggttctttttcctggngcngggattactgtctcngaatgggtctggncaggtttcggcttgtctccnggatcaatcatcttcacaacagcngtgtatttgtcaattacntccntaacaatagcctttttcntatggnatttcnctcccggtttcnngggtatgattttcacaataatttcaggcggggccagtggtcnggtcgggcagttcttttcttttcctcttcaatctccatgatttcatccagtgcagatttctttttcttcttttctttagactgagttgagctctgggaagattcttttcgtttcactgatgctgaactttcctatcgtcttcagtgcactcggtcccagagtacttgacttggaagatgttgctccggatgagctacatgctcctttactcaaattaaacgtgactntctcttcatcattttctctgc

SEQ ID NO: 589438 - DNA, 619 bp, Homo sapiens
tacgtaagaaactataatttcagagggcctcatagatggttcggctgataccacactaccattcaatttttagatagctaacttagtctcaagatctattttccctctctcaaggttgacatcatacgtgagtctaacgcgttatctagtagctactgtccagtcacatcattaacaccctcacagagcttgatgtcttccaagctctagggcacacgtcacaaatctgtttcatctcatagaagcaagcatccaatctcgtgtcaagcggtgccctctaagggtcatggtaagtcatgacaggccttgcagggtcagcattacttcttccagttaatcaaacagtaatggcgtgacagattgtgttcaacccagcaaagtcctcagcgacaccaaatgaagtggatgccatgtgtaccataatatctggcccatctgtcgaatcaccaatacacttgataacacctacgcgccaaacaaatcgtgcctatcaaacaggctgtcttgtgccgccaggatctatctggtaaagacatttcgcctgcatgtgacatggctagcacacccctccctttggttctcgcataacaggtaactctgtgtcacctgttttcagtta

SEQ ID NO: 589439 - DNA, 666 bp, Homo sapiens
agcggaggcggggcttcccgcgtccccaagctccagatcctggggtggctgccacgtctccctgccacgcgcctggggggacgggaagacgggacggagatgttagtggtgggcgccccccgagggttcaccactgtttcctgagaaacttccccagtgcctcatcgcacgcgtactccgtgtgcccgagggccggtcctgggctaggctccagtgcctcagcccgagaacgggtccccagcgccttccagagagacagctcccggacgcggaatgccagggcagcaggcccaggcggcgggctgcgacggagaagctgagaaaggagaagacacgaggggacggggcgagcgaggagctggcggaagcagggccacagcaggatagcggccgaggcccaaaagggcaacgagacagggacggagggtgggaaggccaaaatagcgcgcttcggacaactggaacagaggccgggaggttctaaccagggaaacggtccttgcaattagcacagttgccccctaggagaggcaagggggccaggggacacagaagcgccaggcggtggcaggacgggaggacaggaaagtccagacaacgcaaacacccgggcgcacatgcttggagaggcgacagcgaagagctcggacatctgggatactgccc

SEQ ID NO: 589440 - DNA, 88 bp, Homo sapiens
ggatttgctggtgcagtacaactaggcttaatagggacatgtcaattcaagcttctaacgttagaagcttgaattcgagcagtagtag

SEQ ID NO: 589441 - DNA, 213 bp, Homo sapiens
cactgcaggcagttgttggcagcttcaggttggaattctcaggagaaacattatgaattcacataatatgtacactttggggctctcaaatctagttatatgagttttttaacttttccaataccttgcgttgaacaacccacggaaataaggctgcgaaaaaatactactaccctatcctcaacataaagtggaattaaggatgaattcccg

SEQ ID NO: 589442 - DNA, 251 bp, Homo sapiens
gtacccagttgcggtacagacaggatagtttcactggcctgaaaatcatctgtgctccacgtgttcatcccctctgtctcccccagatcctgggaaaccactgtcttcttcatgtctccatagtcttgcctatgccagaatatcatagttggaatcacacagtatgcagccttttgggattggcttgtttcacagtgcagtatgcatttaaggcccctccatgtctttctgtggcgcaactggtacggcgg

SEQ ID NO: 589443 - DNA, 81 bp, Homo sapiens
tctcaacgtcagactccttggcagctgtatctggagtctggatgtgctctctaaagaccttaataaaatttgtacaaagac

SEQ ID NO: 589444 - DNA, 446 bp, Homo sapiens
  misc_feature (8)..(8): n is a, c, g, or t
  misc_feature (14)..(14): n is a, c, g, or t
  misc_feature (65)..(65): n is a, c, g, or t
  misc_feature (117)..(117): n is a, c, g, or t
  misc_feature (124)..(125): n is a, c, g, or t
  misc_feature (335)..(335): n is a, c, g, or t
aatatttngctggncgccgtgctcatgcctgtaatcctaacaactttggaggattgctggagacnaggagtttaagaccagtctgggcaacatggcaagaccctgtctctacaaaanaggcaannattagctgggcgtggtgcttgtgcctgtagtgccagctatctgggaggctgaggcgggaggatcacttgagttcaagctgacagtaagctatgattgcaccgctgcactccagcctgggtaacaaactaagaccccatctctctgtctcaaaaaaagtgatacttcgcaaagatgcttagactccaagaagcttttgcatctctttccancccaaccactgaggtactgtgtagcctcctccttgaataactaacctggtgagctgagattgcgccattgcaatccagcctgggcaacaagagcaaaactccatcacattt

SEQ ID NO: 589445 - DNA, 664 bp, Homo sapiens
aggatctggcacagaggattaaatgtgagacatatgttccttaaggagatgccaggctgactatacaagagtgcacgtagaacaaatatgactgttatgctgtaaggctgtctaaatcgatgaatgactcgtgcaccgataataacaccctaatcagagtgatgggtactacagcaggacttgacatgttgactatcctggcacacttgaagagactctatggatagtctctgtactcgatcatcatgggcgacacatctggagactacaagcaagtactgttaggactctgtggcggagctgatgaaagtacctatcccacaaggacaggaggatgctcaacactttgaactgtactccattcatttttatacactgctattagcattatctcagaatgctgatttacaagtcaaacgcctacagctgcctactagaatatagactggatgccttattattcacctataagtagtcattatgatgctatcaagctggactcgcgtttcaaagcttatactatctaaatggcgatttaaagctgaaatggatacgtattccatgttattaagagactacttactactatgcgtttcacagacattgaacctgataaattattgcatcattgcgtcttcatgacttttataacctgtgctggtct

SEQ ID NO: 589446 - DNA, 751 bp, Homo sapiens
tccgggggggggtttccccggggttgggtttggttttttccaaatccgaaaaaatctccttgggcccctgggggttccccccccccccgggcccttttcccccaaccccctggcctttcttctccccaacgagcaaattccttacttcgaggggaaccactatctttttaaaaacgatattagggtggtcgaagcttctcatacataccctcgtgacagaaactataagagcacgtgcttgcacattgtgctcgtggggggatgggagcttccttttacttcgtggacccccggtgtcccctccacaccaccctcgtaaacgcagggcattttatctcacgaggacgctctccaaatattaaaacccccttttccatgtgtggggcttcctccccagcttctccttctcccctctttgtacccatcctcccacatatttcggccccccgttgtcgttatgaagggatctggtccgggagctgcttcccacacaaggggggggaagaacccccgggtgtaaagaggtgggggcgccccgggggcgccccagtggtggcgccccgtggaatggcgcgacaccgggggggcgacctccgccgcgaaggatctatcggcgagaggagcgcacctcgcggcgccggtgggcttcccgcagcaccggcgaacacgtgggccgcgggccaccaaaggtccacggaagcaacccctcaggagaagcgacgagcccccgagagactacggggcggccggt

SEQ ID NO: 589447 - DNA, 861 bp, Homo sapiens
ggccgtcgctatcaccaggcgcagcggtcctggagctgtgaggagattcgggccgtaccaccctgcctcccctgcgtccctgacaccggacgtttctgtcctcgggagccattccaacaatctcgtaaaacagtggtggagttactatgaaggttctaggcgtgcagagacgatgcctcagccgaggatattcaatgaggcatatcggaaactggcgactgaagatggcgatccgaggattaagaaatcctggagatattaacgaagaatgcggagagaaaacttcaaagtcaagctaggcggaggcatactgaatggtgctgtcggatgctaaggaaaacgggagatctatgactaaattatgtgcgaaagaacggattactattgtgtggacggaggcaggtttgaaaatggtcagtgtaagaacaagtctatgaggcgaactgttggcgcttacacactcccagtaaaacacccagtagtggactgatctatcaatggagcaaagtatcagggtgaaggagacacgcggcacccgatactctcacagaatcatgcagctttctatagtaacgtaacccataaaacgcacagcaccttgtcttatacagtgtagacatccagatataggggatgagccctacggaaagagaaaagacagaggaaaaagcacacgaatagggagacaagaaggagagaatcagagatagagatatacgattcaattggatagatagagagagtggagaagtacaagaccaggaaaagtagaatctagagaaacagattgggaataatgggagttacagtagtagggaggtaacaaggggaattaataacatgtcaatatatgagaggact

SEQ ID NO: 589448 - DNA, 1070 bp, Homo sapiens
ctggtggcgcttcctgggactcgagcataatatggatcctggtgtgatccgcctctcgagcaactcagagctccaaggcgaggttcgcggcctggggcggatgctctgatcgagcgaggacggagtgcggcgcagtcgtgctccccgcgtatagatggagagtctttggcgtgtacagtacgattgccttctttagaagataaccgcttcgcaagaaaaagcgtgaatccaggagctgcaggttcagcattcaggaacaggatgtctggatggtcggcatgtggagtagcttttcccatagcactgtaggcatctagggcgtggcctgccggtgacgtacgttgactagtatgaggagtgtggctgacaaggagcctgcctgcaggaggtaagaatggtaccatacactcctgacgttagcatgactcttctctgagcggctgaccacgcaggtacacgatgacggccctgaggactcccggcaggaagccacgtgtacgtgccactgagtaccgaggagaatccggagttgcagacgctctctaccatgatagaagtggcatgcccttctaggaacctcatgtgttcccgtgtgaaccgccattatggcgtgaactggcgccagaactatgactgtttggcgagctggtcaggaactaagaacactcatgggtggatatgccggggattgagagttcaagatatgaatgaggcaatggcctcgatgactaggggagtaccgcagacccgaaggatgcgataggtaaagacaggaaagaaggtgctgttggtggttagaagcccgaccgaaagcctccggttgggaaaaaggcaagcaaggtaccaggaaaccaagcccatgaaaggaggctgcagaaaaaaacttctagggaggagaagaagctgtgcataatcttagtgggtgtcccctagggtattatatgaccgctctctgctacaaccggttactggacgagaactcttatattagcgacacacacttgtgggtcattggacacgcaccgcatatccggaccaaccttgtgtgtcggccctggggtgaggggtta

SEQ ID NO: 589449 - DNA, 136 bp, Homo sapiens
  misc_feature (38)..(38): n is a, c, g, or t
  misc_feature (106)..(106): n is a, c, g, or t
  misc_feature (126)..(126): n is a, c, g, or t
catccggcgactagcaccgggcccggaagcgccagccntacactcgccgcgcatggcctctgctccgagctcgctgcatctactcggcctcattctgcacgacgangaggggcaggcacggagganaagaacaatg

SEQ ID NO: 589450 - DNA, 244 bp, Homo sapiens
ttttttttcgagaaaaccattaccttcaggtcattgggcaatgcgacagaagtttctgcaaaccgcatcgggttttacctgcatgcgtccattccggcaaaaggtgttcatctggaccgggcacttcaaggcgaatttgtgtatcaacccaacctcgggggcagcatgtgctgacaggcgagggcatgcacgaactggcgggactggacagcatggtgattgctccctgatgcatgagagcaag

SEQ ID NO: 589451 - DNA, 196 bp, Homo sapiens
ccgagctattcgacggtgtctggattctaggcctgttagatgtaaacagaaagagtcaatgatggtgagaaagtaggtttctctcaagctggcttcctagctcatttatatatcaatatatatattttaattttattcttagctgggcatggtggcgtgcacctgtactgtagtcccagctactcaggaggctgag

SEQ ID NO: 589452 - DNA, 333 bp, Homo sapiens
  misc_feature (149)..(149): n is a, c, g, or t
  misc_feature (277)..(277): n is a, c, g, or t
ccagctactcaggaggctgaggcaggagaatcgtttgaacccaggaggtagaggttgcagtgagctgagatcacgccacttcacttcagcctgagcgacagagcgagactgtctcaaaaaaaaaaaagtgcacatgcttgtaatatttntcatataacatcatggaggtgctgtgtctgctgagcacattggtggagccctggttcagaacccaaagcttcccacttacaaagtgctgtggccagctgagaggagacaccacaggcctccagccctncccccaacagcttccctaaccagttgctacctcttatattttagacccaggggcct

SEQ ID NO: 589453 - DNA, 235 bp, Homo sapiens
ccacgaggtccaaccactgtatctatttcaaaatcaccgatgcggttacgttggtcaacgttacgccgttggaggccatgtttcaggtagttcactcaaagcgaatcaaagtttccctgatataaccaattgtagatagatctagtggctagtttaagctcatgcgcaatcacttccggtgaccagcttagacgtaaatggtttagaatggcttgctttaattttgcattcagtc

SEQ ID NO: 589454 - DNA, 163 bp, Homo sapiens
tagctgcctgctccgaaatatgctggacatagctgctgaatctgggattgttcattaggttcgaagcatgctcatgaagccaggttgttcagcaggccggcgatgtcgaagctgcccacgcctcccgtggggctgggggcctccagcagctcgccccttagtt

SEQ ID NO: 589455 - DNA, 154 bp, Homo sapiens
taggcgttagagtgaaactccgtttaaaaaaaaaaaaagatttatgaaacaattctgggttgggtcaaagaaggcaatgaaacggtccggtgaaatggttattgggatgagaagggagcggggggagcaatcatggtgggtaccggagcctcga

SEQ ID NO: 589456 - DNA, 793 bp, Homo sapiens
acatgagtcctcgactttttgcctgatctctgcactggactctgatctcactgtcgacgcgcccatcgttcacctatgtgcttgattgagtactctgctcggtggcgtcggtcgttccgagcaaacgagtgtcctggcatctggtgctcatggctcgggcatatctgctgtaagccagatctgactgtctcgctcgctcggggctcccgttctaatacacccctttctcatgtgcagctagcgctagacccgcccgctcaatgcgccaggtacgatagcggtgccttgttctcgcatattaggcataggagggtaccatcttggccggccttaccgtcgtacaacggtcgttctttagcttccttacgttgctaaacgccgactgcctgaacctccacacttgctgcccccgtaccatagtgcaaaggcccatggacggataaacgtcaagtgggtccacgaaaattccgccttgttgcctaaaccacggctcacacatgcaacacatagtgcttaaacgacggccggccaataattatcgggcacaaaactccgcgccacaactacggacgcacaccaacaccttacaggttaaatacacagatccttccctcaccgctcccccctccttcccccccgcggcaccgccgcccgctgccttgatctaaccccccctccctcccacgcacctgcccctcctccctcgacccctcctcccttcccccccccccccgcgccccccactccctcgcccctccccgcccttctcctgcgcgccccgttaccgccccgc

SEQ ID NO: 589457 - DNA, 631 bp, Homo sapiens
tctaccaggtgtctccagacaattcaacacctagcagagtgctgctcggggctgacagcataaatcaatgacatctttcagcccagagggttctgagagtgattgcattatgacagcacttcctgaggcgcccctggctcctgaggaatgagctgttcagggcatctggcaagcaggcaccagtccatgctagcacccttccttctggagagtcacccaagggagccaccgatcgctgctagaactggagcagagtcctcaaacaacagtctgcacacagacaagacccgggatatttctttgatccagctcctgccttacaggacttcatcttcacccattcctgaggaaggagagaggaaaaaaagacctctcatacaccccctcagtctagtgttaactgagcacacactgtgatctgggtaagagagaaactctgccatcttggtgctttcagacaatacacatcaaattacattatcaacgatgctggatggcgctaagagccggggagggaaagcaagggagtacaggccacagaccgtcctggacttcgagtttgacttacattttggctttgccatggtacaaacgccatacacattcagtatactcctccgcttacagattg

SEQ ID NO: 589458 - DNA, 686 bp, Homo sapiens
  misc_feature (17)..(17): n is a, c, g, or t
  misc_feature (65)..(65): n is a, c, g, or t
  misc_feature (69)..(69): n is a, c, g, or t
  misc_feature (72)..(73): n is a, c, g, or t
  misc_feature (76)..(77): n is a, c, g, or t
  misc_feature (90)..(90): n is a, c, g, or t
  misc_feature (97)..(97): n is a, c, g, or t
  misc_feature (109)..(109): n is a, c, g, or t
  misc_feature (111)..(111): n is a, c, g, or t
  misc_feature (118)..(118): n is a, c, g, or t
  misc_feature (121)..(121): n is a, c, g, or t
  misc_feature (126)..(126): n is a, c, g, or t
  misc_feature (133)..(134): n is a, c, g, or t
  misc_feature (137)..(137): n is a, c, g, or t
  misc_feature (143)..(143): n is a, c, g, or t
  misc_feature (149)..(149): n is a, c, g, or t
  misc_feature (153)..(154): n is a, c, g, or t
  misc_feature (186)..(186): n is a, c, g, or t
  misc_feature (188)..(188): n is a, c, g, or t
  misc_feature (193)..(193): n is a, c, g, or t
  misc_feature (196)..(196): n is a, c, g, or t
  misc_feature (200)..(200): n is a, c, g, or t
  misc_feature (210)..(210): n is a, c, g, or t
  misc_feature (219)..(219): n is a, c, g, or t
  misc_feature (222)..(223): n is a, c, g, or t
  misc_feature (227)..(228): n is a, c, g, or t
  misc_feature (230)..(230): n is a, c, g, or t
  misc_feature (239)..(240): n is a, c, g, or t
  misc_feature (247)..(247): n is a, c, g, or t
  misc_feature (251)..(251): n is a, c, g, or t
  misc_feature (255)..(256): n is a, c, g, or t
  misc_feature (260)..(260): n is a, c, g, or t
  misc_feature (264)..(264): n is a, c, g, or t
  misc_feature (273)..(273): n is a, c, g, or t
  misc_feature (277)..(277): n is a, c, g, or t
  misc_feature (280)..(280): n is a, c, g, or t
  misc_feature (296)..(296): n is a, c, g, or t
  misc_feature (303)..(303): n is a, c, g, or t
  misc_feature (318)..(318): n is a, c, g, or t
  misc_feature (324)..(324): n is a, c, g, or t
  misc_feature (336)..(336): n is a, c, g, or t
  misc_feature (343)..(343): n is a, c, g, or t
  misc_feature (354)..(355): n is a, c, g, or t
  misc_feature (365)..(365): n is a, c, g, or t
  misc_feature (371)..(371): n is a, c, g, or t
  misc_feature (373)..(373): n is a, c, g, or t
  misc_feature (381)..(381): n is a, c, g, or t
  misc_feature (414)..(414): n is a, c, g, or t
  misc_feature (416)..(417): n is a, c, g, or t
  misc_feature (445)..(445): n is a, c, g, or t
  misc_feature (449)..(449): n is a, c, g, or t
  misc_feature (456)..(456): n is a, c, g, or t
  misc_feature (464)..(464): n is a, c, g, or t
  misc_feature (486)..(486): n is a, c, g, or t
  misc_feature (501)..(501): n is a, c, g, or t
  misc_feature (568)..(568): n is a, c, g, or t
  misc_feature (662)..(662): n is a, c, g, or t
aaaattaaaaaaggagnagggattattgtgaaatttaaaggaaataaatgattaagttaaataanagtnggnnggnngatttggtttgangggtganggggggttttantngggagtnttnttttntgttgannggnattganttttgntttnntgtttgagatattggggggtggggattttggnanggggnttntganaggtggttangggtttagnttnntggnngntttgttatnngggtttngggngggnngtgntggnaggggggtnagtnggnagggttgtgttagggngttgggntggttgggggaggtnttgggntgtttgggggtngtaaatnttattttaggnnttgggaggtngtggtngngaggtaanggagagaattgtttttattttattgtgatagtntnnggagaggagataattaaaaggttggatntggnagatatntgggaagntggggaaatgaggttgttcatnaacttttaagagctnaaacttggctgtgtaatttcagacctagcttatggttggggacacctgaactggccccagggttgcntctctctcaacacaaggtgcatactgaacccttctgcagtgtagtacacgttgctgccgcaagtgcaaaggccacgagggaaagaccttttaancagagcaaggggaatctgaaatgc

SEQ ID NO: 589459 - DNA, 2372 bp, Homo sapiens
gtcagcatagttctgcaccaagaagcttggaaaagacttctttggtctgtgcagcttaaaggacaacatgcattttaaatcaagtatgtaactacttgttaataatcttggtaaatttttatactttccaaaactaaaatactaactcagagaaaaatcaaatgtttaatttttctctgagttagtattttagtttttttactttcgaaatgaagatgaatgtgtttggaataagaaatatgttttctggagctatttcaaagttctcttggataatagaaaacaacaacaacaacaaagtgggattttattcgcttattttaccctgcaaatttttactgaacagtgtgccatacttttttcctaggctacaaacctgtacagcatgtgattctactgaatatacgggcaattgttaacacaatggtaggtatttgtgtatctaaacatacctaaacatcgaaaagtagagtagaggcccagtgtggtggcttatgcctggaatgccagcactgcgggaggccaaagtgagagaatggcttgaaaccaggtgtttgagaccaggctgggcaagatggcaagaccctatctctataaattttttaaaaaaatattagccaggtgcggtggcttgggcctttatttctagctactcgggaggctgaggcaggaggatcacttgagcccaggggcccatgattgcacactgcattccagcctgaatgacagcctgcagcttacttttttttttaataacagtctgtttcaaagagcagaagtttttaattttgatgaagtccagttaatcaattgcttcttttatgattttttcttttttcggtggcaaatttctgttttattttgtctggaaataggtatagctctcattcctaaaaatattctcactgaggatataaatctggttgacagttatcatgttctttcagcatattatgccattgccttccaactctcagtgctgctgttgagaaatcagatgacacgctaaatgtctaaaaatgatcagcagaatttttcttttgtgtcttaagatttatttgccaaggtctcaataattttcttctgtattttcttctagaggttttatagttgtaggtcttatatttaggtgatctgtttcaagttaattttatatagtgtaaatttcacttttttcatataaattttatttttggcatatggatgaacaattgttctggtataatttgttgaaatggctatcttttgcccattaaatggcaccattgtcaaaaaataactgaccatgtatgtgtaggtctatttctggaatctctattcagatccattgagctagaaagtctcttcttttaccaataccttccttgatttctgtgcttttctgtaagtcttgaaattaggtacaacaagttctctgattttttttttcttcaaaactgttttcggtgttttaagttctttgctttgttgtataaactttaggatcaactcataaattttaaccccaaaaaaaagcccttctaagaattttatttgtattatgtgagtctatggatcttttgcgggagcactgatgtattaacaaccttggggctttccactcagggacaccatacatcctctacatttattggatttctttcatttttatcaccaatgtttcacagctttcatcatacaaatcttccacatcttttgttagactcatccctaagtttttgctgctctttcaaacagtaatattttaaaatttcaatgaccaattgttcattgctcacataaatacaatcaattttgtatatacagttattatttttaatctgacaatttatcccatactttgctagattctctgtagtttattaccacctttctaaatattctgtctaggtaacccagagagtcaaaagtaagaattattcatttggtcaactgattagattatttctgtgctcttggattctgttaatttcacactctataggctggatgttctgccatcatcaatttgcattccaagattttgtgtgtgtatgtctcaaaaatatgttaaggcagttttaacaattctttagaaactcagggcctggcgcagtggctcacacctgtaatcccagcactttgggaggctaaggtgggaggatctcttgggccaaggagtatgaaaccagcctgggcaacatgacaaaccctgtctctacaaaaggtataaaggttggccaggcatggtggtgtgcacttttggtcccagctattcaggaggctgaggtgggaggaccattggagcccggagggttgaagctgcagtgagctgtgatcatgccactgcactccagcctgggcaacagagtaaaaccctgtctcaaataaag

SEQ ID NO: 589460 - DNA, 157 bp, Homo sapiens
cggaggcgcccgcggctgcagtagctgctgagtcgggatctcttcgagctgtctgtgtccggtgcacgccggcgcgcaatgtgagccagaggatcagcgcagtcctttcggcgcgggccgggagggccccatgcaggtcggcaagcatgagctcccc

SEQ ID NO: 589461 - DNA, 874 bp, Homo sapiens
  misc_feature (196)..(196): n is a, c, g, or t
gtcccccatctcctaaaagatactccatctcctcggcataaaaaaaagtgattcttcaggtcaggagtacagtgtgtgaaaatcaccaaaatgaatagtggtccgtacatttagatgaaagtaaattatactgaatttcagtacattagttttaacactaaaatttacaagataaaatggactccatttagtatcnttttaaaccagaaataactggggaattaatggggataacaataattaatatctcttgggactttgtggaaattttttaaatttaacaagtacatttacgcagatcatttataaagcaggagtccatttaaacacttaccgactttttggggtggaaacatattaccaggtctaaataggatggtgcccatataggtgagcatccctttagcatcatgggaaccagcagatgatcctaatcttcataatgcctgagactgtgtcttaccaatgtaacctttaagtgaatcacataatgtgtcttggaacttgtctcccaacacttatggtgatggcaacgggttaccagatattggatgaggtgctatgtttgtgacacacatattatgtattcaacaacccttatggatatgaataccagataccatatggagtacggtctcaggacgattcaattaagccggggcaatacgatcccaacatgggattaaatctaagaggttagcaaataatggcaaattccttgacctcacgtgggcaatgttggttggacacggggcgaacacaaatcagggcgttgggccccagacggacatgcacgctgtcagcccctctttcggccaaacagcaataaaaaggctgcgggccaagagggagaaacttagaacacatgtgcgag

SEQ ID NO: 589462 - DNA, 1404 bp, Homo sapiens
gctagagtttcccaaaaaaggttagaataacttcctctcccggagacctcggttttgcacaagccggccttgaaatcagagcctttccagcaactccgagagcgtgtgctcggcgaccgcgggcttggcagcggcgcgcgctcgggccccggcgcccccagccccacgcgcgccgggcgggcgccatggaggagggctccagctcgcccgtgtcccccgtggacagcctgggcaccagcgaggaggagctcgagaggcagcccaagcgcttcggccggaagcggcgctacagcaagaagtcgagcgaagatggcagcccgaccccgggcaagcgcggcaagaagggcagccccagcgcgcagtccttcgaggagctgcagagccagcgcatcctggccaacgtgcgcgagcgccagcgcacccagtcgctcaacgaggccttcgcggcgctgcgcaagatcatccccacgctgccctctgacaagctgagcaagatccagacgctcaagctggccgccaggtacatagacttcctctaccaggtcctgcagagcgacgagatggacaataagatgaccagctgcagctacgtggcccacgagcgcctcagctacgccttctccgtgtggcgcatggagggcgcgtggtccatgtccgcctcccactagcgccgcgccacccacctccggaccggcgcgccagggctgtccgtcgcgtcggcggcgcaagtggaattgggatgcattcgagtctgtaacttctgaaacctgaacaacctcaggaggcccccacctctgccctccaccagcgtcgagagaagggacagcagtgacatcggacagaagacccgggctcccgtcctcccccaggacggtccccacataggaagggcactcccagccctcttgctggtgacattgtcatggtcatcttgtttctgtttggatttttcttctgggtcttatgtttggggggaggtttattctttctgaaaatgtctagattcaggaacacatttatgaggatttggattttgaatttgtatttccctctaagtgccttttttaatgtctatttttttaataaaacagaaatgcattcttgtacaattctgttgaaactggaccaaggctctcagaagaggacccccgagttccttcccctcccccgagcctctgcatgattgtttcaagtcagcctggaattcttactttcacgccgctattcttttcctttctccgtgattgcttggctagccattttaaaaaaaatattctctgttcagtgtatatgttgcttgtttgttttatttattgagatatttttacaagctaagtgactgcagtgtggctgtgtatcctgctccccacccaggaaaaataaagacgtccgcgcagcaaaaaa

SEQ ID NO: 589463 - DNA, 965 bp, Homo sapiens
gctagagtttcccaaaaaaggttagaataacttcctctcccggagacctcggttttgcacaagccggccttgaaatcagagcctttccagcaactccgagagcgtgtgctcggcgaccgcgggcttggcagcggcgcgcgctcgggccccggcgcccccagccccacgcgcgccgggcgggcgccatggaggagggctccagctcgcccgtgtcccccgtggacagcctgggcaccagcgaggaggagctcgagaggcagcccaagcgcttcggccggaagcggcgctacagcaagaagtcgagcgaagatggcagcccgaccccgggcaagcgcggcaagaagggcagccccagcgcgcagtccttcgaggagctgcagagccagcgcatcctggccaacgtgcgcgagcgccagcgcacccagtcgctcaacgaggccttcgcggcgctgcgcaagatcatccccacgctgccctctgacaagctgagcaagatccagacgctcaagctggccgccaggtacatagacttcctctaccaggtcctgcagagcgacgagatggacaataagatgaccagctgcagctacgtggcccacgagcgcctcagctacgccttctccgtgtggcgcatggagggcgcgtggtccatgtccgcctcccactagcgccgcgccacccacctccggaccggcgcgccagggactacctccagtgtcccctccttggggagcctctaaccaccctgctggcatttgtggtgactcctgaggcctcgtatatcccctagcggcctggcagctgcgacggtttgtctgcctgtcaccccgggagcaccttcaggactgtgtccttgtcatgtatccggatgcccggctcagcccatgccctgcacaagtgggggtcatggagggagcctctgtttccccaccaagtacaccaagaaactacactgtgtctgatgc

SEQ ID NO: 589464 - DNA, 570 bp, Homo sapiens
  misc_feature (132)..(132): n is a, c, g, or t
cttgcctcagcctccctactatctggaatgacaggcgcccaccactatgcctgactaaattttgtattttttttttcccatattgcttcagggcttgataagcttctttttttttttttttttttttttttngagacggagcgtcactcttgcgctggctgcagggcaatggcactttcatgcgcgtccttgttaagagaccaccaaacaggctttgcgtgagcaatacggctgtttatttcacctgggtgcaggcgggctgagtccgacaagagagtcagtgaagggagataggggtggggccattttataggatttgggaaggtaatggaaaattacagtcaaagggggttgttctctggtgggcagggggggatctcacaaagtacattttcaagggtggggagaaatacaaagaacccttttaagggggggggaaagtttgtatgagtttccacaaacttattcgaggttgtttagatatcagttaatcctgcttatattacgattcgcgcactcctttcttcgttgtagcttcgtattcctctaactatataactaagtttctag

SEQ ID NO: 589465 - DNA, 435 bp, Homo sapiens
tatgcttgttggtcgtctctgcacggatccccggagacacttacggaagacacacattatctataggagcctggatggccacaagtgataggatctataaagataataccatgcatgactttaattaatagaaaacagtttatagtttatatcacacgaatagagacctacaacaaaaagcattactagagactacaaggaatatttcttaacaagaaaaggtctaattactaggaagacagatcaattctaaacattttatacttcgcctaaaaatgctcaaaacaaaaactacagaacaaggatcaacagactaatccacaatagtgggaaattctaacatgactctcagtatctgaaatacccagacgatatcattaatcagtatgaccctcttgtcatatactaaatgctactactaacaaatacaaatta

SEQ ID NO: 589466 - DNA, 760 bp, Homo sapiens
aatccgccgttgacagctcccgccagcggctgacccatttctctgcgttctcctcgctggaacccagccctctgctgcccgaaaccccacagctccctcgggcctgcacggggccaacgtgccgagcctctcttgtccccaggcagcctgttctgaggggctcacccacagccagaccgcattcatggctgcgctgagcacgggccagggggaggccccggggtggctgtccgtcgcgtcggcggcgcaagtggaattgggatgcattcgagtctgtaacttctgaaacctgaacaacctcaggaggcccccacctctgccctccaccagcgtcgagagaagggacagcagtgacatcggacagaagacccgggctcccgtcctcccccaggacggtccccacataggaagggcactcccagccctcttgctggtgacattgtcatgaaatgcattcttgtacaattctgttgaaactggaccaaggctctcagaagaggacccccgagttccttcccctcccccgagcctctgcatgattgtttcaagtcagcctggaattcttactttcacgccgctattcttttcctttctccgtgattgcttggctagccattttaaaaaaaatattctctgttcagtgtatatgttgcttgtttgttttatttattgagatatttttacaagctaagtgactgcagtgtggctgtgtatcctgctccccacccaggaaaaataaagacgtccgcgcagcaaaaaa

SEQ ID NO: 589467 - DNA, 246 bp, Homo sapiens
aacctacctactctacctactcctgcatcgcatctagctatagaagaagcgccggagaaggaacaggttgaacagtctaccctcccttagcagggaactactcccaccctggagacctccgtagacctaaacatacttactccttacaacctagcaggtgtctaccatctatcttaggggccatcaatatcatcacaaacaaataatacaatataaaaaaccactgacaaaaaccaaataacacaa

SEQ ID NO: 589468 - DNA, 221 bp, Homo sapiens
tggcctccatcctgaactctgatgaggaggagtcttgagcatgtatgagattgaggaggtacacatgaagtcccccagtttaatggggttgggccatccctctttcctcctccccgtgtacttgtggatcggaaacgttggtttggctggcgagcagaaattgttctctgtcgcagatttcgtccacaagtaacacaaagatcacctggcgcaaaaaaaaa

SEQ ID NO: 589469 - DNA, 753 bp, Homo sapiens
ggagatgaggtagggagatgggccggaaggaggaaaaaaaaataaactttaggctgtccgtcgcgtcggcggcgcaagtggaattgggatgcattcgagtctgtaacttctgaaacctgaacaacctcaggaggcccccacctctgccctccaccagcgtcgagagaagggacagcagtgacatcggacagaagacccgggctcccgtcctcccccaggacggtccccacataggaagggcactcccagccctcttgctggtgacattgtcatggtcatcttgtttctgtttggatttttcttctgggtcttatgtttggggggaggtttattctttctgaaaatgtctagattcaggaacacatttatgaggatttggattttgaatttgtatttccctctaagtgccttttttaatgtctatttttttaataaaacagaaatgcattcttgtacaattctgttgaaactggaccaaggctctcagaagaggacccccgagttccttcccctcccccgagcctctgcatgattgtttcaagtcagcctggaattcttactttcacgccgctattcttttcctttctccgtgattgcttggctagccattttaaaaaaaatattctctgttcagtgtatatgttgcttgtttgttttatttattgagatatttttacaagctaagtgactgcagtgtggctgtgtatcctgctccccacccaggaaaaataaagacgtccgcgcagcaaaaaa

SEQ ID NO: 589470 - DNA, 299 bp, Homo sapiens
ccccccccccgggccttttccccgggaagttttgtttttttaaaattaaaccctttttggggccccggggctggtgccggttgggttaggggccgctccgtcctagagggttttttaaaatttgggttgggggccctttttctcccccagccagggcccctcaacccgggctttttttggccccccccctttggggtgtttggctccccccaaggggggccagctttgggccccctttttggggtttttttttgccggtgggccctgggggccgcccctttaagcctttggctctttta

SEQ ID NO: 589471 - DNA, 605 bp, Homo sapiens
  misc_feature (217)..(217): n is a, c, g, or t
  misc_feature (303)..(303): n is a, c, g, or t
ttcaagtgtctacacagctaaatcatgcttccctcatacgctgcccaagccatcagttagcacaaagtgtccctatggtgaaaggtaccttcatgttaatgcaggaacagtggaacatctgtcacatgctgccaccacctgccaaaggttgctgtgcacagctagcagtccaccgtccagactcgacagcgcagtacactggaagacacaggccccntttccctccaagcagcaagtagctgatgaagatgaaatatggaagcaaagacgaagacaacaatcagaaatttctgcagcagtagnacgtgctcgtaaacggcgtgaagaggaagagcgaagaatggaagaacaaaggaaggcagcttgtgcggagaaactgaaacgatttgatgagaacttgccatcctgaaaaacacccatctccagaggaaatttggggaagggggccagaaaaagaaccggggccttgggaaggactttgaaaaagaccaggaccagggccgggggagggggggggaaaaaaccaaggggaaccaccaggaaaaggagaaagagttggagagggagcaggaaaaacaaagagaaatggagaaagaaagaaagca

SEQ ID NO: 589472 - DNA, 721 bp, Homo sapiens
  misc_feature (689)..(689): n is a, c, g, or t
agagagagagagagagagagagagagagagagagagagagagagagagagagaggcctaggcatgtggacgcagccatggctggccgcatctacatctcaagcttggctcctctcccctccttgcccaagacacaactgtctacgcatcgcatccgcaacggctaccgttcacaacgaggccactatcgtggccgcatccatatctcccgccggtcattcctcgccatgtggctgtccttgttctccactgaggatagcaacttgggatccaacatctatcatgacttcaggatggactggcttgcgcctgccacctgtgaacccatccagagtgccttcttcttctctggagacaagttctaccgactcaatcttcgcacacggccagtggacactgtggaccctacctatccacgctccattcctcagtactgtcttgcctgcccatctactggtcatttgaggagtcatagccctcatggccgggccctctgttactcccttctctcatctccttttcctaccccaatcgtcccttagccccgcgtttttcctgaccctgatctctctatctacgtccgtcttatttctgagtcttgcatcttttcttccatattcacgctctccttcgtgctagtgtattgctgctccagcgtttggcgtggggcccctgttcctcatctcgtcntctttttgtcatttctctgcacctttctggcg

SEQ ID NO: 589473 - DNA, 912 bp, Homo sapiens
ttataatcagatatctttatgacaataagttcacaaaggtcagaagagatgagtttgctaaacccagcggtgatacctaagttggaaagggaattgaaagtgtatgcttatgtagattcagaaaaggtatagttattttattcatgagcttttaatgcattttcgtgtttgaccctcgtatgtgatgtcagctacaataaggtgggtctagatttattacaaggagtagaagattcactcgctttgcaactgtaatcttcctcactgactttacatggacaggtatgaaatattagtgtatgggatcttcagtaacgcctttgtatttcctagatgatgtgaaatataggtatataactccatttaaaccaggtgatacgagtgatgtgaactgaccatcagggagggtattaacgtctgtctacaattagctcgtgtggaagtgtaaagtgccggtgacggaatagtcttccactttcaggattctagagtaagtctacctgggacagagggggttcacaacatggtggtgcttgaccatgtgatgtctttgtctacttagaagatgcatcctgtgttgtggacacgataacattttgatgcttgactggaatatgaatgcttcatggtgtcgtctactggcaaatagcattttttggagaactcaggcaccggtcaccagggttcattaaccaattttgtcaataagcaaaccaggtaatggtgggtcccgggagctgggattggcaaagatttgtaagtggcggttgaaccattatgtaaaagaggtgtaatggggtgtcggtgtgaccagaaatcgagacatgagtgaaaacaactgtgcgtcgtgatgtgacacgaagggtgttaccagtgccccagtggtgaagaatcttagaaaaagaatgtcat

SEQ ID NO: 589474 - DNA, 148 bp, Homo sapiens
aatccctgttctcttctacaaatacaataacggacatcatccgggcgtggtggcgagtgcctttaatcccagctattcgggaggttgaggcagaagaatcgcttgaacccatgaggcggaatttgcattgatcatgccattgcagttc

SEQ ID NO: 589475 - DNA, 345 bp, Homo sapiens
  misc_feature (189)..(189): n is a, c, g, or t
  misc_feature (192)..(192): n is a, c, g, or t
cccatgccactggggaatgccagctgtgagccagccaggcttccggttccctgcctgtgagcttgcatttccagcccttctctcagcacctttacccctcgtctctctctctctttctacacacacacacacacacacacacacacacacacacacatcttggttttttcttcatccatttcagaaatnttnacactcttggggggagaggggaggaatagcattaggagatatacctaattctaaatgatgagttaatggtgtagcacaccaacatggcacatgtatacatatgtaacaaaccacatgtaccctaaaacttaaagtataataataataaaattt

SEQ ID NO: 589476 - DNA, 333 bp, Homo sapiens
tcgatacgactttttttttttgagacagagttttgcttttgttgcccaggctggagtgcagtggcgcaatcttggctcaccgcaacctccacttcccaggttcaagcaattctgcctcagcctcccgagtagctgggattacaggcatgcgccaccacgcctggctaattttgtatttttagtagagacggggtttctccatgttggtcaggctggtctcgaactcccaacgtcaggtgatcctcccgcctcagtctcccaaagtgctgggattacaggtgtgagccaccatgcctggtctagggaattgacttctttttgaccttctgcact

SEQ ID NO: 589477 - DNA, 873 bp, Homo sapiens
  misc_feature (13)..(13): n is a, c, g, or t
  misc_feature (86)..(86): n is a, c, g, or t
  misc_feature (104)..(104): n is a, c, g, or t
  misc_feature (113)..(113): n is a, c, g, or t
  misc_feature (119)..(119): n is a, c, g, or t
  misc_feature (141)..(141): n is a, c, g, or t
  misc_feature (145)..(145): n is a, c, g, or t
  misc_feature (149)..(149): n is a, c, g, or t
  misc_feature (151)..(152): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (167)..(167): n is a, c, g, or t
  misc_feature (179)..(179): n is a, c, g, or t
  misc_feature (187)..(187): n is a, c, g, or t
  misc_feature (217)..(217): n is a, c, g, or t
  misc_feature (219)..(220): n is a, c, g, or t
  misc_feature (224)..(224): n is a, c, g, or t
  misc_feature (236)..(236): n is a, c, g, or t
  misc_feature (249)..(249): n is a, c, g, or t
  misc_feature (270)..(270): n is a, c, g, or t
  misc_feature (290)..(290): n is a, c, g, or t
  misc_feature (302)..(302): n is a, c, g, or t
  misc_feature (372)..(372): n is a, c, g, or t
  misc_feature (379)..(379): n is a, c, g, or t
  misc_feature (392)..(392): n is a, c, g, or t
  misc_feature (406)..(406): n is a, c, g, or t
  misc_feature (449)..(449): n is a, c, g, or t
  misc_feature (455)..(455): n is a, c, g, or t
  misc_feature (469)..(469): n is a, c, g, or t
  misc_feature (541)..(541): n is a, c, g, or t
  misc_feature (569)..(569): n is a, c, g, or t
  misc_feature (656)..(656): n is a, c, g, or t
  misc_feature (712)..(712): n is a, c, g, or t
  misc_feature (730)..(730): n is a, c, g, or t
  misc_feature (741)..(741): n is a, c, g, or t
  misc_feature (758)..(758): n is a, c, g, or t
  misc_feature (778)..(778): n is a, c, g, or t
  misc_feature (860)..(860): n is a, c, g, or t
ttgaggcctgcantgtgactgggtgttctgttaaaagggcaggttcctccctcctagccctgtatgccccaggtacctgccttganagataagctctctaatantcaacttgnagggtntcgccctaacatccaagatttngtancatntnntttnatnccnaaatncagatggttctnaactaatnctaaacgaaaactcaaaaaaagcacaccanannccanctgttgtttgtnagggatctcatantccagaggaaatgcatttgcntgttatggttttcctctctnagggcacctgtntgaacttggggctgatgcttccactggtgcctcataggggcctgggcctactctccacctgaattcacanttttctntataaggtatcangtggggaataagtncaagatggtgacaagaggctcccgaagcaacagagctatgctnatatcntggcaaggcatctnccacaatgctccagagggctggcgaggccgggacagcattaggacagagaaagggcagaggggtgcttgtgnagtgctcatcactcaggggagctggcangcccgggatgacaggcagcctgaacagtgctggaacaaagacagccaccctgcgccccttgtcgagcagctgctggtgatgggaagnagcacgtcggcaccacctccttcgttgcaggaaatgttttgtatcgggccaatganttcagttttccttgcctngagatgccttnatgaaggaaggggacanggaatacaggtgggcatgcngcagttggcatctctggggctgccaaatcttgagttcacttggggccaaggcactccacaatcccattccccttcatgccancgaagaagaagaa

SEQ ID NO: 589478 - DNA, 241 bp, Homo sapiens
ctaatgatatctagaggcattgctttcacatacctaagtgtatattaatcatttattagtatagcgtaaatacgtgagtttatctatataaatatctataaaatgtaggaataaaaaaggtatatccaaaatctatgttacatgagtaaaaatgtactctttagatcttggatataccttattattaaagaattaatatattatactatttatattttatctaacattttatctatactat

SEQ ID NO: 589479 - DNA, 176 bp, Homo sapiens
agagtgtactgcggccttgcttttgctcggggagctgttggaggccgtgccctgcatttggcagggctgtagggcatcattggcaatatcttagatgagtgtctgggctgctcaggagatgagccgaataatgcgggggtctgaggcctcgaagccagcacggttcaggtagtaac

SEQ ID NO: 589480 - DNA, 245 bp, Homo sapiens
ctgatgtgcgatcttgacattgatggctgctgactgcttagggtggtggttgctgaaggttgggtgacagtggtaattacagtgattttgttttgttttgtttctttaagagacagggtctcattctgtcactcagggtggagtgcagtggtacgatcatagttcactgcagccttgacttcccgggctcaagcaatccttctgcctcagtctttccagtagctaggaatatcaagaatcggcac

SEQ ID NO: 589481 - DNA, 149 bp, Homo sapiens
tatatgagactccacaactaacatcatcatcagtggggaaagctgcaactttttctgtaatactggtcaaggaaagaaacttacttctctactttcaacatagtactggaagtcctagtcaacaattaaataaggaaaaagaaaggcaa

SEQ ID NO: 589482 - DNA, 211 bp, Homo sapiens
  misc_feature (40)..(40): n is a, c, g, or t
  misc_feature (45)..(45): n is a, c, g, or t
  misc_feature (109)..(109): n is a, c, g, or t
  misc_feature (115)..(115): n is a, c, g, or t
  misc_feature (132)..(132): n is a, c, g, or t
  misc_feature (136)..(136): n is a, c, g, or t
tggactggatagggatgcaccagtgactgtcacatcaagncagtnccttttattctctctcctttagtatgcgattttaaagggtcattaggtcactatggttcccagnagtttncttggggtaaaacttgncagnattccttattaattggttcctgtcaatacttaaataaattattttacaattataagttttccgcattaaaaaaaa

SEQ ID NO: 589483 - DNA, 130 bp, Homo sapiens
gaactgagacttctgagaggaaaaactattgaatgcattagcctcattggtctggctgttgggaagaaaaatttgtcccctactatgatttatttatgccatcactgagcacatcgttgagaatgcggtc

SEQ ID NO: 589484 - DNA, 225 bp, Homo sapiens
  misc_feature (9)..(9): n is a, c, g, or t
agaggtgcnatgcctctcgggtgacttggaaactcctggacaaattccattctaacgttatttgtgacatgtatccaaaccaactgttgtagagattccacttgtgcatagccctactgtgttcccatgttcctgtggaaaagagaagtttacttcgcaatacttataaattaatgaatattcttcattgaggtgactgcaaatgcttctttccccagcagatcg

SEQ ID NO: 589485 - DNA, 304 bp, Homo sapiens
atgccccgaaaatcaaagaagccagtccaaagcccttcttcctgtgtgcatgagcttcgttacgaaggttgaaaatgagtatgcccttgtgctctatagtgggagtgactgggagcaggcaggagggtcctctttctgtccttgttacttcacaggactcagggcaggtgcaggtgctttggcggtgagcggaaccaaggctctatggcttggcccctccagtggggccatagttaagatgcaaaggagctacagtcaggcagcacttgggtagaactacagcgtctgtcacttaaccagtgtg

SEQ ID NO: 589486 - DNA, 811 bp, Homo sapiens
gcaatccctgtacgcaccgtcgtgatgcccaggaagacagggcgacctggaaagtccaactacttccttaaaatcatccaactattggatgattatccgaaagtgtttcattgtgtggagcatgacaatgtgggctaccagagcagatgcaatcagatccgctatgtcccttcgcgggaaggctgtggtgctgatgggcaagaacaccatgatgcgcaaggcctatccgagggctacctggaacagatcaacccagtctctggagaaatctgctgacctcatatccgggggaagtgtgggctttgtgttcaccaatggaggacctcactgagatcagggacatgttgctggccaataaggtgccagctgctgcccgtgctggtgccattgccgccatgtgaagtcacttgtgccagcccagaacactgggtctcgggcccgagaaggacctcctttttccaggctttagagtatcaccactaataatctccaggggcaccattgaaatcctgagtgatgtgcagctgatcaatgcactggtagacacaacgtgggagccagccgaaggccacgcgtgctgaagcatgtctcaagatctgccccttctcgcttgtgggcgtggtcatccagcagtgtgttcgacaatggcagcatatacaagcctgaagtgcttgatatcacagaggaaatgtctgcattctcgcttcctggaggtgtccgcgatgttgccagtgtctgtctgcagattggtaccgactgttgcatcagtaaccccattctgtcatcacgggtacaaacgagttctggcctg

SEQ ID NO: 589487 - DNA, 195 bp, Homo sapiens
aatttttttaatgaaaaccctttttaaaaagaaaaaaaaagagggggcaaagggccctttattggggggttcaaataaaaagccgggggtcatgccgggattcccccccctttggggggccaagggggggggttcccttgggccccggggtttgggatcagcctgggcaacataggggggcccggtttttcccca

SEQ ID NO: 589488 - DNA, 871 bp, Homo sapiens
ggcaggcattgtgcccaacaccatcacttacggttactagaacaaggcagtgctggaaagcaaatggccatctggtactccgggtggacgcctacgctgggccaagctccggaatgttgtcctgggggctgctcagttccgccagcccttaaaggaccgaaggcagcaacagcagcagcagcagcagcagcagcagcagaagcaacaggtggccgagcagcaaaagtcgggcagctctcagacagagccctatctggagcgtccctccccaacgcgccctcttcagcgccagactacttgggctgggcgaagtctacgggaaccatcttcacccatggggcgcctggtcaagagtggtagcctaggcagtgcccgtgggacacagcccacggtggaggctggtgtggctcacatgatagaggccttgggggtcctggaaccccgcggatcacctgtgccttggcaggacggaagcctctcagacctgagtctgacaggggaagaaatgggacctggaggcagcctgggggctcaggctccgacctgagtgcacagtccatgaagcctagaagggataaggtgggcggggtccaaaatagtggatgtcaggaggaggtgggcactccccaaaaaaagggctgggtggccagcatccaacaagattggtccaaccctaccggcgagacgatgatccggaatcgccacatgagtgccgtgacgagacgcagcggacggagaagacgaggaagctagtggcagagaggaccgaacgaggacagaaaacgataagggaagagggaacaaaaacaaaagacaaggagcaacaagggacaccggagaaagataagaaaagaaggaaagagcggaaggg

SEQ ID NO: 589489 - DNA, 122 bp, Homo sapiens
tttggcgtgtggcagtttaaagttattagttttaaaaatcagtactttttaatgtggaaacaacttgaccaaaaatttgtgctcacagaattttggagacccatttaaaaaagtttaaatgt

SEQ ID NO: 589490 - DNA, 576 bp, Homo sapiens
ctttggtcttgtctggctgtattagaatgagaggtacatccctggagaggtccatactaaatgagcagcagagtcatgttacatacccctggctgcttcacaagcaaaggatttaccctgggcaaggaagggaagggagagtcttcttccagactcccaacgcagaatgagggactgccctgactggcagtgggtgacagaggggtcagcagaaagtctgaaagggaaccagagacctgattatattcgtcacgttccaaggggtgtccttaacaagagagatgagtgagccctgagtcaggtctggaaaattacaaatcatcccctcaaaaaaaaaaagcaaactttgatccaattttcaactcttccatgttcttaaaaagccaacaatatcaccagtgaaatcagcgaaccggtacaggaagagggaagagcttcatcgttacagtaactctagaagtcagggtagaatctactccaacggtaagaaaagtctttgcttttgaaatgctatacttccacaaaggctggcttcaaggataggtactgccaggaactggttacagggtgaatagt

SEQ ID NO: 589491 - DNA, 198 bp, Homo sapiens
agatcgaccggtccgtatatggtgagcacgcgccggccactacagaacattttaaaaactagctgcgcctggtggcgcgtgcctgtggtcccagctacttgggaggttgaggcgagagtatcactcaagtgagcccaggaggtcgaggctgcagtgagctgagatggtaccagtgcactccagcctcgacctcctggg

SEQ ID NO: 589492 - DNA, 369 bp, Homo sapiens
ctgtcaccagtagtaattcaccatatgcaagtaccatccttatcatgcgagaatactcacgggttctgtaaaagtgccaagtgtacttaagatattgaaaattatggctcacttaagtatgatcattgtgtgattcctttaaatagcaaaaatgcccagtcctctttaggcctataatcaataatagtttccattactcataccatattcattgtacatacgcagatagttccttaaaaatagaactctctcattaatatctaattggacagaaagcagtataaggtaaaagtgagtgctttgtaagtgaaaaagtacatatctgaggcctttctcgtcacattttcgtatgtcaaagagcaaaaaccc

SEQ ID NO: 589493 - DNA, 712 bp, Homo sapiens
  misc_feature (320)..(320): n is a, c, g, or t
  misc_feature (367)..(367): n is a, c, g, or t
ccatggccacggaggacccccagagctgccacggccttggactccctgtgatggctgggtggggctacggctccgacaagaggctgagtgaaggcctggggtgctgccccctccccccagtgggtggccgtgactggggatgagcacaaccagctgtgctagaggagcaccaggcacgcgcctggcagggtgccatgtgacgcatggcgcggctagccggtgagcactgccagtgtggcaatggtgtgcgagagtgggcctgtcttgtggccctcgtgtgtgcctggggcacattggcaatgcctgctgtgttggatgtnggctgtggtgctgatgtgctgtgcttttgggcacaatgtgttgtggnacatttcccaatgtgtgccactgtttgggttgcccatgtgttgtgctgtggacttgtgaaggtggtgtgctgtgatgttggccatgccattgaccggtggcagcaagagtcccctcacccacaccctcatccccccccgtacccccacttcaccctgccgctactaagtcccactcgctgcgagttttcgggttgggcagacgcactgttgaatctggtagccagggttccctcgaacttggggggatctttttaaaagcaaagtaaatcctgccaccatgttgtagctcaatacaatgtgaactcactttttttttctttaaataagttgtgtcttgttcttgc

SEQ ID NO: 589494 - DNA, 102 bp, Homo sapiens
tcagacgatcccatatcgcttagtgctccccgggaaacggcttggtcctgatgcggagatgggggtaggcgatgaactcgggtctctcgtgctctccgtggt

SEQ ID NO: 589495 - DNA, 331 bp, Homo sapiens
gcatatcaaataacaaaagagatgctgttgacaaaccaagaggatttgccagaggtcttgatcctgaaagaataattggtgccacagacagcagtggagaattgatgtttctcatgaaatggaaagatctagatgaggcacactctgtgctggcgaaagaggcaaatatgaagtgtcctcaaactgtaattgctttttctgaagagagacaaacttggccttcttgctccagaggatgaagttcaatatctgttcacattgttctttcatctatttttatatatttataaaaaaactgggcctcacatgatgatttactaggtgtgacaaa

SEQ ID NO: 589496 - DNA, 178 bp, Homo sapiens
ggcgctagcggcattaatgacgtgtgcagaggtgtaatcatgatatgagtaaggacatcattgcttttgggattattacttaacagagtagacaattattctatctaaaaatcccctaaatattgtagcattgaacccttgaccagcactgatgcgcttcacttaatgtcgctagcgc

SEQ ID NO: 589497 - DNA, 490 bp, Homo sapiens
  misc_feature (249)..(249): n is a, c, g, or t
  misc_feature (306)..(306): n is a, c, g, or t
acagccccagaataaagcaaaaacagaaacacttctaatagtttcaataagagactagagattgactttgggtgtgaggcttggatttcatgtccatttctagtttcatctgtgccaggattagaattatattcattggccaggcctgtgtcacgaggtcatacagggtttccactgtccacacagtgcctttgcaagtattagaaaatggctcccctttctccagttagatgcagccctgtctcaggncatggtggcttggagaagagcatgcaggctggatttcaacccccctttctcccttangctgggtttcttccttgagtgaacaacatacttgttagtagctgtcctgtgcttattcctgaaactgggggtgaaatcagccaccacgccaaaactgaaggataagaagatgggcttcatctagggtatcagataatgggctaataacaaagggaggggacagtggggtgctgtgtgggcaaaa

SEQ ID NO: 589498 - DNA, 152 bp, Homo sapiens
  misc_feature (125)..(125): n is a, c, g, or t
ttcattcccagggcactagaatgatctttagccttgcttggattgaactaggagatcttgactctgaggagagccagccctgtaaaaagcttggtcctcctgtgacgggagggatggttaaggtncaaaggctagaaacttgagtttcttca

SEQ ID NO: 589499 - DNA, 205 bp, Homo sapiens
  misc_feature (6)..(6): n is a, c, g, or t
  misc_feature (27)..(27): n is a, c, g, or t
  misc_feature (75)..(75): n is a, c, g, or t
  misc_feature (155)..(155): n is a, c, g, or t
atctcntaatccatttcttatccttcncaatttaattcatattttggggacttttagggggatcagaaataaaangcactcagctgctcggggacatttttttaagggtaatataaatttcagtgtcaaactcttctcacattaaaatttttccngtgacctctactaaaattagtgttaggggctgtaatggaggaatctgctt

SEQ ID NO: 589500 - DNA, 167 bp, Homo sapiens
atcgagctctgtacccctagttttagaagtttcaatagcaggaagggagatacacacagagaagtgggaatctcaggagacggatgtggccaggtgcttcttacgggggttgggctaagcattattagtcaacgggctgtactgctattgaaacttctaaaactagg

SEQ ID NO: 589501 - DNA, 306 bp, Homo sapiens
ggtgaaaggagctctcctctcccgcactgttccgagaagcggttgttgacattcacaaagtgtatgggtgtgatgattccaggactattattgagtgacagtgacgcttcacatttggggtatttcaagatgagcgattctactgaccaaactgactagcgactaggaggtggaccactctgatcgtactgctgagaaggcagttggatgataatgttgggagagatgaagatgctgcttgattggagctagatgatattgtttataagacctcttatgacttgcgatacctacatcagatatttg

SEQ ID NO: 589502 - DNA, 387 bp, Homo sapiens
cgtgggttccttgcagaagcagtggcatatgttttatgcagatggctctgctgttattgctaaagagactctagggtgacaaagagagaaggaagatcaacaagaaagaagaagatggggctgggaccagcacagggagtgaaaggatgaacactggtcagagtctggacatattttgaatgggcccactgaaagaaagaggaattgatattttgaatgggcccactgaaataaagaggaattggccaggagcggtggctcatgcctgtaatcccagcactttgggaggatgaggcaggtggatcacgaggtcaggagttcaagaccagcctggctaacatggtgaaaccttgtctccactctgcaagaacccacgcgggtaccgag

SEQ ID NO: 589503 - DNA, 216 bp, Homo sapiens
  misc_feature (182)..(182): n is a, c, g, or t
ggctattatatgactcattatactcaccaaatcaggtacatttaatctttgaaaagagtatattgctggctgggcgcggtggctctacgcctgtaatcccagcactttgggaggccaaggcaggcggatcatgaggtcaggagatcgagcacatcctggctcaacatggtgcaacacccctngtctctactcaaacaaaacatcacaaggggcatc

SEQ ID NO: 589504 - DNA, 110 bp, Homo sapiens
tggacagcacagaggaggtggacagcacagaggaggtggacagcacagaggaggccggagcaggaacaggttgaacagtctaccctccctgtgctcctcctctgtgctgt

SEQ ID NO: 589505 - DNA, 193 bp, Homo sapiens
tagacggactcccctgctcgctgacctatatgtatgacgagtaccatttcaccaaaccagcaccaattaccagcaagcaacacgaggcaagcccatcacgtttgctacttttgacgcatcatcctgtgatgtagacaatgtcaattgcaggctgtacaatgttgtgcacgtcactcaaccgggcacttgaatc

SEQ ID NO: 589506 - DNA, 111 bp, Homo sapiens
cacgagcgcccaagtcactaggcgctgtggaggggctgtacctcgcattatgatgctgttgtgaactctgtcttcctccggagtactttcagctggcttaaattcaggggt

SEQ ID NO: 589507 - DNA, 1475 bp, Homo sapiens
  misc_feature (282)..(282): n is a, c, g, or t
tggggttggacgcacgagggtacttaattggagggtacatgacaagggggggatccctaggcccctcccctcttacaaggggtctactgtggcaacgtggtgaggaggggagattcaggtggtgggtgggggacgtgagtgtggtggcagggatctccccagcgaggtggagggtctctctctttcctctgggtgcctctggcgtggggcgtggtgtggctccaggggttctatactccttgggagaggccagtgtgtgggtccatgtgagggtcacaccanccgcgtgtgtggcgtgtgtagcccaaatttcggtgtggtcaataccgaggaaatgtgagcttgtgacaagagtgtggctcgtgtgaagggcaagtggccgaggccccgaagggtgtcaaagagggtggaagggaaggtgggtgtgtctcgcccgtgtgtggcacagtctcagagaggagagaaacacacgcgtgggggggccccagcgtgtgtaggccccagggagagtgggccctggtgaggggggggccactttcgcgagagcgccgcgtgtgcttctacaaccaaacctctttcttaggagagtgtgtccatatcaaatatctgtgggggacagaggtgtattttctctatagaaaagcgggcacgagagtctccaagggtgtctcacaccagcgtggaaccagcgttgtggggcccacgtggtgtggggagcaccaccgtgggagaaggggggccatatgtgcgccagggtgtagaacgctttcccgcgggtgttcaagcgccctccaacggggggctgttggaacctttgtgcggccaaacgagggcactgtggtgggaaaaggcgggcccaaggataaaagaggggcacggggggaactaggaattgttcctgtggggaaagaggccccccggggggggggcccaaattaacggggcgccaaccaatgttataacccccggggaggggggcggcccaactccacaaaacaagggtgctactacttgggggagcagaggcgccaaagttagcaatgggcgacaatgcgggacaacgggggtgggcggcccaattgaggaggcgtcctcttccaccaagcagggaattaacccccacaacaataggtgttggtccacatcgcgggaatgtgagaccctttggggcgccacaagggggggttggccaacaagaccagtatgggggtggaggtcagcaccggagaagggcacgactggcgtcggaaaagcaccacaggagaggcgacctgggtcaggcaccaaacaaacttcccacagggtggttccacaacccccccagtggaccggacaccagcgtcggggggccaaccacagccaaacgggcggtcgcacgcagtatgctagcacaacccttctgtggggagtcccccccccgtcgggagaaagttgaaacccccagcaagtctaacccaagcggaggggcagagaaa

SEQ ID NO: 589508 - DNA, 276 bp, Homo sapiens
ccccaaaaccccccccagggggggtttgcccccccgattggcccggactttaaaatctaaatgggttccccggttaatgccctttcccggatttattttcccccatttcccatcctttttttttcccccccccaagcccttgggataaaaccaaccgggggttgttttttttattggaagccccccggggccttttttgtgggcctttttttttagggttccccccaccggggttttttttaaccccaaaaactttttttttgtttttggggggga

SEQ ID NO: 589509 - DNA, 108 bp, Homo sapiens
tgacagctaatcacattcccgcccactttgtccacgccagcggccacatgactgaggggaaatggcaagaaattcagctcctgaaactgggcccaactgatagggccc

SEQ ID NO: 589510 - DNA, 779 bp, Homo sapiens
tgtgttggatgcccgatgcaagcgctagccaggcgcaatgcgcgcacatgactgtatgccatcctgaggacacccccgccccccggtgcattccggtaaaccctggcggaatcgcctccggatcccctgattgggcgtagagttgttaggtacgggtcggcttgtccggcaccccgacgcattccgcgcgcccacacaccgggtaaggtaatacatctcctcgtgctattaataacgtaacgcgtggtcttcatatagcatggtcccatcgagtattgtcgcgtgcacgtgtgtagtgcgtagccctgaatgcctgaggcttggctcgcagagatccactcgagtgtccggagtcaattggattctgacaatgatatacctagtacctcgagtgttatgacttcgtctaccagtctccgtgcatttactatccacgggtagcggatagaaatgatatgtcttagccttacagagcgtgcacccgaatcttcagatacccccccccgggtgggggcaaggggtacgaatcattggggacaggcagacgatctgtgagagctttgtcattaacccctaacgggcactcccggaccctagaaaccccaggagcgtgagcggggtctgtacaccagcaaagggggccccttccaggttatcccttcacgtgtcatgcagcgcacctaccccctttgagacgcaattccagggatggatttacagtactgattgacaggaacgggaagccatgacgggaggggacgcgaagatcgaaccggtgc

SEQ ID NO: 589511 - DNA, 169 bp, Homo sapiens
ggggaaagggttttgggggggttgggggggggggccttttttttttatattttttggggggggggcccccttgggggggatttttttttttccccccccccccccggggtttttttttttttgggttcccccccccctttcttttttcgggtttcccccccccccccca

SEQ ID NO: 589512 - DNA, 251 bp, Homo sapiens
gtattctggtcactctaaggatcccaaattgaggtcgggtggtcagcagtgagttaaggcgaagtggcagtagctgaaggggcctgagcagagcttgtgctgggaggggcctcgcattgacaggaagaagaggaggagatttaaatatccaggtctgaaagccagttaatagttctccttcatctgttcctgcattgtgtgtagcatctcctgcatccgccgtagttcctcgtatttctctctcgatctgt

SEQ ID NO: 589513 - DNA, 458 bp, Homo sapiens
tagggatgaataatattccattgtgtgtaggcatatatatggaaaagggttatatccaaaacttataaagaatcatacaactcaattttaaaaatgggcaaacctgaaaagacattctccgaaacgaacacagatggccaaaggtttttaaaagggtgctcaacatcacttaatcatcacggaactgcatataaaaaccactcgaagtactacctctcaccagttaggctagctgttatcaaaaaaaacaaaagacaacaacatgttgtgacggtgtggaactaacaaggaactctgtgcacttccgtggtgggacatgtagatgggttacagcccttactggaaaatcagacatggaagtttctaacagaaaaactaaacactacccatacgactccagcaatccctcttctgggaatatcctcaaagtccatgaactcaccaccttgtacaacatc

SEQ ID NO: 589514 - DNA, 2054 bp, Homo sapiens
  misc_feature (630)..(630): n is a, c, g, or t
  misc_feature (655)..(656): n is a, c, g, or t
  misc_feature (901)..(901): n is a, c, g, or t
  misc_feature (940)..(940): n is a, c, g, or t
  misc_feature (987)..(987): n is a, c, g, or t
  misc_feature (990)..(990): n is a, c, g, or t
  misc_feature (1169)..(1169): n is a, c, g, or t
  misc_feature (1259)..(1259): n is a, c, g, or t
  misc_feature (1268)..(1268): n is a, c, g, or t
  misc_feature (1285)..(1285): n is a, c, g, or t
  misc_feature (1540)..(1540): n is a, c, g, or t
  misc_feature (1560)..(1560): n is a, c, g, or t
  misc_feature (1620)..(1620): n is a, c, g, or t
tagggtttgaggggaaatgctggaaatggtaaggggtatggaaactatttcatataagtaatgctaggggtgaggtggatagaaagttttttctcaataggaaggtgtgttattgaggtgtggctcgatagccgaaactcgggggttagtgcgtgttctcaaattctcaataagaaacgacgggaaggttataaaagaatagggctctgtgggtgcacaaaaatagtgttgtgtgtgtatcaaagatctctcacgggggaaaagatgtggcgtctcatatatgtgtgtgtgtgtctcccatagagataagaagtgtgtgatacggtgagagtagacgaggtgtgtgtctatattcctatatatatatacatgtgtgtgtgtgggtgtaatattctcgcgctcatatatgaaagaacatatagaggcgcgaagagagtggccccgattggcgggcgatataactctcgaatgtgtgtgttgaaacctcgctgagagaaaacaatagatgtctccggacaactctctctccttttgtcggacagagtgttctcaacaaacggagggtatctcagcggtgagagactctctcgctgcgccataagctgtgttgtgggaaaaacatataaacanctccacatatttgtagtgcggcccnncagaggggtggtctcccgatgacagagcggcccgcaggagaggagtttatatcacctccgagcgagaggagtggtggtgctactccatgatagtgtggtgctgatgtcgatgaccaaaacaagacgaggggccgccgacgaacacgaacaagctggtcttatcacaagacgaggaagaggcaccccccactctttcttaatcttcatcaagcacatccaccaggctggtcgctcggtaggacaancatcaacggtctttaacaaccacacaacatggatgagcnatatcgtggtgggacccaaatagacgagagggacgtgcgacggcaanccnttcatacctaatacattacatcggttgaggcaggcactaaccgctctgctgggggctccgttcgtcgcgggagcggaccgacatacacctaacggtgtgtacttcactccccagccaactaaacgagaggtggtgtgcgcgcgactcccacccagagcaaacaactccacacacgcggncggggaggcctcgggaactaacaatatcaatgtagtagcgacgaagctacttactaggagagcacagagtgggccactaatcacccaacncccgccccnctgtgtaggagtaatantacaacgacgagaaaagaggagccgaatgtagcgttggcagtacgtctactaacaagaccaagccggcgaggagctactctaaagagacgcgaaccgtcaacaaaagacagggtcaggcggtgcgggtctgctcaagaacaacaacatatcacaacatcctatcggacgaagtgcgagaaggaggggcaccgctaccatcacaggacagatcatgccgaagagcgtcagctgtatgctctgatacagcccagccncacgaggaggatgaggcagntactcggggatgaacgagatatgcaggggagagacagcgaacgcaggggacggcggactntcccaacccaagacgttgcacactacacagaacagaccggccgagtgcgtagcagacgcacaaaccctcaacctagggcagccccaggacgaccccggcataccatcaacaatccaaacggcaggggagagaggatgacaacatcatagcggggcggcggagctacaacacgagcgggcgccacctaggctgagtgagtcagaacacgaagcataattactggacggcgcgcacgccgccaccacgaggtagcatgacgcaacacccccgcagagacggcgccacacaacatcggggcgacgcaacccagacggaaaataagtactactcacacccgaaaaacagatagccgcccgcggcgagcacacatcaagaggtcccgacagcacaagcaccatcacgatgagcagacagaacggagagaaggacacaaa

SEQ ID NO: 589515 - DNA, 883 bp, Homo sapiens
  misc_feature (45)..(45): n is a, c, g, or t
  misc_feature (65)..(65): n is a, c, g, or t
  misc_feature (88)..(88): n is a, c, g, or t
  misc_feature (100)..(100): n is a, c, g, or t
  misc_feature (102)..(102): n is a, c, g, or t
  misc_feature (130)..(130): n is a, c, g, or t
  misc_feature (142)..(144): n is a, c, g, or t
  misc_feature (154)..(154): n is a, c, g, or t
  misc_feature (157)..(157): n is a, c, g, or t
  misc_feature (160)..(160): n is a, c, g, or t
  misc_feature (175)..(175): n is a, c, g, or t
  misc_feature (178)..(178): n is a, c, g, or t
  misc_feature (208)..(208): n is a, c, g, or t
  misc_feature (218)..(218): n is a, c, g, or t
  misc_feature (223)..(223): n is a, c, g, or t
  misc_feature (243)..(244): n is a, c, g, or t
  misc_feature (249)..(249): n is a, c, g, or t
  misc_feature (256)..(256): n is a, c, g, or t
  misc_feature (300)..(300): n is a, c, g, or t
  misc_feature (312)..(312): n is a, c, g, or t
  misc_feature (314)..(316): n is a, c, g, or t
  misc_feature (318)..(318): n is a, c, g, or t
  misc_feature (329)..(329): n is a, c, g, or t
  misc_feature (340)..(340): n is a, c, g, or t
  misc_feature (349)..(349): n is a, c, g, or t
  misc_feature (355)..(355): n is a, c, g, or t
  misc_feature (382)..(382): n is a, c, g, or t
  misc_feature (384)..(384): n is a, c, g, or t
  misc_feature (391)..(391): n is a, c, g, or t
  misc_feature (397)..(397): n is a, c, g, or t
  misc_feature (399)..(399): n is a, c, g, or t
  misc_feature (415)..(415): n is a, c, g, or t
  misc_feature (429)..(430): n is a, c, g, or t
  misc_feature (434)..(434): n is a, c, g, or t
  misc_feature (442)..(442): n is a, c, g, or t
  misc_feature (741)..(741): n is a, c, g, or t
  misc_feature (783)..(783): n is a, c, g, or t
  misc_feature (866)..(866): n is a, c, g, or t
aaaaatattacaggtacacattgtaaaacacatgatcaccaattnaaaacaatctaaccagacanccttaacgtctgtcagtcaaccngaacctgaaatncnccccccctgacatgctgcaggcccaaancccatccctaannncccttccccnccntcnccctcaccctctccntcnccagagtccacaccaacctcctcataatcnttctcaaggncagcnatatcttcacgggcctttgnnaaatngccttcntccatcccctcacccacgttccagttaacaaaggcacgcttggnatacatcaggtntnnntngtggtccaggngagctcaggcntcagcaatngttgtngtgttgctcagcatgcacacagctctntnttccttngtcagntntccaccaggtaccatntttggaggttggtnntttntgccaacnttgaagccagttgggcaccaatccacaaactggatgctgcgcttggttttgatggtggcaatggcagctttgacatctttgggaaccacgtcaccacggtacaacaggcagcaagccatgtttttaccatggcgagggtcacatttcaccatctggttggctggctcaaagcaagccttggtgatctctgctacagaaagctgttcatggtaggctttctcagcagagatgacaggggcatatgtggccagagggaagtggatgcgggggtagggcacaggttggtctggaattctgtnaggtcaacattcagggctccatcaaatctcagggaagcagtnatggaggacacaatctggctaataaggcggttaaggttagtgtaggttgggcgctcgatatcgaggtttctacgacagatgtnatagatggcctcattgt

SEQ ID NO: 589516 - DNA, 352 bp, Homo sapiens
cgaggatcccccctgagatcacgccaccgcactccagcctgggctgacagtaactgagactcctctcgatagagggggtggcaacgggaggggaggggagggaaggagcaagtaggagaatagtcaattatgtattcatctcacaatcagttaaatggcaccttacataaggtaaacatagagtagctacctgtggaaatacttaacctttttatctgtagctatctacttattaacaaaaggaaccgcaatttcttgcatgacacagcttttagcttaatatttttcctttggcatagtgaattggggtctcgagtttttagtttcttctcacaatactaatggagatgta

SEQ ID NO: 589517 - DNA, 318 bp, Homo sapiens
  misc_feature (79)..(79): n is a, c, g, or t
  misc_feature (100)..(100): n is a, c, g, or t
gcagtatttggttttatgttcctgcctttatttgctaccctgaaacagcatggtactggcataaaaacagacacatagnccagtgaaacaggataaagancccagaaataaagccccatcctaaggccagatcttcagcaaggttgacaataacaagcaatggagaaaggactccctgttcaataaacagtgctgggataacaggctggccatatgcagaagattgaaactcaacccctacctttcaccacatacaaaaattaactcaagatggattaaagacttaactgttagacctaaaacttataaaattcctag

SEQ ID NO: 589518 - DNA, 232 bp, Homo sapiens
cggcggctgggccgagagacaggagggcactggagctgcctagctcctgcctggttttctggatgcgtcccagaagggttaccatgggggtacggaggatgggctcgacccaccacgtgactctcttctaacgaagctcccgcgcgtggtggaacgaggggacaggctccttcacccaacccaacaactccttatatcttcgcggcttgagcaacccgtgcgttggcggaca

SEQ ID NO: 589519 - DNA, 614 bp, Homo sapiens
cggcagcgatgcgcggtcgatctgaggatccccctggctctacctgtcgttgcgatggcatgatgtatatttagaaaacgccatcgtctcagcccaaaatctccttaagctgataagcaaattaggcaaagtctcaggatacaaaatcaatgtgcaaaaatcacaagcattcttatacaccattaacagacaaacagagagccaaatcatgagtgaactcccattcacaatggcttcaaagagactaaaatacctaggaatccaacctacaagggatgtgaagtaccccttcaaggagaactacaaaccactgctcaatgaaataaagaggacacaaacaaatggaagaacattccatgctcatggataggaagtatcaatatcctgagaatggccatactgcccaaagtaatttatagattcaatgccatccccatcaagctaccaatgactttcttcacagaatgggaaaaaactactttaaagttcatatggaaccaaaaaagagcctgcatggtcaagacaatcctgagcaaaaagaacaaggctagaggcatcacgctacctgacttcaaactgtactacaaggctacagtaatcaaaacaacatagta

SEQ ID NO: 589520 - DNA, 460 bp, Homo sapiens
tgagccctggagactgtcaggtcgtacgactgcaattcttctcagattcactctcttcctcattgttcttgttctgtaaatgactaagagagaccagagaccagacctccccacttccaatcactggttttgttgtagatgaactgcctcctttgctgtccggtacctaatgtggaccagacggtgctcaagaccctatcactagtacaacctcagtgtggaatgttaaatatgccttgcctggaagaaaaagaccaacttgactaatcagatcatcataactatgcatgaagtcttccacagaaagatgatgaaattttgttacacttccctaacctttgtctaaataagcattcccaaacatctacactttggaacactgacttctgttctttgagatgggtgcttcccaggtggcccatcctcaaactttttgcttgaataaactctctaaactaga

SEQ ID NO: 589521 - DNA, 129 bp, Homo sapiens
tacgtcgacgctggatttgactcagagaggacccccagagggtgtatacatcttccctatttattttcagcccttgagggcttcatatgtagatcaaagccaaggccccaggaaggtgacatactcctg

SEQ ID NO: 589522 - DNA, 346 bp, Homo sapiens
tcccggctatcacattatcaacaaacaggtgtcagccccgtacccctgcacgatgggacccacgactgcacaagaacgctaggtgcactacctgggccacctattagcgacccatgtaccgctgcgagtccaagcctggcttacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgatagtgatgctgatgatggcg

SEQ ID NO: 589523 - DNA, 296 bp, Homo sapiens
  misc_feature (45)..(45): n is a, c, g, or t
  misc_feature (63)..(63): n is a, c, g, or t
  misc_feature (73)..(73): n is a, c, g, or t
  misc_feature (94)..(94): n is a, c, g, or t
  misc_feature (97)..(97): n is a, c, g, or t
  misc_feature (107)..(107): n is a, c, g, or t
  misc_feature (111)..(111): n is a, c, g, or t
  misc_feature (153)..(153): n is a, c, g, or t
  misc_feature (176)..(176): n is a, c, g, or t
  misc_feature (182)..(183): n is a, c, g, or t
  misc_feature (190)..(190): n is a, c, g, or t
  misc_feature (221)..(221): n is a, c, g, or t
  misc_feature (242)..(242): n is a, c, g, or t
gcaaacgtgggatgtactggtcatctggtagatgatcctcttccnatatgagagcttcacttntccagagctnatgagaaaggggtcctacaanccntgtcacccanatcnacacagcacaggatgtgaaggaggtcattgaatacgcacggntccggggtatccgtgtgcttgcngagttnnacactcntggccacactttgtcctggggaccaggtatncctggattactgactccttgntactctgggtctgagccctctggcacctttggaccagtgtatcacgtttgcggt

SEQ ID NO: 589524 - DNA, 450 bp, Homo sapiens
  misc_feature (37)..(37): n is a, c, g, or t
ggccaactttcccttgttcccgtgggcaaagggtttnggggggaccaaattggccaaccccccccttttcccttcaaggtgaagagccccttggggtttttggtggggcgccccctccccgccccccgggggcctgggattgttttcccccctttgccttaaaaactgctctttatgggtgggtttgattgatttttcccccccgcccgggggtggccttccccccttggggaattttcccaggccccccttttttcccttttttaaaccccccgctcccttccccccccccctttggaggggggtgtttttccccagtttccccttccggggttttcttgcccccctttccaaacccccccccaagtttcccttccccgggctccgggtccccctttgggttcccccttgggttttttttcccaaaaaattaaattttttttgggttga

SEQ ID NO: 589525 - DNA, 141 bp, Homo sapiens
gccggtatgcatacatgtccacagcgcatttcttccgcgccaggtcaagtaaggcaggtggtggttcatttttccaggccattttccacgggcaccatttccatcactgggcccagcacatttccatcaccagggccagca

SEQ ID NO: 589526 - DNA, 328 bp, Homo sapiens
tgtcatttgcaactcatggagattgaactggtattttcatagccattccttgcatgccttatggctgtatctctccacgagttcttgtccattccagcaaagggtgtcgtctctcgccacagtgttgtggatgcagatgtagccaggcaaagacactatagaagctgatgacagactatcaaatatactagaattagtacccttcttcggctggataaggtttcttcatgtcctacatgagcaacttttaatactttcttgtcaataaagagatcttcaggataataagcagatctatattggcgttgttgagaatgggcacattctt

SEQ ID NO: 589527 - DNA, 617 bp, Homo sapiens
cggaagaaccaggtgcgacgcacagtgtctgaggaaaagagggtcccacaaaggcccaaccatatatgggggtaaaaaaaagcaggaggaaaaccacctatttttcaaaagcagcctataagagtagctttttctctgaaaaaatatgcaattggggaccacacggcgcctgagacttggtggcgaagaaactaagatctggcgacttccctcccgtcaataagtaattaaacggccgcccccacataataaatctttggaaaaacatgtgcgggatagaagcaatggttatccactgacgcaaaaagcactcttctgtttgagaagttcagagcgagagactctctttaaaaagatcggcaaccacaaacggggtcctttcaaaagcgcgtgtcctgcgccaccactggaatatatacgggtaaaataaggagatggagatatttcaaagaggcattacagagcactcttatttatcgcataagcgcacgatcccctgacaactagtgagtgaagacggcattacacatcctggccgagatagtatcagttgtgtgacgaaatatacagataggaaaaatatttttttttaaacaacagcctcgttccacaaaaca

SEQ ID NO: 589528 - DNA, 678 bp, Homo sapiens
  misc_feature (93)..(93): n is a, c, g, or t
  misc_feature (145)..(145): n is a, c, g, or t
  misc_feature (149)..(149): n is a, c, g, or t
  misc_feature (162)..(162): n is a, c, g, or t
  misc_feature (239)..(241): n is a, c, g, or t
  misc_feature (253)..(253): n is a, c, g, or t
  misc_feature (296)..(297): n is a, c, g, or t
  misc_feature (299)..(299): n is a, c, g, or t
  misc_feature (316)..(316): n is a, c, g, or t
  misc_feature (322)..(322): n is a, c, g, or t
  misc_feature (324)..(324): n is a, c, g, or t
  misc_feature (332)..(333): n is a, c, g, or t
  misc_feature (340)..(341): n is a, c, g, or t
  misc_feature (351)..(351): n is a, c, g, or t
  misc_feature (364)..(364): n is a, c, g, or t
  misc_feature (370)..(371): n is a, c, g, or t
  misc_feature (382)..(384): n is a, c, g, or t
  misc_feature (387)..(387): n is a, c, g, or t
  misc_feature (389)..(390): n is a, c, g, or t
  misc_feature (408)..(408): n is a, c, g, or t
ggcggcagccgtgcgacaggatttggcccagctcatgaattcgagcggtctcataaagatctggctggcaagtatcgtcagatcctggaaaangccattcagttatctggagcagaacaactagaagcttgaaagctttgtggangcantggtaactgagantgtcagtctcgtgatctcgcggcagttgctgactgattttgcacacatcttcctaacttgcctgatagcacagccannngaaatctatcantatcagccttgggaaagaggatccagacctagagtcatttcanntntgaggagcaggttgctntccatnangacagcanncttggcnntctatactantgaggaaacgaangaacgnnttgggacgcannntgncnngcccaaggtgttgcgtgnggaattcctttggaagacagggacaacaagacacgctacaactggtagacttactaaacctggcacgagcttagcttgcacacgattgcctagcggctactactctggcagcgatgactgagtccatgtccagggcacgaggctttacactaagatccgaggcactctgggtgcttcagcaagtgagatcaagccaactgaagcaagttacgagatacagttactaaggtatgcgtatgctacgtgtacttgacttatagaaggaaacct

SEQ ID NO: 589529 - DNA, 362 bp, Homo sapiens
ccggtatgtctctagcccagttcattctttttactgtgtcacataaagcctaggtataacgtgccatggatacaatatcgtgccttatttcttttggtgctctagagctcagattgctgctcttctcttaggccctcttatccctaccgataataggggcaaaacttccaggcccgatcaggccaatgcttacacagtatgcctgtctatatctctggtgagcagatctttcttaactctgtgccactaaggtcaaattctaaaagcactcaaattatagctgttgctgccacgtcttcatctcttttcctctaagcaaaaaatcagaattaatgagctatacccactatcttcactgccat

SEQ ID NO: 589530 - DNA, 290 bp, Homo sapiens
attctctggtgcagtaacaaggggaaaaacaatacagaaagaggggagagtgagctatgcagatgttgattaggtgtttgatctctgaagaggacaaaaggggtcctaccggcattgggtattggttccctgcatggatgtggatgggacggtgtactctccatgtatgagctgggtacttctatagggagcgtgtgacgatggaggccatgggattgagccatgccatccatgtttcatgtccgtgcttgccctagtgagccgtgttgatgcaaatcacatagagattg

SEQ ID NO: 589531 - DNA, 273 bp, Homo sapiens
attacaggcatgaaccattgtgcccagccaagagatggaatttaaaagcaaatgcaggtatagtaggagcaaatggatgaaatagatataccattcagtaataagcctaagacactgctgtcgctatcttaatatcatatgaggtggattttaggtaagatatatagacatgaagggacctctgtagtgttagagagttattcatctcgtagacatatatcatagatatatgtctcatatagagctcaataatgagcaaattcccgcacttgg

SEQ ID NO: 589532 - DNA, 412 bp, Homo sapiens
tccccgtacttgcgctgggatattcaatactgatttaatgattatatactctgtgcatttaacaaaatttcacatgtaccccatgaatacgtataaatataacgaatcaggaaaaaaaaagaaggaaaagaaaaaaaaccttaaaggtaaagttggctaacttggagaattttttttttcttgagacggagtctcactctgttgctcaggctgtagtgcaggggcactatctcagctcacggcaacctctgcctcctcggttcaggcgattcttctgcctcagctaccaagtagcttgggctataggcccgtgccaccatgcctggttaatttttgtatttggagtagagatggggttccaccaagtttggccaggctggtctccaattcctgacctcaggtgatctgtccg

SEQ ID NO: 589533 - DNA, 387 bp, Homo sapiens
  misc_feature (30)..(30): n is a, c, g, or t
agtcgtaggcctgtgtaagactcctcgagnctgtccacataagatttgtgcactttagctgaatgtggtggcttacactggaatcctagcactttgagaggctgaggtgggcagattgctagaagccaggagttcgagaccagcctgagcaacatagtgagccccctgactctaaaaaaaaaatttttttttttaattatctgagcatgctggcatgcgcctgtggtcccagctacttaggaggccgaggtggaaagattgcttgggcccaggagattgaggctgcagtgagctatgatcacaccacttcactccagcctgggcaacggagcgagaccctatctcaaaaaaataaataaaatatttgtgcagttctctgtaaaaaaa

SEQ ID NO: 589534 - DNA, 191 bp, Homo sapiens
tctagaggatcctctgtgctaggcggagtgactggtgcatcaggctcgtacagcctcgactcctgggctcaagcaatcctcccgctcagcctcctgagtatctaggactacagttgtgcgccacatgcttggtcaattttttgatatttagtagagacaaggtctcaccatgtctcccagtcttgaactcc

SEQ ID NO: 589535 - DNA, 226 bp, Homo sapiens
atcgctagttcagctcttgcccacgggacactcatcaagtaggtgtgagttgtatgtctgtcctctacccccagaaacaagcctgttaattgttttgccttctcctctggcgactgtgtggtgagtcctttgttgcgtgatcaggttgcggatagacttgtaagggtgtttgcggcatacagtgtaagcattgtgaccgccaatgaacttgaatggtttgtactga

SEQ ID NO: 589536 - DNA, 287 bp, Homo sapiens
agattaaagagcagtcaaaattcctcagctagggaattcaaaggcaacttattagcaaatcacatcaagccttcctgggcttattccacagtattgacatagacctgtatatcttagacatcacactgttctctcgggatcgaaagtagtactgggtactgcatattgtgcagctacatctggcttgctatcttaacctttatgctgccattctttcaaatatttgtccagggcttaggggaagccattaaatgatctgacttaacactgtcgtcttgcccgccatt

SEQ ID NO: 589537 - DNA, 834 bp, Homo sapiens
ggcacaccacgagttctcctgtgaagggcccatgcttgccctagagtggacccagccctcacctcgcccgcagagctgacctgggagagcctgaaggggcatagagccaccgtaagtcaagggaaaaagggcagagcatgcaggggagatgaccatgatctgtagatggctacccggaaccgcgaccatgtaacccgatgaatccccccagctcctggaagagatgtcctaagatctcttagggacgccagacccggaaagtctcctgcatcccccattgctgacgtctaaggtggagagggcatatgcatccgtctgtcctgatctacggtgtctatgagctcgaaggggtaagaggcttgatgtagttgtcatggtgcctccagtcagactctccgtatcttgtcccatatttgcaaggggaggggatatggcggctggggctccagtcaccaaagctgaggtggcttctcattaaccctttaggactctgaagggtatggacctaacgtgaatgtgtgtcagggggagacttgtctggtgaggttagtggtcctcaggatgtgactagatacagtgcagtgtaataaaggaagttggaatgggagttagccgggcagtgaacgagtgtggggaaggattggatgctggggacaacaggaaggggcctcgggcgctcgtttggctgcactaactttggtagcatgcagtgtgcatacatagaccgggactggggagggagctaagcttgggctgggctgacttggggcttggcatagggtggaaagggctaacctggggctctgaccacacaaagacggggaggtgccctcg

SEQ ID NO: 589538 - DNA, 611 bp, Homo sapiens
  misc_feature (517)..(517): n is a, c, g, or t
ctgctccctcttcatcatgtgtgaaccaatacagacaaccatcccacatggacatccctctggataacaagagcttcctgagaccgcacagcatggacatgaagttcacctactgtgatgacagaatcacagaagtgattggttaccatcctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccagggaacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcancaagctaaaggaggagcccgaggagctgggccaggctggctccaacccaggagaagccatcatctctctggatttcgcgaatcagaacttccag

SEQ ID NO: 589539 - DNA, 137 bp, Homo sapiens
gtgaacccaagctctgccatttcctagttatgtgcaccttgggcaagtatttaaccactctgtgcatctattccctcatcatcaaaatggcataatattgttacttacctgatagattgttgtgagatcaaagattt

SEQ ID NO: 589540 - DNA, 492 bp, Homo sapiens
ttttactcttggcacctaagctgggccccaatcgcagaggtctaaggcttctggaaatttcgtgttccgtgtcaaggcgattttatgcactcacctcttagatgtatggggttataatcgcctgccaccaagcccggtttgttattgcttatggactgtggaacgtctcgaattgagaggttaaatcggaccggagctagacttgctttgacggggcctggccgttgctatgaataagaggtgtggttattgacagtccatatgtattagtgatggatggttgccaatatatgaataacaggattgaattgatcttgtgttggcatatggtggaatgatacaagctgacatgtgcatgagagtgcttgagaagatattgtttctaggaaatgcacattatttctgtgtggacgtgttttatttgggatgtaacacaccgggaacagtggcttgtacgtgccaccctggagagatgcaagagcccctgttgct

SEQ ID NO: 589541 - DNA, 863 bp, Homo sapiens
tgactcatttatgaactaggaataaagaagcctctattccctgaacccgagtgtaaatctttcatagtgctcagacaatacttggactcaatatccgacaattcttagacttatccatagttcttatatgtgaataagcccgttacgtcgaccactgtatcactgttgacttagactatgtttagcagtatagagccacataaatccttatagaccatggatacctggctataatgatccatgatccttctatagacagagcatctttactatgtggtcccaaaattctatatctttaattcacgttgggctagctaagaacttaatgcagcgctttaacgagcaactatggtgcagattcatcatgttcaacatccttatccgactacacatgtgtgccctgtgttgtggagacacataattgattgaaatgctaatgcagaaaaataggcacctagctcaattcaccatgtaccttgtgtaatgcgcgccacacaggtgtctgtcacatactggcggaggggtctatcactgcccttgtattagtggctttgctaaggaactttattaaggaccaaggaattgtttgggacttttgagacaaaattatactatcgattggccgtgggaggttaacaccattaagcctttgtatctcagccaagttacttgcgatccaattacgacatccccattagacacaggataggtgtattgcccttagagaatggtgacattcgttcaacccaggtcgcgaaaaaggggtatacattccattagtgagaaaacagtagagatagattgggtgtaagacacacccatggtgtaaaacgcgcaccaaagtactttgtgtgacccaaacg

SEQ ID NO: 589542 - DNA, 364 bp, Homo sapiens
ccccggtcccctggggggggccggtccaaattttttaaaccccccccccccccccccgggagggactcctggctccttgcgggcccgataacccctttcggcccgaacccccgggggttcccggccccaaatttgggcaagcttttctgggccccggcttttccagaatcccccccctaagaaaagggggtttccccaaaagaggttaccctgaccttttgaggccccccccgggccccttttgggagaaaaatttttgccttttgaaaagccccgggggtttttttggggtccttccccatttggggtaaacccgggtctttttccccctaataaaataaacccaatttttggcggcttgcca

SEQ ID NO: 589543 - DNA, 133 bp, Homo sapiens
taggtataccacatattaggctctgtatttagaaaacatctccatgctatctattaatcttctaggtgagcctgaatttaaatacatagggaatatgcatgggaatgaggctgtaggacgagcaactgctcat

SEQ ID NO: 589544 - DNA, 332 bp, Homo sapiens
  misc_feature (321)..(321): n is a, c, g, or t
  misc_feature (332)..(332): n is a, c, g, or t
gggattacaggtatgagccaccacgcccatccgagagaggaaacatttctatccttgcataaagtcgcgtgggcagcgtggctacactgctcaatgcactggatttctgggtaaagtaggggaagatcaaggaggacccaggggattttggcttgagccttggaagatgctgctcactgagggggggcagcctagagggtggggtcagttggcctcccctgcctgtgctgttggtttccaagtttccctctcccttctttgacttctgacagcttccgaagtgtgcacacagcctcttgtcagcacttgcgctctgccggngtaccgagctn

SEQ ID NO: 589545 - DNA, 253 bp, Homo sapiens
  misc_feature (171)..(171): n is a, c, g, or t
  misc_feature (187)..(187): n is a, c, g, or t
  misc_feature (222)..(222): n is a, c, g, or t
  misc_feature (228)..(228): n is a, c, g, or t
tggtaagtccatgttgtcaaatattgactatttttatattgggtgtcctacccaattaaaaaaaataagagggagaatgggcctagcagcaactcttatcatttgttattgatacaatcctaattcccaaagacaagataaaattgctgattactggctcaggaatatggntttaaaaagtggaagncattcattccttttccccaaagggaaatggcttangggatnccattaaacccccccggtgacccaa

SEQ ID NO: 589546 - DNA, 183 bp, Homo sapiens
cggatgtatgagcaccttgggaaaaagatcaggaggagtgcagctactttctagagcctcagctcacttctctccttctagctccagcctgtgagtgatgtaacgaggctagcgctggagagctgcctccctgtggaagcctaccctgcccagtcctgagtagtggacggctaccatgcatca

SEQ ID NO: 589547 - DNA, 1047 bp, Homo sapiens
cccacgcgatgcgacccagtcctgcgatctgcctagtgcagtgaggatacttggattgaagatgccatgtaatggaaagatactataggatctatccgccttttcttctatgaaactgcattcagtatggataaaggttgcgaaaatacagctataccagtggatgcgtgttatcgctgtactgtacccttaacctgtctcccctatataggaatggagtactatccttgaagatctggaatgtgaaggattgattaatcgaatagtacccactaatctatgaatcagacatcataagttcgatggtttactgcacattggtagtagaacactcgtaatgttgtcgatactcatttgataaatgatgagtgtgacccgtagttctacaacttcatgttacacaccatcgtcgtgtaattgttgctataaggggagtgatctcacgtcttctacgtgcaataccatgtcgcctcctgggttcccaactggtactctctgcatcccgaccatacctgagtaaacaagggatcaataggaaactacacacaatcacagcctaagacgtaaatttatttcaggtgaattctatacgctatgatgacctaggatgtatacaactcaatggtaggtgcgcaggtgcatgctattgcaccgtgctgtatctcttgttatccacacatgtttgaccctcaacacagtgttgccgtatcaactcgttgtagatccagtgaccctccctgccgtaaaacccagccattggatacttcatagtatcttgggcgtgtcacaaaacaatcgatgttctcgaaaagcaaagctcgtgggtcctgcacgccagaccgtctagcttgggagtatgatcattccccccggatcctattaagtaggccgataatcatgggaccgagggtcacacgtcctcctggaccattgcgccttccccatggttacaaggccacccgtgcagattaacaccctcttgtactccattggtacacgggctttcgacccacactgggaccaccatcttacgtcaacacgcccggg

SEQ ID NO: 589548 - DNA, 160 bp, Homo sapiens
tgacttgaggatccgcgtgggtaggtgggtgtgcactggtaggctgcatgtgctgggcagcaggtgcggtctcagcactccgggactcgaggctcgccctggcaggtggaggcaggttcttgacagctcctctgtcctcgtctctctgcaagtgaaccca

SEQ ID NO: 589549 - DNA, 119 bp, Homo sapiens
ttgtagcagctgaggctgaaggatgcttgagctcaggattttgagacagcctgggcgatacagcaagattccattgcaaaaaagaaaaaaagaaaaagatttttaataaggatccccag

SEQ ID NO: 589550 - DNA, 459 bp, Homo sapiens
ctgcaggtattcggcactaggagagtagtagttagagagagagagagagagagtgcgtgtatatcgacctatcttccgctcctccttctctattcctcctccccctcctccctccctcctccctcttcctcttccttccctttcttctctccccctcctcccccactctcctccctctccctctctcctctctcctccccctctttccttctcttctcccccctttccccctcctctcttctccctccctctccctcccctccctctcccccttttgctctctcctcctcccctcttctccttctcttctcctcccttcctcccttctctctcctctccctctcctccctctctctccttcccccctccccccctccccctcctctctccctcttccttcctcctcccctctccttctcccctctttctctcccctctcctcctctttcctttccttct

SEQ ID NO: 589551 - DNA, 717 bp, Homo sapiens
gaaagccacttctgctttctaaccccaggttccttaaatattgaaatcttgtacatttgtgaaattccagtatgtttgcttaaggtgttaataaaattagttgcatcatgtagtcattgagtgagggggagatataagccaaggattttaaatgacccttagctatagagaatttgctataagctagtcttgtttgtaaaaaaaaaaaaaaaaaaaagaaaaagaaaaaagtgtctttgtactggttttctggtattaagtaatgctgtaactggcatggcagtctttttttttaaatcaaatatagtggtgacgggccctgttgtagcagtgaatatagttaaaatacgtacgtttaaaaaaaaaattataaggcccttaccagttacggtcctatagctcattcctactagtttccttgcacagatttgtaatccccagtggtcccgtattggccactcaaaatggctctactatgctaaagtcctggtcaatagtcttaccctccttgaaacacttgaaccacttggatgactttagcttggaggagataccatctcccaggtggtgcttcctaagtcttggcaggcccctcttcccttcaataatctggtgctacgtatttttcaaaacaacttggtttgaaactggccttgtcctggtgtccagctcgctagctgatctcattcctcccagggtttccttaaccatttatag

SEQ ID NO: 589552 - DNA, 129 bp, Homo sapiens
aaattgaggtaggttatagtcagttatagcatactgaggagatgagtgaagtctcattcttgtcagtatgaaattatttcaaaattagttaaaaagagggtggaaagaaggcgggagagggagcaattt

SEQ ID NO: 589553 - DNA, 209 bp, Homo sapiens
accagcattgcaccatcttaatctaatcattcagaaagaacacattaacccaagttattgcatattcctattaagaaataaaagcaggataaggttatcgtgcaacaatcactttcctctctcttatccacttcattatcttatcgttaagtggatcatagagatgaaagtgattgtaccccgctaagttattgttccccgctgagtga

SEQ ID NO: 589554 - DNA, 435 bp, Homo sapiens
cacgaggtgcggaatgtgaccgatgccgtcgagtatctcgagctgggcggctggaatggcctttttgagcagggccgcgttcgtcgcgatcgggctgacccggtcttccgtgccagcgattaagagcacccgtgctcgcgccttcgcggcgacttcgtcggggctgtagccatcagtgagggtgaagcggaccgcctgccgaaacggagcggggttcacagcccgtgcgccattgcgaaccatggccagcaggtcaggcgaggtgtgcgagccgaccagcgcatcggcgcgggcgccaaagccatatccgccgctggcgatctgctgctctcgcatcgcgatgacgtcggccttctgcgcgtcggtgagcccacgcgggccggcgctcggtccgaccatcgccagcgtgacggtgcgctcgggatagtgcatcgc

SEQ ID NO: 589555 - DNA, 779 bp, Homo sapiens
ggatactgcgagtatggcggcgtcaaaggtgaagcaaggacatgcctccgtccggggggctatgggcccatcgactacaaacggaacttgccgcgtcgaggactgtcgggctacagcatgctggccatagcggattggaaccctgatctacttgggctaccatggaagcataatgaagatggaaccgtgagcgcaggcgcctacgaaatcgaggacttccgaggcgtcgctatcgcgctgtttgcctactgttacagggcagtaaaccgaccggagtgaccttgcatatgccttgcgggagaacctggtaggagtgaggccatcatcatgaaggactgtgcccgactgccaaggtgggggatgtctgtgttccagacaatccgctgggtgccccccttgatcggggagctgtacgggctgcgcaccagagaggaggctctccatgcaagtcacgggcttcatgtggtacacgtaggccctgtgccctccggtcacctggatcctcgtggcgctccgcccacctgggacggaataaagtgcttcttgcaagaccgtgttgaagaaaatgagccaaaatgcttaaatgatacaaaaaattttgtgggagacgagcgtagtgccgtagaaaagggatttcacaaaccaatgtggagaggggggccgtggtgtgtcgaaatgggtaaagtcgaagagggtaacaaaatgttgtgccacaagtgaaaatagcgggggagacaaagaaacggtgcggggatcttgttccaaaatgaaaatatacg

SEQ ID NO: 589556 - DNA, 324 bp, Homo sapiens
caaactgaacagtatcgtttgaaagctctcattattcaagctgtcactttttggcagggttggcttcccctccattttggcttgggtaactcctacttgccctcttgaggattccaactcacattagactcacctctctgaactggtctctcccgggttaccaggggatgcctcttcgttagtgctcccatacaccttcatggcttccctactcccttggtccttatcattctggtattgtcagcatcctgtctgttctcctggcgccccatattcttctcaacttggttattccctactgtgtgggatcctgggtacatctct

SEQ ID NO: 589557 - DNA, 341 bp, Homo sapiens
caccactttctttatgcacgtactttcgtgatgatttcgtcacattctgatacaaggttagatgtcaagcgacattgtagaggactgtgcatccatggatttccagattcatctatgctctcagggttagtcggcatcttactgtatacagtgtgtatctagacacaatcttgtgcttatacagttgtgagcagatctcttgtacaacgtctacatacttttggacatgcttgtgcctcatttgcctcaggtctctcagcaaagtctggtcctataaggtagaagaggaggtgtgcaaaacagtttccattgtgtgagtaatgttatcacctgtattagag

SEQ ID NO: 589558 - DNA, 628 bp, Homo sapiens
  misc_feature (249)..(249): n is a, c, g, or t
  misc_feature (515)..(515): n is a, c, g, or t
  misc_feature (518)..(518): n is a, c, g, or t
  misc_feature (579)..(579): n is a, c, g, or t
attaaatgttgggtaaaattgggtggttaaaaaaggagaatattttaacttaaaaagtgtgggagaagtaagaaataaatatgggggtttaaattttaggatatgaatgtgggaaaatgaacaaatgttaaaatgtgtttttaaaaagttaaagcagtaaataatttttattgattaagggataaattttgttaggtaagagacttttttgtaggaagaatacaataatgttttatagattttttaaanaatatagttatccaagatttaaattaagtaggattattattttctgaaggagggggtattgcagatgggtggtaaatacaacaaataagaaatctgagaatatgagaattccaatacggtgagagagaagataagttggcaacaggtgagaagaaaatattgtgggatttgaagagaaatgttaagtgtgttggctgaaatatattcaaagaagttaaattcagggaaggtgtaattattactttggactatataggtataagcantancaaatttaaggtagaaaatattgaaattagggggagattgtgtttttttataagatgacgncattatgaaggtttgtaggggagaaataataatggtcgtgattaattcc

SEQ ID NO: 589559 - DNA, 1726 bp, Homo sapiens
gggggaccaggcgccagcccaccctcctggggctgacatgagccattccctgctgatgcttcactctcctcccaaagcaaaccacagccaagcctgtctgagctgggcagctccccttccccagcccatgcgcgtcagcggacatcctcagctcgcttgttacttactcagcctgatgctcacacgctgcacgcacactccacccgatctccaccaccagacaccagctgcgccctgagccggcaccaccgctcgcccactgctgacgctcctgcctcctgctgggcgcaacacgagccacactagggctggaacgcgcaccactgctgccgcacaccgcgacacaccctttgcgcaatagccaccactctacgcacccccttcaagacactgcgcccatcggcacttactgcacacacagaacacctgacaataccacacccacttgccctgcccattgcctcccccatgactaaaactccccccaacacaaccccaccttccccccttctccaccccaactgcaaaccccaccccacttccaaccaccatcattcgactcccacgcgcaaccagcggcctgcccaccccctctctcatactaccctttacctcccacacccctcacttacacaactgccaccatcctatcaacccaccactgcccgcaccacccgcccctactcccccttcatgcgaccactctaccacctcgcgccctcacccccaacccgccacgacacacccctgcactcaccccgcctcccccctcgcaaccaccttcccttcgccctcggccaacacacgaccccaaccctcaccccaaaccccgccttcccccaaacccattccgccactccctcgccactcgcccgcaacccacacccccacaacaccggcacccacaccaacttgaacccccctcgcaccatctccaccacccacacaccaacacccatcacacacacacctcccacacaaccctctctccccgcgcccaccccacaacctgcacccacccaccaccccacccccacccacacaccccccccccccccaccacaaccccctaccccacacccccaccccaccccaccctcccccccccaccaccacccccacccccccactcaccccaacaaccacaccacgccacccccaccccaccacaaacaccaccacacacctcctcaccccacccccaccacccccacccctcccccccctccccccccaccccctccaccccccacaccaacacccaccctcacactctcccgacacacaaaccgaccacccacccaacactcacccacaccacccaacccacctcaaacaccgacaccacccacaacaaacacacaaccccacaaaaacccaacgccacccactacatccatcatttcacacaacaccactccctcccacgcccccactcacaccatctactcacaccactctacatcaacccacacacctccaatcaatctctattccaacactcatctaactccactcatcccttcaacaccagcactcaccctcaaacatcatacaccacaatccaacacatacacatcacaacgtgacacacaccaacaactcattcttaacaccacatactcctctctccacatccacaaacacaacccaccatccacccagagacaccactaacacaccacatacacatccaccatctctacactctctcaccacccccaca

SEQ ID NO: 589560 - DNA, 1052 bp, Homo sapiens
cttactggtgtgctgcatcaccctagaaacgtggctttggtgctgtgtgaaacgctgcctctgtggaagtctctcctcgctggtgggtggactgtggtctgcatgcgcgcccagctgttcttctgctgtgttctcacatgccctgcctgcctgcctgcctgcctctgtgtggaccattttgctgggtgatgtgccctcagtgtcgagctgcctgcccattgcagaatggctgtggaaagagcaagatgctgtgccccatgtgtgccctcttgagctcctgtgctccctgtgcactgtccctgccctacgtcctaccgactatgctgtgtgatgccctgtggggctgccatcgtgaggtggaaacccttctctgtgatcacatggcctggtgagacaggagtgggcctgttggctgcccatcgctgccaatggcttccataggttttacggcacaatgtttattcgaaaatctatttatagagaagaaacctgggaatgttatacagggcctccattaatatagtgccccaaagtagcttaggtgaagcgcgcacaaattggcgggccccggaccatccagagatacccgctttgacaacgcaccttgcgcaagacattacctcaggggattttaaacatgtgggaacactcaatctccggggcacccctaacaaagcgcaccaggtcggggagtgaacccatagacgacgaaaaagctaaaagagagaaaacgcgggagaccaataggaacgaggccccaaaaaaagcacagccagggagggatacactacaagagaggagccaataggcgggggacaaaacaaacggggaccccaaaaaccaatgagaggggggagcgagggaagaaaaaccgcccgagagagaaaggacacagggtggggagtccctgtggggcccgcggaagccgtggcagcacaaagaacaccgcgagggagataagagaacccgtaggggacaaaaaagcgcgaaaccccccgtggaggacacggtgacccacgaacaacagacacaagcggctaactcgcaaaaat

SEQ ID NO: 589561 - DNA, 1414 bp, Homo sapiens
  misc_feature (1115)..(1115): n is a, c, g, or t
cattgtcgttccttgtttgtccgcgcgctgttgtgtgtagtaggcacgtctgcttgtttttctccggcgcggtttttttttattgttggggagaaaataaataaggggggggatgtccccccaaccatttgttgtgcacactcacaggggcccaatatgccctctaccaactgcccccccttggggggtttttgggggggggccctcttttgtgttgtttttcccccccctctgggtttataccctcccctgtgggtagttgggtgtaacccatgtgttgttctggtggcaacgtgaccacaccgttggagtgtgtttctgtgggttgtgccccccacaggagagaggtgtgcccctctttgggtgcgcttatacaccccccgccttgtggtttttcaccggcgggaatagtgtgtttcctttgtcgcgcatgtttggttaccgcttggttcgccgccattgttcccccgcccccggcggggggaaaaagggcgttttttgtttatcctgtctcctcccttctgccgtcttagtttgttggagaaaacaatattgtttccgcccgcgcgtggcaccgtttgttttggcgaggaaaattttctttttaaggaacacaccatgtgtttttgtcgggagaccacttcctcacacacggcgggtggtttaataattctttgggggtgtacaccaccccccgtctgggggggcccacaccaggagttctcctttctcctccttctccgcgagaagataatagccttctttgttgtccccccccctcgcccgccgtatgttttgtgttgtgggaaaagagtggatcttccgcggatgtagctcccgcgcgagatcgtggggagaacaacatgggggttgtcaaccatcgttcccaccggtgtattcccccccgcctcgcgcacgtgtgtttcgccccccacctgaggcttgagatctcactcggggctctcttttgcgcacatcttttttggggtataaaattggagagagactcttccggcgagttctctctggtctcacagggtttgtccccccacactatgtcctctgtataagagaggagagcctctggtgtggctctgcccacagcccctctgggnggccccggggcacacacaggcctctggcgcctctgcaccctctgtccctccacatacccacagggctcctccctcctgtctctgggcctccaattgtgaccccctggccctcttcttaccagccccggccctgtggccctgttcaaaggccagaacccccgaccccttgactccccgggtggggaggtggcccaggatagctggagactgaatccagaccctgcaccagattcttccaggccatttctatttccaccatcgaattgaaccaccttggccccaataaagttgaaatttta

SEQ ID NO: 589562 - DNA, 1974 bp, Homo sapiens
  misc_feature (1435)..(1435): n is a, c, g, or t
  misc_feature (1831)..(1831): n is a, c, g, or t
tttaggaaaaacccatcggctcagaaccgcaagaatctagatcaacctggatactccattacaggaccatagatctgcaaggtatccgacaacgtcaatggtgtagagaacagtcagcgaaggacctacttacataacaaccaagatgtatgagtaccaaggcatgagagatcaaaatgactgacggtgaacctcccattatcacagactggcattcaaaatgagaagaagacaataccgtatggtactccaactgttacctaagcgcgaataagatgccacacgagagcactgctttcaaagcgtagcagaacataactaaaaccgcgaacatggctcccaattgtctaactactacccgaatgcgagtgcggagcaaatggacagcactatgccatgtcttccattggtgataagggcaccggcaatcaacaccattggatagatatcattgtgcgctcacctagtcgcggcgctccaaaagataatagtacttcattacgtagtatactcagtggcttaaatcgctccctactacaaaggggctacaccatagattgttgtttcttcgttgtccaaccctggacatttagcgccataggacaaaccctgtgagcacgtatccccataaattagttggataccgcaaacacggtacaccagccagctctgtggcaatttttggcgcccacagaaggttacgaaatcagcttccaaaggcctctatgtggcagcaaaccccaaaaaagtcctaagtgaaagcagagactaccattggcgtcacgcataggaacctttcaagaaaacccatgacttgcagtaacaccagagtggccctaaacggagagttataggcccacatggcagcacgacccactcggataacctttgggactaacgcaagaacagtcacagaaaggaactaagtaggaaagcccaatagtgtgcacgaacaagccaaaacacgggttcacacccatccacggcaacttgactcccttggctatagccaaaataattcagataatcgactattaaactcaattatcatttctattgcaataaacactgcgcttggactctaccgaccaacactccacggaagcgacattgtgggtgccatgagacgggatataccgccagataacatacttaacctctatccgctgtggctccgccctgtggttggcaaaccgacacctcgggacgcataagagcgcaacgactgctgttatagcacacggagcacctggaacacacactgggtgtagtatcccgttgttccgctatcatatgctgcccattgacattgacccaaggagcgtatcagcctgacacaatgcggcggcacaatcaccacagatcagccatcacacactgtgagtcggagacaccctacaagcgacacccaaaggagcaagtgtcccaccttganaagtaagcaacaccaggatggcggcgaagcaagccagcaatgcagggaggcacaacaaagcgacaaccaatgcacacggaggcaatcatcacgttgatctagaccaaccaactcgacaccgacagaaaggatggaggtcacacagcgaagagactcagacacatcagcgagtcccagcaggacgaacatcacatctcagaaacacacatggaggcagagtgcgctctcgcgagcacgacagcaacgaccacgtcactgcaaccgagactagagccgacgccagcacgccgcacagacggaccgcgacaatcgagtcccaactacgtctcgccatcagcagcagcgcacacacaccgccgatcatcgccacgccactacgactgacacacgcttcanaaatcaacggcatcgatcagcacagctcatcgacacaatcacgaccagacatctgagtgcgatatagcatcgagtcacagcacactcgatgactctcatcgtcgagtgcatcgatcatcggacagatcagatctgattggaca

SEQ ID NO: 589563 - DNA, 326 bp, Homo sapiens
  misc_feature (4)..(4): n is a, c, g, or t
  misc_feature (94)..(94): n is a, c, g, or t
ccgntaggagagtccttttttaagcaaagtgcccctgcaggccgggttttgccgccaggactgcccccttcccagagccctgtacatcccagantgggcccagggtttcccatagacagcctgggggcaagttagccctttattcccccaccagttcctgaatggggtggcctggccccttttttgcttaaaaaatgccctttatgatgccctgattccatcccaggaacccaacagagctcaggacagcccccagggaggtggtgggcggcctgtaattgatagattgattatggaattaaattggggacagcttccaaaaaaaa

SEQ ID NO: 589564 - DNA, 1256 bp, Homo sapiens
tggaaacacagtcttactctgtcgcccaggctggagttgcaggtgggtgcgactcctcagcctcacgtgcaagcctccgcctctcccgggtttcaagttgactcgttccggccacagcctccgtgagtatagctgggactacagtctcgaagcatttcagcaaacaagtggcaaggcagagccaccaggaaacgtacaccgtgattttctcattgacaaattacggataagtgcgtgtatttagcatagtgtggagccacttttcgtgtatttgttcaccatgtggacatttttgttggcaacacaagttcggaattagcaagtggacacctgttccccgtgtttggcagagtttaccccaagaggacagtggagcgaactcagctaactcactccccagcgtgggtgttacactactgtgaattgtggtcttacaaaaaccagccctccaataatttgatgtgccaaatcttacaagccacttgggtataccccccattttaaggattttgtgcgcattctatgtgacacgacacactacagcgctaccgattttgtgcaagcacccttttcatagaacacacacagacagaacaaacaactaaacacacacccacacaagacaccaacacacacgacacaacttcccgtacctcaacaaaaagaggacaggaaggagggccgggcgcagaacgtctaccctaggcggagggaaggagcgggaagagatgcgcgggctcagcacagtacggaggcaggagggaggaccacaggcgcgcagcgccaatgcaaaggaaccataacgggagtccgaggcgggggcgacgagagggacaaaataaaacatccccaccatagtctcgatctcaacactccacacaccccactaatcagacttaccatcaccctccattcatgaaatcatcaaattacacaacatgacacttcacactctaaaaaactaaaaccaaccccatcccaaccttcatccaccaaatcatcatcatcaacacacaatgcaggcagcgtaaagaagtaatcggacaagaggagagtagtgcaaaggcaaaggaggagcgagacgaagaacacaccgaaagacaggacgcggcagcgcaggcatagtcggacaggtggggcggcgggcgatggtgtggtggtgggtggggggtggcggggggggggcaggggctcggcgcggccgcgcacgtgagcgggcgctcagaggagcggagtgcgacagtagtgggcgcgga

SEQ ID NO: 589565 - DNA, 1683 bp, Homo sapiens
ggaaaaaaaaattattaatagctcaggttaaaaacacccatttaaacaaaacacaagagcattcgtaactagcgaacgctgctactactacacaacaaacacacttgctgactactgtagaacaagcattctcatcatggttttaacaactcatatgctcagacggcacagactcgcgcgctacactgcttgactgtgactaccacatctcactgcacaaccctgctatcatgacctaccactaactcctacttacttatcaacttcgctatgactctcagctcacaccctacagaaaactcacaccactacctgctcctagacagatcaccattccaaatcataggaacgcccaacacacacatagcagcacatatgacaaccacatttgacgaaagagagttagcatcattatacgaataagatatctacgatatacacctacacgctgaacccttgctgagttcacaaacaacgacaaacaacacaatggcccccaaagcgctgcgcgcgcacaacacctcaccatctttcccttgctgaactatcccactatcgacacacgacatacttataacaaacctcatcatgaacacaccttagcttatttcccacaactatcttcatcatacacgcgcacaactgtgacactccttacatacacacaccggcgccaactactcttaccacctggcacaacacccactctaaaacaataacgattaacatcacaagccacaccctatacacattcaacgacatacattaaccttacattggacaaagtaaacatatacctaagaaccaacttctacaccacaattacacttaaacttcgcaaccttttcaaacacccaccacctcactctcttcccttaccacctcggacccctacatttggaccatacacccacatatcctcaacattacccatcaccactgcaaccaacatccctacaacaccctacacaccacaacacacaacaccctattctacaccactagccacatgtcccatctccaaccaccccaacaaaccctcgccaacacctcaactcacccccactcattcccactctgaccaccatctaacacttcacctctacaccaactccatccactacaacacaccatcacatatacacatcctcattcctaactttcactacaacgtgcaacacacccaccatcaaccacatcacacatcacagctctctaatatccaaaaaacgctcacaccacattcctaaccaccctcatcccactcccaaccatctacataccaacacccacactccatccacaccatcactttcaccacacacattcatacgtacctctagcatctcacacactctaccagcacaatgcaacactaccccacacaactcattcacactctaccaatcaaacataacacactctaatcctcaaacactagctacgactaacacacacctcatatacacactaacaattcataccaacacaaaacatcataccagacaaacaatacatcacacatatactatcatccttaacacaatcacttgtcctactcacacaacacactatccatcagcaatcacactattctatcatcctcaactacaaaacacacacaaataagacaatacacaactaaatatctcacttacacattctatctaccacacatgataa

SEQ ID NO: 589566 - DNA, 268 bp, Homo sapiens
taaaaaccttaaaaaaaaaacttttacattttaattatataatacattcagcttaaaacttacgttcgttaaacaccccggcattagcaagcagtaaagtgatgattttaggatctttttcaagttgcatgacgtgcttgctttcatttgataggagagtgcatacgttaatagcaaagtccacttcatttgggagtccagataacagtgaaagcaccaatttattataatcatttggcgaattaaagtccatggacagcccataact

SEQ ID NO: 589567 - DNA, 439 bp, Homo sapiens
gaaccagggcaggtggtggagaaggtgtcatcggagctgagccttggatggcatcccagcagccacagctggacaagcaaagctgtgaggggaggcaagagctcaggccatcctcccatccacactggccaaaatgaaggactcacagaactgtgggaagtatggctggagaagtgactttggaagtgtctgtttactaaagggatgcatggaaagcacattcatatagacataaaatgtacacgacttggtcagtcacctgaggcttgttggtgaaaggaagttacagatttcaacatttgctgtcaagctcctctattatagaaataggagaggtaacataattggctttgggagctgcaagtagtttgctttccagtaacagcatctgttctctctgttctctctctcatactcaccatactatcatgcccacatt

SEQ ID NO: 589568 - DNA, 243 bp, Homo sapiens
ttcataacaggacgacgggttctcatgtgagatctatgctcctccacatgcctgttcacgctctacgcgattctcacatgttaccatttattacaggttactacaccttttgaaggtcatgttctggtcagctcttgtgatctgtgtagtggctgtgtagattcatgcttgacttttaaaatcctgggcattgtttgtgctgagcctcgtatgtttgtcagttcatgccgagtccgctgcatt

SEQ ID NO: 589569 - DNA, 635 bp, Homo sapiens
gcagaggaaaagaaagaatcagatctatagtcatttaaatatttcccatcagcatttacgtaaaccagtatactaaaaatagtagttttggttgagatttttgcacattaacttcctttaatttgtgagaatcctgccttttgggtggtgtcctcttatctgacaacacagttttaaatgctggctttatctggtttggttggtttactaataacacgtagttttggacccgtaattacttaacagctaggcatgggggagaccgaattggactgggccccaatcattgttctaccttccgtgagctgtgcagccataggcaactcccagcttctgctgtgcacctgtcttgagctggaaacaggtggcgggaagcattctcaaaggccccttctagcactaactttgtatgttcagtaaatatcagttccctggaccagctccttttattctggtacagaattattcttagcctatggggtgggggtggggggacagtagtgtctattatttgtgaattttggaaccagtgtcattactttacagtcaaggaggcatgttagagtgtctggattttatcccttgatacagcgccccatcccacataagagatgtcacttcaattgaaaactcga

SEQ ID NO: 589570 - DNA, 1121 bp, Homo sapiens
  misc_feature (998)..(998): n is a, c, g, or t
  misc_feature (1121)..(1121): n is a, c, g, or t
ccccgccctgtggtcacgctgtaatcccagtctcagggaggctaagaggcgggaggatacttgagccaggagtcgagactgctgggaatatagcgagacccgttcaaacaaaaaaaacaacgacaaaacacaaccagaattgtgcgcgcgccgcccgagccacccaaaaggacttccaaaccaatccaggctcggcggagcgggcgcccagaagagacgtagacacagcgcgaaacaccgacgtgcccaaaggaaacgccgcggagcacgcgacagagggacggagagccacacccaaaagcaaaccacgccggggggcaacacccagaaggtgagagacacaccaccagcgagagggacctccaccagacaaaacacagggagagtacaataaaaaaccgggtagcaacaagagcagcacaccaataaaacacaagacaccaccagccagtaaggcaagaaagaaagacagacaaacgacacagcaagaaaccaacaaagacaagcaacgaaagaacaagcaaaaaccaactaagccagaagcgagacagagaagacacagcaaacacagcaacaaactagaagaacaagccagacccagcaccagcacagcaagaacagaacaaaaacgcaaaacagaaacagagacagaagcaaacaagctagaaagaagcagaggaaagcgagaggacaggaccagaaacgcagcagagagcgacgcagaagagagcaagaacacaagaaggacgagcaaggaggagagaggaacagacgagcagcagaaagacgagcaaaggagccacgacagagcgaacgagcgccacggacgaaaagacacgacgagcgcagagcaaggacacgacagagcgagaaagacgagagaagaaagaagggcacgaaagacgaagcagaggactgggcagcgaaggtggaagacacagacagcaggacaggggaaaagaagaaacaggcaagggagagggagaacacaggaagangcacggcgacgacgacgaagagagagacaagagagcgcacatacaacgcatgacagcaaggagaaggacaggccgagccagcagaacactagacgaagacgacaacgagaaccacgatgaagn

SEQ ID NO: 589571 - DNA, 661 bp, Homo sapiens
ggaaattaagaccaggtgtttgttaatcttaactttagccaagacaaacaccaattcagttacttacgtagggatgggtctcaggctgaggactgttctctaccaacctagaagcaggaaaaagtaaactgatcttccgtgttggatgcgcgctcaaattccataaaggagttatttgtcttacatcggcatggaggcaggaaaaacttgccttccttgtgttggaagcaagttaaactccaaaaaaaaaagatcagggactttctggagggcgtgctctcagacctcagcaaattgtcctattggtttgagacataaagttagctcatgctggtaccaggcaccgattggagatttgtcaaaggcaggggcatctttaattaaaatccgtttggggtaccaaaaggtgaacactgaaatttgggacaggtctcaattaaattaaaccatttattttgccaaggtaaaggatgcatgcctgtgacacaagctaaggaagtcctgacaccatgtccccaaggtgggtccaggcccagctctgattttttacatttaagggggaactggaacctcatttatatttgggagagggccaagggtcccttcaaaaagctaggctcttgagctaggtgggggttttcgcgctcagttgtagcatatc

SEQ ID NO: 589572 - DNA, 118 bp, Homo sapiens
gtcacatgaccatcgcccgtcaaggtccctattgaaatggttataatacaaacaaggaagcacatggtacaaaatacttatgtattatgaatccagaccaaattaaatatgaaacctt

SEQ ID NO: 589573 - DNA, 377 bp, Homo sapiens
gcctccaattgcagctgactaaactaaaagtgaatataattagcagatagcacagagtagtagcagaacacacggatcacatccaaatacagagccccctagtctcgtgcgtagagtaagactcgctcacacgaggtcacaggctagccaggggtccaaggcttaggttgtgagcaatccaccatcctaccacgagtacaggtaggcggggtgttcgtgcatcatgtacgtgcaccagaggttggcacccagcaccttcagctggccctgggtcccagcctggttgtccaccaatttgttttctgcattcaaaagacacacttccaactcgaactggttactgcacttgacggagatctggtaattcaccagccctg

SEQ ID NO: 589574 - DNA, 795 bp, Homo sapiens
ccaactcagctcagctgatcggttgccgccgccgcggcgcagattctggaggcgaagaacgcaaagctgagaacatggacgtttatctgctcgccactccgcgccatgggacggatttcttcccgggttccagatccgctttgcccggccggacttcagtggacatttccaaatggaaacgaagcctgctgtagtgatgcaacctgctctattacctagacaagcttagctggtggtggcgtgccaatgatgattgtccatatgtggggtttcgtgagtcccttcaacatgatcctggcaggactcgtggtggtgctggtgttcacatgggttttgtgtgggcatgcccacgaataatgacgtccttcgccggatgaagaatgtgcgtaccccaccgactgttcgttccatggtggtcatgttggcgagctatttccttatctccatgttttggaggcagtcatggtctttgtgtcttggcaatacttttgctttggctgtgaatgtagatccgatgcatcgttgaagactttcggaaccttcaaggaacaagactgcgagactaatattggcccggagtagtgttgtgaacgagagaccccgatgggcattgttcctcggattgccctaagaaacagctgatgacagaaggcatcgaaatgaattcaagttgagtaatatcagccaaggtttaggggattaacacttaaatttacttgatgtatggttggcaaaaaattgtgttgcagttgcctttggcaaagcctatgttcggtgccgtttgaaccaggggtc

SEQ ID NO: 589575 - DNA, 505 bp, Homo sapiens
gacgcacggagggtgaggtcggtacgcggtggtggctgtcacggcgccagctcctcccgacgccgagaccattgtgggctcagctaagcggcggcctgcggcgcccctgtgagcctgcgcaaacccaggccctagccccatgccccagccgtgctggctgccggaggggccctggaacaggccccggcgatcctgcccgcagacccagtcgcccaagtacccaatggctcagcaagtcaccaggacgccggaggcccccagcaccagtggcgaggtgccactgctgtgaccgaccggttgctgcttctccgtcagttcgcccttggcatcgtttcccgttggtaccttcgacggccgttccctcgcgccagggacttgctccgcccgggtccttgctcccggccgttcccgctgttcgggcttcttgcccttgcccttcgtctctccctccttcgcccagcgttccccatgctggtcgtcttagcacgcacgcagtccgcatccc

SEQ ID NO: 589576 - DNA, 175 bp, Homo sapiens
tgacccccagcgttttggaaaaatgggtgtttgtttaaaacaataatttggagggaagtggactaaacagggtttttaaattaaggtttgtgtttatgtatttgtatttgcaaaaactcacccataaatgattttccctgtaagttgggtataaaacaagctccccttggtttca

SEQ ID NO: 589577 - DNA, 1270 bp, Homo sapiens
  misc_feature (1029)..(1029): n is a, c, g, or t
  misc_feature (1164)..(1164): n is a, c, g, or t
  misc_feature (1245)..(1245): n is a, c, g, or t
  misc_feature (1265)..(1265): n is a, c, g, or t
gtagtgcgtcgatatgtcttaacgtcgagatgaagatttgactgcctgtgtagtacaccgctcaggccaacaaggccatgtcacttcgtcccgtgatacttgtttgttatttacgtatttttgttgttgtagttaacatcaacacacccatacagttactccatgtcgtcgtctatcgcaataccatatgcgagttcggcggctaagcacataggttgatatacgtggtgatgatagtaggtctggaggtttacaccagacgctgacgaatgtgtatctagaatcgatagttcatagagtctagtttctgggttgtatgatagcacaacacacaccaccagtcgcggacgtgttatgggtagtcaatacaggcgcggcgactatatactctatcaaaaccaatctcgatagagtcagacatccacaattgtgtacgattacaacatactatattccccgctcccagctgagtgcatgtgttcctatcactttattcgacccgattgtgcggatgcgtatgggcctaggtttgtgccgctatcctatttaaatcggatgcgtaaagggagttggactgtctatattcacgtgtgggtcacattagatattctttatgatgtgtgtggggagaggccatcaccggcggggtgtgaaatagatactagtgtggggtgaattgtggacacacaataggtgggggacacaccacatccgatccccccacagtcaaaatcattttcacgggtggcaaaatcggtcgggaggtggtgtggaatatatagagtgggatcaatctagggtggggtgtaacatccgacgtgaactcaatcggggcggttgatgattgttgcgttggtgcgacactaaaaacactacaccggtggagacaccggcggtggtgtgaacggacacacgctgcggggtcgtgcggtctatctccacgggaaacagaggtgaacatcacacgcgtgcatacatcacgaaccgtgtcggggtttgcggtggtcaccgtatgatattcgcatcatngatatgtcgttgcgagtgaccagacgtagtacgcgtattattttcgcggtataggtttcttattatgttataatattgcgcactggctatgtgcctagccgtagtaatatgcataatcctcacagcgtgatgttngcggacacacaaatgagtgagagtcacaccacaccgcgcgtatctccagatgagtgtgtggctgcgcactgcgtcggcctnacacgggaggatcagcacangcgcg

SEQ ID NO: 589578 - DNA, 126 bp, Homo sapiens
atacagtatgccgcgacttcaaatggtcagcgcgcggatgtacgctgtccagaccggttctcccacaaacagcgcatggcttcgtgtagttcttctcgtacaccgtgaagcggtgatagatccccg

SEQ ID NO: 589579 - DNA, 845 bp, Homo sapiens
gaggggagcccaaaaacccaggtggcaacgcacaaggtacgtggtgatatcaatcgtgctcttgtgcggagaccctggcacttagtgaattcgcatatttctcaagtatattgagaaacgtgtccagtccgagccatcttcaccactggtcaggcggcgtcggctgtgggcctcaccgggtatgtcctagcgtgaccctgtcagcatgcgagtgcgcaccttggtaggctggggccctggttctggctgaccgagtgcagtgtgtctcattgatgaacatttgacaagatgaatgatcaggacataaccagcagtccatgaggccatggagcaatagagcatctcaacatctcgaaggttggcatcgtcagcatccctgcgggctctgctgtactggttcattgctggccgccaaatccccatagtgagggcgctacgagtccctcgtcatgactttctctgagaagcgtggtagctcacagagacgccatcatctcacgctttgacatcctgtgatgtggatgacgggacaccgtggacccagtccaggtacgagatgcatggccctgcttcgtggtgagcagccacgtgagacaccaccctgagtaagcaaggagtgaggagggcgctgggcaatgtgcagcgctgctgagcgcgcatgcctacatgtatggcgtgagccctgcctcaggaggtctgaagaagtagatcatctacgccaaagggagaggggccacccgaaggtcgacagattgaccaggacaaggtggcccagatgtaccgtgactgggtgaagaatctatgggaacgggacttcccattaagtggcgggcatcgaggcagat

SEQ ID NO: 589580 - DNA, 736 bp, Homo sapiens
  misc_feature (186)..(186): n is a, c, g, or t
aaggagtggcccgggctgggtggggagttccggccaagctcttctgagaaatgaggagatgaaaaacaaacaagggcaggatggagaaactggggccaagaaagggatcagaagaaacagaacggggattggagaattcaccccaggctcctgaggggccctgggctcccgagggagaacaacccntcaattcggtaaacgaaaaagctgggttccctgggagggtactttctgagaacttcatcctcgaagggctggtgggtaacgggctcttttcatcttcacggggcaaccaacagaaatgaagcagagtgggctaaggtcacagtggcacaggggctggtcagcaacacagtggctggggtgggtcctccagatggcccgaatcttcaggaataagcccggagccatgggagcttacaactggcagtctggaagcacgagatgaattgcgtggaatccacaaattacaaactatgggcattgaagctgaacttggaggtggcaggttgggttatcttggttattttcatcctggagatacttcttaagtgggtattcaacttttctggtttttggaagaatggctggaaaggctttgaatttggtggtaacaaggtgggtaagatagagaatctgaagggtcggtcacagggattcagaaagttgcctagtgaatcgaagaacagtttactgatattaggagaccttacattactccttcttggatttttcc

SEQ ID NO: 589581 - DNA, 426 bp, Homo sapiens
ctctcagctttaccttctaacttctgcaccaccagaaattaaattgatggcttaaaaataaattgtttaccaatgatatcctcattttttcagtgctatttaatccaatatatggctttatatttttctatcttctatacttctccaatacttgtcttatcttgtattccattttctatctaaaactcttaacaatattttcatttactatctatgttactatcttccagttttcttctaagtatgttcattttgcccttagcttatttgtttcctagcttgtcttatatcttctgcttcctacttttcaggtttaaatatatcttttgtcttctaaaagtatttttttatcttctaatttccctatcttctctattcttttcttcgccttcccgtacttctgtcttccagttttccacttcaaac

SEQ ID NO: 589582 - DNA, 710 bp, Homo sapiens
atggcacatgcagcgcaagtaggtctacaagacgctacttcccctatcataggaagagcttatcacctgttcatgatcacgcccgtcataatcatttgccttatctgcttcctaagtcctggtatgcccttatcctaacactacagaatcaaaaactatagctaatactaatcattcgtcagacgctcaggaatattgggaaacccgtcgtgaatctagtcctgtcccgcgcatcactcgcgtagtcctcagtcgtccctccgatccctacggattccttgacgagtaacagacaagggtcaacgatctcgctccacattacctatcgataattgcgatatccggtcgacgcaagggtacttgaatcctacgtagtacgtcagattacagtggacataatcttctagttcctactgtagcttgctcgctccattagttccttagatagcagagcgaacgtgcagaactccattgaacagttcgagcaatgctgatgtagatacctcgctcgatgtgaagcgcgcccatctcgtatacactcaattacattcacgagagacgtctatggcactcatgtagtctgtgccccacatttagtgcttaataacagtatgcaattcccgggacgtctaaaccagatcactttcaccgtctacacgaccgtgggtgtatactacgggcaattgctgctgaaatctgtggagcaaaac

SEQ ID NO: 589583 - DNA, 214 bp, Homo sapiens
acatctttaaagacagcgtgtttcagaggctgtgacggtgccttgtgaacatgccaattctcgcagtcccgggagctctgaggagcaggcccagctccttgccaggctgatggtactgaaactctgctctccaagacataacctgatggccgtgcaagatttcttaatcgactgtggaccgtgagagtctgcatctcattttaattaagatggg

SEQ ID NO: 589584 - DNA, 593 bp, Homo sapiens
aggatcttactccttcagatgattttataatttgtttactaaaatcttcttttatcttattaaagcttaggctctggatgggtgtgaacaaacggaggtcttcaagggtatttaatatggactgggataacactcatttcaattttaaatatggtatgacaatggctcatattttccaatcataacaatcataggaaataatatattggatatttgcatattttcatgatagtatatctattactaataactgatacaaaaaatagatattcgtgctttaataaagtaatatgagacgtaataatgacattctataaatgtcccatattctaatagttatgcataagctttacagactgtgtatacttggctttcttacatagtttaagtatcttcagaagtatcaataatctatagtttatcattcattgacatatagttaactcctcttcaaatattcatcattatgagttaacatgtggccttattcagaaacatcatatgctcttgcaccttactagggtaagtccacttggaaccgaatttaatgtggatatgcattcggctaaaaactatgattcaggatcaaaacg

SEQ ID NO: 589585 - DNA, 1110 bp, Homo sapiens
  misc_feature (6)..(6): n is a, c, g, or t
  misc_feature (9)..(9): n is a, c, g, or t
  misc_feature (936)..(936): n is a, c, g, or t
  misc_feature (1001)..(1001): n is a, c, g, or t
  misc_feature (1009)..(1009): n is a, c, g, or t
  misc_feature (1019)..(1019): n is a, c, g, or t
  misc_feature (1021)..(1022): n is a, c, g, or t
agcggngtnttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaagaaataacttcattgtttggacctgcatatntagctgtgttggaacgcagttgattccttgagtttcatatataagactgctgcagtcacatcacnatattcantggtgaaatncnncttgttactgtcattccccttccttttcgtttagaatcagaataaagttgtatttcaataatctaaagaaaagaaaaaaaaaactcgg

SEQ ID NO: 589586 - DNA, 623 bp, Homo sapiens
  misc_feature (6)..(6): n is a, c, g, or t
  misc_feature (9)..(9): n is a, c, g, or t
  misc_feature (562)..(562): n is a, c, g, or t
  misc_feature (614)..(614): n is a, c, g, or t
agcggngtnttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacacttgagcctcctcngctgcaggagccatgagacctactggattgtgccagctgttcgccactgcangccacttgc

SEQ ID NO: 589587 - DNA, 543 bp, Homo sapiens
gatatgtctggcgctcagcctcccaaagtctggagatagcaggttgagccaccgtaccgggcctttttttttatttaaagacaaggtatggctctggtggcccaggcgggagtgcaggggacccgatcagggctcacggcagcctcaatttcctaggctcaagcagtcctcccacctcagcttccgtgagtagcttcagggccataggggcatggctacaaagccctccaataaaagcaaaaaagtaccatttggcccaaggctagatgatataaaacatagaaggggacttcaggtttacatctcaacccccaaatttagctaggcctttaataatattgcaagggtcaggcttcttaaggtcttataattagaagcggttggtaaaagtggatggttacctacctacggtatgagtaaggcggcataagtggaccacaattatgtgaatatgtcatattggctggacttgtggctcaggagagagggccattcagaagaaaatctgctgtggcccatacatcttctaaagttctgtatcaa

SEQ ID NO: 589588 - DNA, 942 bp, Homo sapiens
atctctgaagtgtgtatttcctattgaattagagacttggctttgtttcaaagatagtgtagctagaagaatttttggctgtctaagatgcattctatagagtgccagaaattctcttcttatataattttaaattatagcatcatcttctctgagaaagaaatacaatacttactgatatagaatgagtctaaagcttacgtatttaacaaggtgattggactgggggaaaggagtaacaatgaatcttcaatatttacaaataaactaaaggaaatgatttacgaatatttctttttttggtctgtgaccaggtagttatctccttgtacctcctatgtaccaggggctggtgtaacctttctggctggacaactgacttaactcttcggagagcttctataatactctctaagccccataagaacacgctgaaaacactttatcgggacttcatattggcaatactgaacacgtaccacacggtaacccttgaaagttcaaaatagcaacaagcttaaacaaaagtaccaagagtatacaaattctctctaggatccaggttcacatacagctcccgtgtagtaccagaattgcgaacgtcattactactaggcaacggccagcataatatatagcttaaaataacctcccatattagcgcactagggtggtacagggactaatataaccacggtcgctacgccagcacggcacctgaagcctccggcaaattatcccccccatatgaattccccccttcacaaccattcccggcggtacggcgacctccaacactgggtccattttcaagcagagctccacggcaccccacctccctgtcggttctccacaccttaaatccttcctttgcgaggctaacacctcctaaccattccggacttgccccccgggactcacagcgacttccatcttaaccag

SEQ ID NO: 589589 - DNA, 202 bp, Homo sapiens
aaaaaaaaagggccccttttttttcccccaaaatttgttaaatgggtttttttcccaaaggaaccccgggttttttaaggggttaaaaaggcccccccaaacgggtttttgggggggttttttttttttcccgggggccctttttttttgaaaacaaagggggggtgggggccccaattttttcattaattttttcccccca

SEQ ID NO: 589590 - DNA, 105 bp, Homo sapiens
gctcgtcgacgtgtaatcaccactgcggtgttggctccctgtacaagttccgtcgacacagtgagcacctgtgctgacctccaagatatcgttaagctggagcct

SEQ ID NO: 589591 - DNA, 405 bp, Homo sapiens
gttctagaggatcctaaagggagtcggttagcgctggaggggctctgaggtttggatgtcagtgtgggctggaataggccttggttagttgagcttggctgcagaatgggacttggagttctgtggctgggcaagggctcggcttggtggtggagctcacattgccctccccacaggtccagcccaactctgtgcacatctgtgcggtggttgtggagtacgagaccaaggccgggcggatcaccacgggcgtgggcaccacctggctgcgggccaaggagcctgtcggggagaacgtgcggccgtgcgctggtgcccatgtccgtgcgcaagtcccagttccgcctgcccttcaaggccagcacgcctgtcctcatggtggggcccggcaccggggtgggaccc

SEQ ID NO: 589592 - DNA, 719 bp, Homo sapiens
ggcagaaccgggatccggaggcagtttggaggcggtgaataatagctcttcaagtctgcaagtaaaaaagtggcctcctaacaagaattacattgctaagaaatggtgacaaatagagagaagtggaaagagtagagaagaagttgaagaggcaagagcctggagagaataggtcgtggacacaaagtactagatcgaggtgtagtgaatgggaaagtggaatatttccatgcaagtgagaagggattgacaggtgctgagcgatacttgggcaacctgtaatgaagaatttagattgtcgagaatggattgaagcgtgtcttaactctcagaatgctggggaacgagaaggatggtacctatgagagaatacatcgtttatctgaactagtgagatctgatgacatgaaaatcaagaagtagagataaacgagagtggtgcgtggatgaggccagggaggattttgccagaggtcttgatgctgagagaataattggtgccacagatgggggtggagaattgatgttttctcgatgagactggaagagattcagatgaggcatgactgtgggtgtggggaagagaggcaagtatgaagtgtcctgcaaatagtgagtgggttgatgaagagagactaatgtgggattcttggtccagaaggatgaagggtctagtaattggtcagattgttcttggatatatatttatatatgtatat

SEQ ID NO: 589593 - DNA, 118 bp, Homo sapiens
ctgcgacaagtatgattccgcaaacagcatacattcatcctcctactagtaatcctccttcaacaatattctctccgcgagaatgaagcatcaccacctactacgagggtgcctgcgg

SEQ ID NO: 589594 - DNA, 145 bp, Homo sapiens
tagtatacttggatcagggccatggtttctctcaccatactcagctttgggtactcactccctagcttgagcctactggtcatcaagctgtacagtgccaaggtgtgggatggctgtggagcatgagctatggcccaagtaactc

SEQ ID NO: 589595 - DNA, 653 bp, Homo sapiens
aggacccgaggaaaggacttcacgtggggcaggtggccccgtgaaggggccattataagcgtttaggcatgtttaacttcagcgctgtagaagctgtccagctgggggctggtgatgaaatacctgggcatggccaccccattttttttcctgcctgatggggggaagatcaaggactggagaaatggactcaccccgataatcatccccaaggtcctggaaaatgaagacagaaggtctgccagcttcattttaccccaactgtccatttctggaacctatgatttgaaaagcgtcctgggtcaactgggcatcactaaggttttcaacaatggggctgacctttccggggttacagaggaggcacccctgaagcttttcaaggccgtgcataaggctgtgctgaccatcgacgaaaaagggactggagctgctggggccatgtttttaaaggccatacccatgtttatcccccccgaggtcaagttcaacaaaccctttgtttttttaatgattgaacaaaaaaccaagtttccccttttcatgggaaaagtggtggatcccccccaaaaataaatgccttttggtcctcaacccctcccctccatccctgggcccctccctggatggcattaaaaaaggggtgagctgga

SEQ ID NO: 589596 - DNA, 352 bp, Homo sapiens
ggagagagagagagaactagtctacgagtttgttttttattatttatttggtaaccatgggatattataggtcttgtgggtgtttcttaaaactcagcagcgtgtctgtgggccataaattctgtagacatttagtttgagtgccgttgggcgccaggtacatttagtgggtggcacgcctttggtggtgcactcgtggtggtaaaagagacctgtgcatgtgtccgaacgatgggcgagagtgcgaaatcttaaacatctgtgtttgttccacatgtaaactatatttcagatttgttaaaatgggctccgtggttgttaataacaaaaatacaagagataaaaaatatcc

SEQ ID NO: 589597 - DNA, 863 bp, Homo sapiens
  misc_feature (11)..(12): n is a, c, g, or t
  misc_feature (14)..(14): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (22)..(22): n is a, c, g, or t
  misc_feature (24)..(24): n is a, c, g, or t
  misc_feature (31)..(32): n is a, c, g, or t
  misc_feature (43)..(43): n is a, c, g, or t
  misc_feature (48)..(48): n is a, c, g, or t
  misc_feature (365)..(365): n is a, c, g, or t
  misc_feature (370)..(370): n is a, c, g, or t
  misc_feature (372)..(372): n is a, c, g, or t
  misc_feature (374)..(374): n is a, c, g, or t
  misc_feature (393)..(393): n is a, c, g, or t
  misc_feature (416)..(416): n is a, c, g, or t
  misc_feature (426)..(426): n is a, c, g, or t
  misc_feature (441)..(441): n is a, c, g, or t
  misc_feature (486)..(486): n is a, c, g, or t
  misc_feature (492)..(492): n is a, c, g, or t
  misc_feature (505)..(505): n is a, c, g, or t
  misc_feature (529)..(529): n is a, c, g, or t
  misc_feature (545)..(545): n is a, c, g, or t
  misc_feature (552)..(552): n is a, c, g, or t
  misc_feature (561)..(561): n is a, c, g, or t
  misc_feature (593)..(593): n is a, c, g, or t
  misc_feature (596)..(596): n is a, c, g, or t
  misc_feature (703)..(703): n is a, c, g, or t
  misc_feature (705)..(705): n is a, c, g, or t
  misc_feature (712)..(712): n is a, c, g, or t
  misc_feature (743)..(743): n is a, c, g, or t
  misc_feature (746)..(746): n is a, c, g, or t
  misc_feature (775)..(775): n is a, c, g, or t
  misc_feature (841)..(841): n is a, c, g, or t
ttgattactgnngngntntngnanacccccnnttgacaggaangactnagatttgaggcccacctcccatggtgatggggagctcagaatggggtccaggagaatttggttagggagaggtgctaagggaggcctgagcagagggcaccctccgagtggggtcccgagggctgcagagtcttcagtactgtccctcacagcagctgtctcaaggctgggtccctcaaaggggcgtcccagcgcggggcctccctgcgcaaacacttggtacccctggctgcgcagcggaagccagcaggacagcagtggcgccgatcagcacaacagacgccctaggcggtagggacagcaggcccagccctgtnggttntntnggcagcaggtctggttatnatggcagaagtgttcttccccanactccaagtnctttaaacccacgtnagggctacgggccaggaaggtggcaggctgggcagagaccaattncttctngcaggatagagcntttacgttgcaggtgtagccagcngggcagcagtactggngatcctngcagcacanagcatggggcaactggcagcaggcccagctcncancacaggctcgggcagcaggtctgccccaccgggcagctggtgtgctggtcacagccgatgtctctggggtgggataaggaagcccggcgggcaggcatcttctccantncagccangatctcgcttcctcgctgacactgcccctcngcnacacacgtgtagccctgggggcagcagtnctggtggtccgagcagcagacagcctctggggattggacagcagccccactccccagacgtgagtnggcagcaggtataagaagaagg

SEQ ID NO: 589598 - DNA, 298 bp, Homo sapiens
gacatctactggaatcgccagtgatctccacaagggcaggactatgtctgggtgccagcacgtgagaacagggtctggctcctggcagaagctccgaggagctcctctaccttggaatgaatgcctgcttcaggttggaccacggctggccccttgcagtggctaccaccaaaatgcagttctgaccaagccaccacctaagacaactcctttcccgggatactcactgctctgcgcccaagtcttgtggaatacgcacctctcttcagaatatacgacaattaacaaaattgcttta

SEQ ID NO: 589599 - DNA, 809 bp, Homo sapiens
  misc_feature (14)..(14): n is a, c, g, or t
  misc_feature (152)..(152): n is a, c, g, or t
  misc_feature (716)..(716): n is a, c, g, or t
  misc_feature (751)..(751): n is a, c, g, or t
cctacttatcaacnaatgtaatagagccccccaataaatcacacctaaccattactcccccttcaccctttttaccacatcatttactccaccccattatcacctttacacacaacttcaccccaaataaatctaaccactaactcctcttnaactttaatcaaaatttttttttaatggctcaccaatacccacaaccacccatattacacaccacaccttttacacgatttaatctctttactatttctcacactctatccattaatccccttaaaaaccacataatgattacttcattatcaattccccaactttccaaatttttttaaaacccactcccttcaattttaccatttcgtcccattcttcccaactcaaaggcattcctccatacaccacccttttacctaatatccctttttcccaaattcccttctccgctaacttaaatactggccgctcaccccactctttctttttcttgaaaaaattctccaaacccctcaatcttaataaaacccccgctttccccgttctttccacttacagaaaccctctctccaatactctttaataacctaaaaaaacctcaaacctctaataatttataacctctctaaaaattcaatattataaaaacaactcttttacaaaccttacaatcccctcctttttttttgtaaaacccatcacacctgaacctgcttcccctngtccattccacccaaatttcccctctttaaatagnaatattcctaataaattacaacccgccccatctaaatataaaaacctcacaatcattt

SEQ ID NO: 589600 - DNA, 269 bp, Homo sapiens
gacacccctgcctaggggaacttgtatcgtctacttggttcgttgtcctagttgcattttacctgcagtccaaaggttattttcgatgctagaactgcaagaaccccaaagccaaagaaagcctcgtggacagtggtcgggacgcggacggtcctttctgacgactacatttccacggagacacactacccacgtttgcgacgacggacgctggtacgttactgtgtgcaacgtgtttttcttggactggcacgcgtcgcgcctgggta

SEQ ID NO: 589601 - DNA, 344 bp, Homo sapiens
tcggggcagacacacctgtaggcgggagcctatccttagctcctttgagcgccggctgttcttagccctgggcgctgcgttcattcttgtgcgggaggcagcggggtgtgtttatcctttatgcaatgtcagggggaagctaccccattttgacactattgttgccacagacggggtacaggatgggctgatatctcagcatcatatctgagtaactaggccagcgtagagattgtcgattcatattaagaggttagattccaccatacctcattctcagagctttacagatagaatcgcaaaactgttcgagctggaaaataccctagaataatggttcttct

SEQ ID NO: 589602 - DNA, 195 bp, Homo sapiens
ggtatgggtggtgcgcgaagtacaatgaagaaggtttattatttatttagacagagtcacccaggctggagtgcagtggtgtgatctcagctcactgcaacctccacctcctgggttcaagcgattctctgtctcagcctcccgagtagctgggattacaggtgtgcaccaccacaccctgtcaattttggtatt

SEQ ID NO: 589603 - DNA, 320 bp, Homo sapiens
  misc_feature (21)..(22): n is a, c, g, or t
  misc_feature (166)..(166): n is a, c, g, or t
  misc_feature (301)..(301): n is a, c, g, or t
  misc_feature (311)..(311): n is a, c, g, or t
agccaggaactggtgtcattnnttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaanaaaaaattagctaggcgtagtggttggcacctatagtcccagctactcggaaggctgaagcaggagaatggtatgaatccaggaggtggagcttgcagtgagccgagaccgtgccactgcacttccagcctgggnaacacagcgngacttccgt

SEQ ID NO: 589604 - DNA, 1224 bp, Homo sapiens
gaaatgacctggaggaagaggagtgtgtgtatagcattattaatgtctttattattttgtaatgaaaaagcatcactaagctgcccctggcaagtcgggtgctagctgaataggcacccaatagagtccagtgactaaatttacgtttagtctattttggatagcaaattatgttaaggagacagttgatggctagtggctcaacgaattgtgtattcaccatgtttgtgtgagacagagtcatgtgctctcccttgaagcttggttagaattgtgctactgtgaacgctgatccatgcatatggaagtcccacttcggtgacatttcctggccattcttgtattccattgtgtggatggtgggttgtgcccacttcctggagtgagacagctcctgagtgatgtagaattcccggagcgtccgtggttcaggagtacacttgaagcagcatctgtgcatgctttacctctggaacaattggctcgatttctcttaacagtcctacttatgataggatcctgtttcctatgtgtgcaaaaataccaagataacatcgggccagacaacaacagacaaacacacagaaaacaaaaaacacaacaaacaaccagaaccaccacgcgcagcaccagaaacacacagggacaacagaccaaacaaaaacaacgacaggaagaagaaaaagcgagcctgacaaacacaacacgaatgaaaaaacaaagagagggacgagaacagacaagatacccacaaacatgagagacactatcgggaacccaagcacggagggatagaacggcataaacagacgaacaaaagaacagcggacgtgagagcagcaaccgcgagacggagcacggagagaggagcagggaggtcacgcacgagtgaagagcagagcacacggatggccagcccacacgaacagagacagtccaaccaacgagatgaaagaaccaaaccacaaagacaccacacaccgaaaaataaccactgaagcgacgacaccatgacaggcacgatcgacgcacgcgccgacacaacaatgaaatacggaacacacagaccgcgcaacgacgacaacaaaaagacgcaaatcaggaacgaacagaacgcgaaagaagcaacgaccagagcaccaacacgaaatgacaccaccaccaagagaaccagtcaccacgaaccgtcacaacccgaggagaccagaacacaacagagaaaga

SEQ ID NO: 589605 - DNA, 596 bp, Homo sapiens
cgtatatgtaccacattttctttgtctaatccaccattgatgggcacttggattgatgccatgtctttgctgttgtgaatagtacccgataaatatacaaatgcaggtgtcatttggtagaatgatttattttcctttgggtatacacccagtaatgggattgtcgggttgaacggtaattctatgttgagttctttgagaaatctccgaaccactttctacaggggctgaactaatttggattccacaaccagcgtataaaacttcccttttctccttaaacttggccatggtctggtatttcctggaactccttattaaagagaacaggtggtaaacactggtaccaatctaatttctgggcttctcacgaatccaatctggctttcggttaacctttggattatttggggctcttaattcacaattggtgacctttgcgggtgggcttggtggtgttttgaccctttattttatatgtgggctctaccatttctgtgctgtgtatttccctggtgtgagggttttgagagacatttttccatgtgaaattccgggacctttaatctcggatgtgccccccattccttctctcg

SEQ ID NO: 589606 - DNA, 686 bp, Homo sapiens
  misc_feature (159)..(159): n is a, c, g, or t
  misc_feature (163)..(163): n is a, c, g, or t
  misc_feature (202)..(202): n is a, c, g, or t
  misc_feature (205)..(205): n is a, c, g, or t
  misc_feature (213)..(213): n is a, c, g, or t
  misc_feature (215)..(215): n is a, c, g, or t
  misc_feature (217)..(217): n is a, c, g, or t
  misc_feature (220)..(220): n is a, c, g, or t
  misc_feature (224)..(224): n is a, c, g, or t
  misc_feature (227)..(227): n is a, c, g, or t
  misc_feature (233)..(233): n is a, c, g, or t
  misc_feature (238)..(238): n is a, c, g, or t
  misc_feature (240)..(240): n is a, c, g, or t
  misc_feature (269)..(269): n is a, c, g, or t
  misc_feature (285)..(285): n is a, c, g, or t
  misc_feature (288)..(288): n is a, c, g, or t
  misc_feature (298)..(298): n is a, c, g, or t
  misc_feature (303)..(303): n is a, c, g, or t
  misc_feature (307)..(307): n is a, c, g, or t
  misc_feature (311)..(311): n is a, c, g, or t
  misc_feature (318)..(318): n is a, c, g, or t
  misc_feature (320)..(320): n is a, c, g, or t
  misc_feature (325)..(325): n is a, c, g, or t
  misc_feature (327)..(327): n is a, c, g, or t
  misc_feature (334)..(334): n is a, c, g, or t
  misc_feature (336)..(336): n is a, c, g, or t
  misc_feature (338)..(338): n is a, c, g, or t
  misc_feature (430)..(430): n is a, c, g, or t
  misc_feature (505)..(505): n is a, c, g, or t
  misc_feature (507)..(507): n is a, c, g, or t
  misc_feature (513)..(513): n is a, c, g, or t
  misc_feature (522)..(522): n is a, c, g, or t
  misc_feature (571)..(571): n is a, c, g, or t
  misc_feature (684)..(684): n is a, c, g, or t
accacaaataaatttaataattttctttaaataaatttcttatgctaaaaaaaaaacctctagtcattttctagagacttctttttgccttagggattctttatagttcctctccatgtaacatattgggtaatacttgtggttctgaaataaaatgcnagcnggggggtgtacacaaaaaccttaccactgaatcaagggnccngctgtgcngncnttntgtnccngtcctnttctntngttctgcccctggcccttgtgcctccctncttttcgcctcttttngcncggccctttnccccnctcncctnggccccncngttcncntttcgcncncngtcgcctcttttctcccctcttctccgcccctcccgcctccccccccccccccgcctgcccttttcctgctgcctgttccgcctctttgccncccccttctctctggcccccctccccagagctgttccggtgttccggccctcccctccttggttctcccctctgncntgttcnccggccggnggtcgcccttgggcccgtttcccgcctgtcgctctgttgcctcccttcncccccccccgccccccgctgctgccccctttttcccctgccccccgctgcccctgtccctgcccctcccccgcttgcgctgttcttggccgaggtgtcttcccctcccctccncc

SEQ ID NO: 589607 - DNA, 877 bp, Homo sapiens
gatacctggaaggaatggagacagccggcagaaaacacggcagagagggtggaaacatcacgttaaatatgattaaaatcccattacgtgctaccgaagcaataataagtggactgcatagaaatcagtatcctggattacgctgagcatgtgataacagtccatctcacacacacacaaatagaatttcagatacaagtgaacccacatgttgaagctttcctagtagtacactacacaaatcttcaactgttcatgcttgaatcatcatgccaatgactatggaggctacagaatagatgtcatcttaggagtgcttgctcatgagtgaggctcagtctgtcaaatgctgaagtgaccacaaggagatttgattatacatgtgaacacctcagaaggcacagcccacccagaaggcagacaggtcaggctgctttttcttcattgcttggattcaatcctccgggcggctcaggctcaaacataacttaagcatgattaaactttagaagaagctgccaggaagactgtgaaatcttcatgcccaaggatccctaaaattaggagcaacaaccacttggctcagacggtttatggaggcaaaggtttggatgggattagagatttctaaatgtgagttcgtgtcctctgccagaccaccttacttccaccattcctcagcaaatcaagaaaaacaggagaaaagacatgcctttccataagttaaatctattctgttttaattctatattatatctgctgtacaacttcttttgtttgtaacaccatattgttgctagtaactggaaattaattttcacatgcctcagcttagaaaaataaaaagcagccctgcatcaatcccaaaaaaaaaaaa

SEQ ID NO: 589608 - DNA, 904 bp, Homo sapiens
gataatcacaatgtccttggaatccgagttcctttaggctttgtgaccaggtggggtcacaagatgtctgacatgacgaaggaccgttggtgcgagtcatcatgtgggtcgaaattctcgagactatattcctatgagagtcttcgcggttaggacgcaagtaggttccaagtaaagtagctgaacaattagcaagtagccgaagagaaccttgtattagtcactctccgtgaagagggtgactcaaacgaggacctggactgataccagatcattgccgcgtggcttgatgtgggtgacactggtggatggccacagttcaacgaacagggcaaaccagaagctcagaaaaacacaggtaccactccagcacgtggctcattcgacaacgaaaagtcataccgtagaacacagatggcgtgttctccttctcactccttgacagataatgccaggagtcatagtgaaacaaataaacggcgaagcatgcaacaggttctgccattcacaggcacccagtagcaacaggagctgtgcagaaccttgctggcccccggattggcatccaaatgcctgggcaggcgattggccatggacttcttccaaggtactatctctgctaacccgacactacacacacaaaaagacctaaaaggcccagaataacaacaacaagaccaaccacctaagacacaaagcaagacaacacaacagctcagtcgcgaccaccgccgccaggcgaccccgcgaaaaacgagctcgtcccaacaccaacccgcgctggaggcgagacgcggcccccccgaggaggcacagaggagacacagcgggccacaaagcgcgccctcagagagagatcccgggcccgaaggcaaaaggcccggagagcaacacaccaaaacgc

SEQ ID NO: 589609 - DNA, 1065 bp, Homo sapiens
cgtctttatttcctttccctttattccctctcaattacatgtttagaatctctcgcctccaagctattccttcaaccttatggcttcaatctccgctcctgtgccggtgaccctttggtaccctcacagtctgaattctgctatcccaggttttattcacccagaccctttaagttgcttctctctgtctacgcctgtttgctctatagtgactgtcttacataacatctatgggacctgtgaaaccgcacagagagccacagtagagaggctgcttaactgcagtaccatcggagagttgacagaataatctagtagaaaacaattagtctggttgcatgttaattccttccagccagaaagaaagacaaaaacaaggagtaagggggactttagtagtcttatgtctcagctacacattacattggtgtatactgcacgctcaaattcagaactggcaattgatacatgatatccaatggcctagaatccttgaggcacgggacctggctcttcctatgtattaaaaagatattttttacctgaagagctaaagcactggccagtgtcgtgggttagcagatctgctataactctgaaattaagaccgttgcagtattcctagcactcaatcgtgatcaccctatttgtgacagagaaagggaaggaacatataataagatcatctacctataatgtgaataatgtggttgagctatcaaaatgtctttggaattttcacaagccgctgtccattgttggaggatgttacctactaaacttgaaaacattcattccatatctacttacacatacaccagcaacagtataaatgtaagcctaactttgcaaaattcgtaataatttactgatggaattttttaataacatgcagtatataaagtgtgcagatttatgcgtgttgacaaaatcatttttcagcttcgcaaaatgggacatgccaatattacatttctcacttaagcagttttttacatctaaccgttgcttgctttcataaaatgaattgtgaatgccatcttatcactgactgcaaacttgcct

SEQ ID NO: 589610 - DNA, 421 bp, Homo sapiens
tagacagaattctagctttacccgtgcatcgttgattcagcttttctgttagggatcagcagctgcaggatacttccatatgcgtaatagacagccatgcccctgggagtcactttcaatggtatctgtgacatttcggtgtgcctcattccttcttcttacctgaactcactgctctcggggtgtttctgcactttgctatatgtgtcgtgtctgatatccctctcgcgtagctttgcctctatcaggactggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaagga

SEQ ID NO: 589611 - DNA, 307 bp, Homo sapiens
gagattccagacacctcctctttctcctgacgctttggaggaaatcatctagtaccagctccaggctcctggtctgctagaccaggttctcggctcctcccggctctgaaatgtggctcagctctgccacagtctttctctttgttagatcctgggcagaaatgtcaaggcctttcatcatcttgggcccccagttcagagagaactccatctattattactagaaccatctactgtatagaacatatattggtatactatacaggaaaactattttcaactcagccacttctgaccggagtcgagg

SEQ ID NO: 589612 - DNA, 580 bp, Homo sapiens
ctggtgatctagaggatccctttgtggttgttgggagcaggccgggttggtgatctggggcgactcacacgttggaaatcagccccctaggtgatggaagagctcctcgggtgtcttgtcagttgggctggctcccccttgccggaagcgggaagcgatctcatcggaggtccggcctttagtctcaggacctttgcaagtcggtgaagatgaagaacagcccaggagcacagtgaagatgatgaagaggtagggaccacacagttgctccacatacgggaagcacatgcccacaatgaaattggaggtccagtgggagcaagcctgcaagggcaatggcagctggacgtggaccctgggctgaagagttcagccaggataaaccaggggatggggccaggacccatttcaaagaaggccacaaagccaaagatggccacgatgctcagataggacatccagggtagctgctccagcagtgctagcgcgatggtcatgagtatggcacaacccggcatgccagcgaggcctatgaggtgcagggtccgcgggcctgctcgctccaccacaaccagtgacc

SEQ ID NO: 589613 - DNA, 158 bp, Homo sapiens
ccgctatcagcgcctggcatatgcgccagctggagctccaaagcgcgcctccgttcctgccagtgtgtcttccaatggcagctctcatgctcagctgtgactgcagctcaggctcaacaccctgaaaggtgcgccgcaggtcagtaacctcggacctg

SEQ ID NO: 589614 - DNA, 1420 bp, Homo sapiens
gctccgggcccgcggcaagcctcgggcgctgttcgtagcaggccgcgaacgagcatgtacgagcaagctcgatagggcgagtggagaccgtgaaagagcgcccgaatctttactcgaagtgcggtggacaggagctggggtcgactcgaagctcagttcttactgggagactcaagttcttgtccataccacagagggaccaagcctgacaaaatcagcaaggctaatgtaactggcgccctgtcgaccatcacatgggacgatctggaggcccagatgtgaagcatccgttactgcgacaggacaatccccgtaccgttcagaagcagctcacgagtggtccgctaagctctaatatgcgtgagctacttattgatttacaagggaagccagacttcccctcgaagtgcagggctaattattgccacccatgggtccttggcgaccttcaactcgttcgctactatacccattgctggttgcccaaggaatccagaggtaggactgggaagttgcccaacgactgggtaaggttcatgcgcatgccgggctttgtgccttgcgcaaaaggatatcagttacaatgaagcccaaacatgcttgtaaaccatcgaaaggaacacccaaggggggtccccatagggaggccaaactacccactgaacttgcgagggcgtcgagcttgaccaaagcaaaaaagctggttgtcctaggggggccatagggcggttaaacaatttcctcctgaacgaaagaaatgcctaagaccactatcttttccagttggaggcatttccttgattaccgatagactctcattccacgggcaattgcggacttcggctcgggagtcgcaattccgagggaaacggcgcgtacgagcaaacatggcctgcttccttctcggaggggcacccccggggatctctccttttgtgcaaaacaccacccaaaaatagcgcttgagcatgaactatctgctcaatgaaaaggaatgtgagttggctttccatggggccccggataagtaaggtaacaaaggttttggcacagtccgctagaatgagagtcggaaacgatacgacacacattcccttgcaggaggaatttggccacagatgggtcactccagttttgcccgggagcttggacgaagtggacctctggaccccccgcggcacacgagatggaggaacatggaacacagtacaacaacaagcaacacaggaagagctgtgcccaacaaggtgaccgcacaagaacaacagacaagaaaaaaaggacgggcctcaaacagcaccccgcgcacatcaaacgaccggtcgtacaaagcacacaagggctacaacgcagcaccgactacacaccgaataactgcagtaaccaacaggccaaacacgaccgcgcgtaccgatacgac

SEQ ID NO: 589615 - DNA, 446 bp, Homo sapiens
acgcacgtactgttcctacaagtgactcagtgtgagccacgcattgctaactgtcttaaccaatgccttcctgctacggcacaccctcatccaacccttcatgttccgcctgcacaatcggtaccagcccatggaacccaacccccgtgtccccctcagcagggtcttttttgcctcctggagggtcgtgctggaatgtggcattgcgcccatcctccggtgcctcatggccacccctgccaagctgaatctgtcgaaccacattgcagtggatgagatccggtagcgattgtttgatgcaggtcatgaggcttgggctggacctgcttgctctgaacatgccgcgccccagggaccacgggctcccaggatacaatgcctggaggcgcttctgtgggctcctgaagcctgaaactgtgggccagctgggcacggtgctgaggaac

SEQ ID NO: 589616 - DNA, 656 bp, Homo sapiens
  misc_feature (68)..(68): n is a, c, g, or t
  misc_feature (241)..(241): n is a, c, g, or t
  misc_feature (401)..(401): n is a, c, g, or t
  misc_feature (420)..(420): n is a, c, g, or t
  misc_feature (423)..(423): n is a, c, g, or t
  misc_feature (504)..(504): n is a, c, g, or t
  misc_feature (622)..(622): n is a, c, g, or t
  misc_feature (643)..(643): n is a, c, g, or t
acgagccacgcataagccaaggtgaacaggcagccgcaggaagggcgtccagatgggtgagtcgctgngaccctgtgcagactcccgaggggcggtggagcccacaggctcaagacccaccaggcgcttcctccccgctggtctacagtgcctgaaacgtgggcctccccgacgcgggcagtgggtctgttggagtggccagaagggtcctgttagggaacctgtggatggctcaggattntagaatactccgagcctggggtgcccagagagcggaccttcggaacccacatgagtgtctctgcttgtgactcccggcagctccttaatcctaaagaagccagatccgaatcttgccaaatggagccaggagttctcgagccagcagagagcgatggatntcacccgcagagggatcangtntaggagcagaatacacctgcagctgccctagcaagtgtggctctggaggccaggcgagagccactcctctcgtcatgctanggtcgtgcagagctgctggtaagcactcagagcccagccgccagttgcaacagtgaggcagatctgccttgcagtacacagatgtcacccatcgtgatagccaatgctgaacagaccngaccctcagttctttatgagntattagacagacg

SEQ ID NO: 589617 - DNA, 131 bp, Homo sapiens
tccagcatccccttgcattttgtcgcccacggctcttagagtgaaatcaccacattttcagtagattgatcgaatttgtgaaatgtgaatccctagggaaggagtgaagtgcaattcccagtatgagaaga

SEQ ID NO: 589618 - DNA, 330 bp, Homo sapiens
ttaatcatttaaagaacaaatgccaatcatactaaaaattcacccaaaaaatagaggagtaggagaaaattccactcattttatgagggccagcattatcctgatgcagactgtatcaccaaggccaatatgccaaatatagaaaactacaggccaatgtgccaaacaaatacagatgcaaaatcctcaacaaaatactagcaaaccaaattcagcagcacattaaaagtaaaatacaacatgacctagtagaatttatccttgggtataaattgggatggctcaatatacaaaaatcaattaaggctcaatgggggatggagcacccat

SEQ ID NO: 589619 - DNA, 272 bp, Homo sapiens
caattttgcccctgggggatgaatgaaattttgggctttttcaaaaagtaaaattaaattttttccactgggggggagaccctttttgaaagaagtatggccaaaagcactttaatgctgctgacatttttgtttttatttttatttggtggggcgcaagaagtgctgacacaatgggttttttttgatgtatttaaggtgatgtatttgcttgagttactcctgtttcattggtcttgatattgggaactaaaattaaaccttgttgggga

SEQ ID NO: 589620 - DNA, 137 bp, Homo sapiens
tagaggatcccattggaagagtgctgtcctttaacataggtttttaaagactaggatattgagtgtgaaacatccgttttcattgttcacttcttaaaccaaaaattatgtgttgccaaacaccaaacccaggttca

SEQ ID NO: 589621 - DNA, 345 bp, Homo sapiens
ctagattctaactaattgaattatcatgtaatctgcaaataataacatcttatctattatcatctattttttttgtttctttttcttgccaaactatcactaactaagaatcacaataaaacccacaaagaaagtattatatgttgaccggaggtgaaatagacgtatattgttcaaggtttcattcactgtgtgggaaatgatttgtcatctgttggctcatgtgttatgttagttacctattgctgaataacaaaataccccaaacttagcagcttaaaacagcaataaacatttatgatctcccacagtttctgtgcatctggatgggtttagctgggtggt

SEQ ID NO: 589622 - DNA, 1180 bp, Homo sapiens
  misc_feature (70)..(70): n is a, c, g, or t
  misc_feature (1093)..(1093): n is a, c, g, or t
  misc_feature (1180)..(1180): n is a, c, g, or t
catctccacggcaaaaaaacagcacaagacccaccacttttggaaaaaaagaaaaacccaacgctcttgncggggggggggagaaaacccccggagaggtaaacgatcggtacgataatgcgggaaatttcacgtcagcactacaaggactcttgggcgcggcctcgcgcataggtggcccgaaaatcatccgacaatgcccctgagacacgacatgacgttcaaaacatacacacgccacatccccgctcgacgccatcgagacgagaagcaatccaccaccttccacggcaccggtacacacaccttctggtgacgtcactctcccagacggaggtgtactttcgagtcgtgtgaattttcatattagtataagccatacaacgaattgtagcacacgaactttacacgctgcaagtaatacaccgcgccccgggaacgcgctctacaaagacactgtccccccccacgccagacctagcaacccccataccaacgaactccgtacccgtcagccggcattccaactgttcgttacagccgcgaggcgggagatgcagaaacaccgcccattcacgtatcgattagacacacgcaccacatatgacgacccccctcccatccacacccctacctcccttccctccctcttaccgctcgccctcaacccatgcccggcgacgcgcccggcccccatccccccaccgcccccccccctagtgccagacagcacactttcacccccccccccacttcaccccgaacacccacaacacccccaccatcctgatatcgcccccccccccccgtcactgagtcccgcaacaccccttgcccccccccactttccccaatctcctccccccatactgcgattgcaacactcaaccgcactccgcctcataaccgctcatcccaatcctagcatgtacataccgccatcacataccgccatcttaccgatccccacccctagtcccgtgtcaccgtcaactatacaaccgccccttctccacccgatcctcatgtgacgcgattggtccgacccccttaaattcgcacgccgcccgcttccaccgtgccgcctctctantatacctcatcatcacataccgcatgtcatctcgatgttaccgtacgctgtcgacatataatgcagctccactctagtactagcagn

SEQ ID NO: 589623 - DNA, 240 bp, Homo sapiens
agtgagtgtgtgtctaaacagtgattccaactctatgtgtcagagaaaacactattgaccctgtactgtgtttacagtaccctgctgacagtgtactgtcgtatcctcagaccttgatcctatttctttattttacactttacagtagattaggtctcaagattatgagaatctccatgagctttcagagggctaaacttttctcgccattcttattgctacttactcgatacacaggga

SEQ ID NO: 589624 - DNA, 944 bp, Homo sapiens
gtcccggacgtgggtagttggtgggccgggttctgaggccttgcttctcttgagttttccactctaggccaccgatgccgagtagcagacctgggaggagtgcagcgcgctgcgagaagctttacctcgctgaccctatgaaggcacgtgtggttctcgagaatataggcatgctgatgggaacttgtgtgttagagtaacagatgatttagttggtgttggtgtataaaacagatcaagctcaagatgtaaagaagattgacgaaagttccacagggcgaataatgcgagttatggtagccaaggaagccgcaatgttaccatggaaactgagtgaatggttgaaagtgaagactgggtcgtgtacttaggaagtacatatctgtttgaaattagagaaagtgtctgggacagaaaagtactgttatgtaacctaagtgggctgttcgagaagcttagaggtcattttgtgtaatttttcttttgaagttactgtagagagctagggatgcaagatgttttcaggttagaaagcctttatgtactttgggaagttgaacgaggaaatgcatctgtcttagaaactggagattagttgatgttaagggaaaacattgttggtgttactctgggatagtcgtatccagctcgtgtggacactgagaactttcgggaaaccccacttctgcttaagtttaggtccatcgttccttgacagaccttcaactgtagcatttggccgatccagctctcgggcataaaggttctggggccactacatcgaattgggctggcttaccacccccagtgggggttacacggggcgcagagttaccggcggcaattgggtcgtacaattgtgtccagagcgtaaaggaggacggaacagatactcgaccaaggtagggaagccaaaacactcccgggatcacgtccataattaa

SEQ ID NO: 589625 - DNA, 837 bp, Homo sapiens
ggaagagggtgatcctgacccggggaaggtcgctgggcaggcgagttgggaaagcggcagcccccggcgccccgcagccccttctcctcctttctcccacgtcctatctgcctctcgctggaggccaggccgtgcagcagtctgaatgacaggaggaactggagcctcattggcctggccctggggcgcctggcctcgggcttaatataggagctcctgggctctggcttgggacccgacctgctgcctggccgcgcttcccgctgctcctgcccgggtggatggaagaacccctagccctggcctgctgcctggggcaatggccctctgcagctctcctcctggcccactctcgtgcgcctgcacggcacagccatcttggaggggagagtccatcttgttccagccagaagccccggaccaaaatacagccatcaccttcacgggcaagtggagccaagacggccttccccaagcagtaccccctgttccgcaccccctgcgcaagtggtcttcgctgactgggggccgcgcatagctccgaatacaagcatgtggaggaagaaccagtacgtcagtaacgggctgagcgacttttgcggagcggcggcgaggcctgggcgctgatgaaggagatcgaggcggacggggaggcgctgagagcgtgcacgaaggtgacaacgggcggcccggcggtacccaagcggcaccgggcagaccgtcagagcggaactggagggtgaagcgcaaggcactcgctggactcgaaagagggtgcgcaatcgtgccaagccccagaagggtcgagagcagtgacagctggaactgtgcaagggg

SEQ ID NO: 589626 - DNA, 891 bp, Homo sapiens
  misc_feature (873)..(873): n is a, c, g, or t
ccatgcggcagacagctttgaggacaatatttggagggatccttcagaagaggtctcggacacgacctgtctcaggactctgcacagcggtcaacccaattctcggccaatgcccaaacctattaaacaaatggacaaattcgggcctggtttaaaggggattgcctcttcccagaaacgggagccttgcgaacagtgattattttcgctcccaggttactttctaatgggggggctttgtgcgccctgtggactcggcctcgagggttacacaacgctttcctcttaatttgcttcttagatagagagggaatagggatatctgaggttcgacaaacatgcttgtcctcgtagacctctcatccgagttgatctgaattctccgtgacaggcgattcgttcgccccactcggctaaaatggtcaaactgtagacacagtttctgttccccaataatataaaggctcttgggagttaactacacgtgagggtagtctgagcaatgactagaggatttactgaacagagacgtcgagcgaggaactgaagactcgtactgttgcctcgttatgcacacacagaccactggtagtgcttgcactcttacaagtccacagccgtagcattaatacaagaatcgggttgggtcgaactttacacaacggctactgttcttgggaatactttgttagatatacttgttcaagaattcctcaccatagctatttcccatcaaattctgagcggagcgtgtatgtaacacacatcgactcatagatgtagagtgtggattatgaactgttaaagttatacgttgttttatactgttgcttataataaagaagtgttctgcattcgtcacgcttgacccgnggctgccactatcctttg

SEQ ID NO: 589627 - DNA, 210 bp, Homo sapiens
tgcgctattcgaacaggctacatgatgctgacgacactgctgggctgcaggcatggctgcagccagtaggaggtgtactccacgtcggccatgtaaatgcgcaggctgccatcctcactcagcaaaatcatagacgtccgctgctgcacatagcaggccgtgtgcctaatagcaaccatgtcttttttttccgctaaaacaggacgagtc

SEQ ID NO: 589628 - DNA, 110 bp, Homo sapiens
  misc_feature (77)..(77): n is a, c, g, or t
  misc_feature (83)..(83): n is a, c, g, or t
  misc_feature (94)..(96): n is a, c, g, or t
aatgtggacatgagaatttacacttaaaaattggttataccaatgtggatgagtgtaaggtgcacaaagaaggttanaaaaanttaaccagagnnnacaaccaaaaaaaa

SEQ ID NO: 589629 - DNA, 486 bp, Homo sapiens
  misc_feature (67)..(67): n is a, c, g, or t
ggtacgacggcagcatctatctagttttaaaggacttgaaggaggctgtgatggaagggcgcttgtnggagtgaaaagagctctgggctaagaatgaaggttcccaggctgtatttttggcaatgttcttagtaagtgtcagtgagtgatttatcttttcagagtttctctctctccatctgcaaaggcagacaaattgtctcttgcaagggtctgaagcatccaaatatgggaacacttacgaatgcttttcaaaatgagatgaagcccctctccatgtggtgttggagaaggcacttgatgtgggggcatttggtggtaggaagtgcttcagactggagcactccccatggatagaatgtccctgaataacacagcagaagccacatgaagggcctgtgcagtctcatgacgcatagaggacttgtgtggaccagtttgtcctctcctatgaaaatgaatgaggtttgaaatgcgacctgtgac

SEQ ID NO: 589630 - DNA, 1423 bp, Homo sapiens
cgtccgtgtgtgttcccgcgtctggtgggtagcatcgccgtgtgctgccgctgtttgcccgtttggggcgtgtgcctttgtcccctcgttatgcgcatggttgtcctcccttcttccatttgggggggctggggtaataagggtgtatgggcccgtgccttttcgccaggcggccctccacacccgaggcctcctcggggggtctcttcctccctttgtgggggacaccctccggtggggtccggggccgcagaggtatcgcttggcgcttttgaccccgccggagaagggtggaatctcccgacgggagggaatggttttatcccccctgaccctactcccgtccttgtgtgagcccgacgagaaatgtgggcgtcggtgtacccaaggtttttttcagacctttttaaaaggagaacatccctcttggcgacataaaaatgggttaagtgtggccaatagtggtgttaaggatgtctgtgttccactcttaggagaggtttacgccccgcgcagctcttatagagagttgtgttagaaggacgcccctcccttggagacccccgcccaaatttgtgtggtgcccccactgcttgtctagaccccccgctgtcacacaagactgggcttgtacacacgaaacttgggagatgcacatgggtggcccccccctcgtatatggtttgtagaggggtgagcacccacactctaaattgtgggctcttttcctcggcctctccctctgtagaagagagaaatgcataaagagatatagacaagagctcgtggtttgtgtgtgccccacgctcgagattttatagccgcacatcgtggagaacactccacttctccgactctagccccgctctcttttctcggggtgttttgagaaggctcgcctcgtgtctctctatagagagcagtgcggccactctctccacacattgtggctcttgttatatccacgctccacgctgcctcgcgaggagaaattctctgagaatatggcttatatggacacaacaacacttcttttataaattttagataattatattttttgagaaactcttgctcttggggtttgttggcacccctcggccaccccccattctggcttgtgacgcacgccctctctgcacgttccgctcggggctggccacgctttgcttgagttcttttatagtttcctcttccctatcccacgttccccactcttttctggtataggttttctaggaggtctcgttaaggtgtaacactcctcgcacgcttatttggcttataaaatgtactctcctctttaatgtggttctctcttggggccgacttgggaggaaaagagaaaatccactagtgcacacctgttttgatactgaatattgaccagtgtctttttgaaataaagaacccgtccctccca

SEQ ID NO: 589631 - DNA, 330 bp, Homo sapiens
gttatcatacaaccttcctgactggaacaagctcgtgcgtgccttgtatatgtaacataattgaaccatactttcacacatgctactccatggggtgtattttcatggctacgccttgtgatcttgtgtatatatgttgccatagtgactttccatgatcaccacatggtttggtcaccatagtattatgacccaggtgaaaatctagtgtttgtacaatatatgtagaatgatcactggagccatcttcccagattttctgagcttcagtccaaaaagcaatatttggttcttctaaatgaaaaagggcccaagattttgaacgaaaat

SEQ ID NO: 589632 - DNA, 186 bp, Homo sapiens
atcagctcggacccatgattaatgtgttgatcgttgtgacgcactttcctgtgttctgtgtatgttggggtagccttatggatgtgcagagcacagcagaagataaacaatcgtctgtgaagagggtcatcgcagcagtcaaatgatttcgtattggccattagttcatgataggtttgtttgttg

SEQ ID NO: 589633 - DNA, 1058 bp, Homo sapiens
ggtcttccagccttcatctttctcccgtgctgcatgcttcctgcccacgaacatcagactccaagttcttcagcttatgggctcattggactttacaccaggagtttgccaggggcttctcaggccttcagccacagactgaaagctgcactgtcggcttccctgctttcgaggattctgggactcagacatggattccttgttccttacctgtgtagatggcatatatgagagttcaccttgtgatcgtggttcttgtaaggaatggctggtccccctaaatcttaacaatggacatttctggtacctatctacatgatcgcctgcagtattttaccttctgattggttggcacaaagaattatgcaggattaaaaacttcaatgaacaatatctcccttctggttggcttcagaaatcaggttgtatcggtggaactgtaagcctcccagaccccaatcacatggtgactgtctaaaccgcagtacctcacaatgtgaccttatgggacgataggcatcttagaggtaatccagtaaaccatgaggtcataaggaaggctacccaaagatgaccgtgtcctctcatgacgcacgggaggacactcggcacatagcacccacacacaggcggacaccatccaggtggacggatgaagcagagaccaggcgcggctcaagaggccaagacacacaggactccgaaaaaccaggaatccgggaaggatgaacagtgctcccaagcccccaaaggaaccactccggcaccgtagagagttagaaccagatcaaaacgtggacgaaaatggggcacaagcccccagcgggcctgtgaagcggcacaaaacaagaccgggtacagtggggggaccccaactatgttgggagacatgtgcagagaaagacagagtggaacacacagagagagggataacacgggcgcagcgcaggtgcgggagccactataaacctattcatggttagcgcttcgcccttcttctgtatagaaagaggctgacagcaacaggaggaggagggaaacacaggaagaagcccaac

SEQ ID NO: 589634 - DNA, 89 bp, Homo sapiens
ttgtggtcgcggccgaggtacaccgtctcgatgatgtccaccatctcctgcttgtcctccatggcccagttaatcttgttgttgttgcc

SEQ ID NO: 589635 - DNA, 102 bp, Homo sapiens
aatgttcagtagaatgcccgatatgcgggcacagaacattgcgccacaatgatcagcgtcgatgcgtatgcgaccgcaacagagaacacgccacaggcgccc

SEQ ID NO: 589636 - DNA, 111 bp, Homo sapiens
aacattggttcacgcattactgtgggcttcagtggaggaagtaatgctgagctgcgagcttgacatcacttaccaggagcctcatggaacccagccagcacatgagcaggt

SEQ ID NO: 589637 - DNA, 291 bp, Homo sapiens
tgcccgctgggagctgacctcgatacgtccacccgctggcagctagacatcctgctactcagtcacggcggactggcggacagagggcagcaagcaggcaagggctgcacagcggcacaggcgcctctcttgcctagctactctccactatctagcacgactggcttctctagatgactaacccacaggctctacaagcagcgcttctctagctaaacgtgccctgctgcttcactctgctggcacaacagcttacttacttcttgccaaccactcataacgcctctctac

SEQ ID NO: 589638 - DNA, 441 bp, Homo sapiens
caagcagttaatacagactcatcttgagtatttttggatatggtaagaagtagaagtctagtttcattcttcttcatgtggttagccagttattccaacaccattaattgattagggagttctcaccccattgtttatttttgtcaacttcatcaaagatcagttgagtttaggtatacagctttatttctgggttctttattctgttccatattctatgtgtctatttttatactactattatgctgttttgttactgcagcctttagtatagttgggtaatacaatgcctccagcttgttctatttgattaggattgctttggctatttgggctttatttgggattccatattaattttagaatagtgtgtttctaattctgtgtagaatgatgttggtaatttgacaggaattgcattgagtctgtattaactgcttg

SEQ ID NO: 589639 - DNA, 82 bp, Homo sapiens
cgattgggaatctagcttctgcttgcctttccagcgcgacgcacagtaggagcctaataaatgtttgttgaatgaaaaaaaa

SEQ ID NO: 589640 - DNA, 434 bp, Homo sapiens
tatgacttagaggatcccttcttgcccgtaatccatattgtctggctgagggggtgggggcgatgccatggactagtatggtcagaggaggctgcgtgtcctcttggtgtccctgtgggaagtagcctcatgcatggcactgtctagcagtattagcgacccaggtgtccctgtcacctgctctgtttcagctgttgcagtgcctcagggtcccttacaggccaaaagccatgaggtcagaggcagaacagtccccgtgtgagaatttggcgatcgtgggtgcacgactgcttcccaatctcacagcttacagtcggctgcgccaatcaagtcgtggggttgattttaacaggtcaagctgcatagggacctatcctaccccaggtctgagtccgcaccggttctccaatgtctcttatcccaccatggatagg

SEQ ID NO: 589641 - DNA, 687 bp, Homo sapiens
cctagaggatccccgacgctctctctgtgggggggggatttaggggtgaccctggcaccaggttttctaacagatgacccggtgaatcataatttaaaccggcatatattttatagccagtcacattggccccctcacccgggaaaggtctgcataaacggccccttcattggcatataattaaaagtggatacaaataccactgcagaactggcctctgagcggctacggggggcgcacagccggtagggcagcccggcttggcaaggagcagcgcctctgcggctgctgtgcacagccgggcgcttcaataaaagtggctaacaccacgggctggccctggagttccttccggggcaaagctaagaaccctccggggctaggcttcaatcttagggctcgccggtccggcatcacggggatcatctcccagtaaactagccacacttacatccaggggtcagggacatttctgggagaaagcaggccaggacactgtggaataaaacacacaatagtctctgtggtcttctccaccccaacccaaaccaggcaccctcagcttgattctcctttttaatgggctgtaagcagggaagcacaatgtttcacattctgtgtaagggcgttggtctactaaaatctaacctcagagcccaatctaaactagatgaaagagtggtgcgc

SEQ ID NO: 589642 - DNA, 199 bp, Homo sapiens
taattctactacaaaccacaaagacattggaacactatacctataatacggcgcatgagctggagtactaggcaccgctctaagctatccttattcgagccgagctgggcccagccaggcaacacttctaggtacacgaccacatctaacacacgtaatctgtcacagccacatgcatatagtaactaatctatcttca

SEQ ID NO: 589643 - DNA, 963 bp, Homo sapiens
gccgaggatggccgtcatggcgcccgaacctcctcctgctactctcgggggccctggccctgacccagacctggatgagtgcactcggcaatgaggtattcttcaatccggtccggcccgccgggagccgtctcggggctagtggagaagcatgtgcggttcgacagcgaacgccgcgagaccagaggatggagacgagggcgccggggatagaagcagggcggggccggagtatgggacacagggaagcaccaacggcaatgtgaaggcccacaacagataactgaacgaaatgagcctgagcagacctttgcgcggttacttacagaccagagcgaggcccggtctcaaaacagtccaagaatcaatgtatggctgagacgctgaggatcgagacggtgcggacttacttccgcgggggaaaccgggaagggaacgcataacagaccgcgcaaagcgattacattcgaccgctgcacacgaggacactttacgactcataggggaccgagagaggacaatagagtcgagtcagaactccacccaaaggcgacacaggtgggaagggagagcccattgatagaggaggcagtcgacgcgcctagccatggaattgagcacgtggagtggacgaggagtccggaaatacctggagaacagggaagaggcaacgctggcggagaaacggaccccgcagagaaacttataaaccaacaggaccagtctaggaacacaagcgccccctgaaggtgagagaaaggagcgctcaacctgagaaaaacgagaacaggaaaggatgaggacacaaacaagaaaggagccttgagacacgcagaagatgccccacaacagggaaaagagaagcacagacggaacataaatgacgtagcaagatagaaacaccgaggacgacaacaaacccagaaaaggcagatggagaagctgcccagaacacacaaacgg

SEQ ID NO: 589644 - DNA, 402 bp, Homo sapiens
aagagtacagaaagagtagcctgcatctctctattcatacaggtatttacttgctatcactatattcttccaagccagtgagtatgtctcaagagtgtgatagtgtgacttacacataagtctactaagtctcagaatccaatagggtcgattagttaccacactagaggctaaactgtgtgaggaccacagttaccattcacaagggacagtgaagatactttgggacaggtcacagtgtcacatcaggtcagaggctccgagcaagtataaccacatcctttggaaatccttccatttttgcaatgtccaaacatcctaacttgctgttagatgccagagttcttttatcatctggtctcacttcacagaccgctccccgggagccattagcctacagtg

SEQ ID NO: 589645 - DNA, 103 bp, Homo sapiens
gctcttgcaaggctctgtcttatagttccccagcacaagcagtctcttgccaccgaggctcctcgctgagtgatcttttctatcatggcatggctcgcagccc

SEQ ID NO: 589646 - DNA, 401 bp, Homo sapiens
gagatcaagatcagcggctcacgcagctcgagcagccagccaattgctcgatgcacgccaagatcttcagtcaggcctctggagacgaggagaaacagacaacaccatgttcacacgtaccgcacaaaacgagatctacagccaatttaaacgcctacccaatcccgacctggtgatgtacgtctttcctcatttagcgggttcagacccggcaccgatcccaggctacaccacggtgtttccgctgtatcagcgggtgcaatacgccatgcctggcgaacgcacggaggcatattgatgggtttttttgaacgattcaaaacgcaacgggcgacagagcgtgtggaacctggcgtaacaccaggttcgccgttatctgacgatgtgcagggacccactcg

SEQ ID NO: 589647 - DNA, 251 bp, Homo sapiens
  misc_feature (12)..(12): n is a, c, g, or t
  misc_feature (134)..(134): n is a, c, g, or t
  misc_feature (136)..(136): n is a, c, g, or t
ctgctctagttnatgtaaggatgagggggcggcctagaccccctgctgcccaggccgttaaggcaacactgggttcctggcttgaaagctgtgggctggctgcccttgccagctcaaacggctggcgagttttnancttccctaagggactggcatagggttttttggggtcaatgccaggaacctgggggaaactggatgcttttaatcctaagaagttcatccctcctgctcttactgtttccggccct

SEQ ID NO: 589648 - DNA, 334 bp, Homo sapiens
  misc_feature (53)..(53): n is a, c, g, or t
  misc_feature (92)..(92): n is a, c, g, or t
  misc_feature (110)..(110): n is a, c, g, or t
  misc_feature (130)..(130): n is a, c, g, or t
  misc_feature (148)..(149): n is a, c, g, or t
  misc_feature (167)..(167): n is a, c, g, or t
  misc_feature (238)..(238): n is a, c, g, or t
  misc_feature (316)..(316): n is a, c, g, or t
  misc_feature (331)..(331): n is a, c, g, or t
caaatatcgtcatacccaagatggatgccacagccaatgatgtgccttctccncatgaagtcagaggttttcctaccatatacttctctccngccaacaagaagctaaanccaaagaaatatgaaggtgnccgtgaattaagtgattnnattagctatctacaaagngaagctacaaacccccctgtaattcaagaagaaaaacccaagaagaagaagaaggcacaggaggatctctnaaagcagtagccaaacaccactttgtaaaaggactcttccattagagatggggaaaaccattggggaggactaggganccatttgggtaattntta

SEQ ID NO: 589649 - DNA, 325 bp, Homo sapiens
cagctcacccaacagaggtgagcagcacgcagcattaactgtactcttgcgacaataagaaaacatgagaggaaatacatgaaataagctaaatatgcattaaacatctgtgaataacagttagactgcactacatgaaccaatacacatttagctaggtccatttaagtgtacaaagcactgccatttattttcaaagcgctgagtcaatcagtcaacacacgcctctgacttatgacgaggacgtctgatgctgccacagcgcaattcctatgtgcttctgactctgctcatcagtcacacggagctgatggcttgtacagaa

SEQ ID NO: 589650 - DNA, 1133 bp, Homo sapiens
gtcactacactcttcgctacctgtacttcatcgctatccccaccggcgtgcgaagtatttggcttgaccttcgacgccacaggtcactaagacaagcataagtatgaaaatggtatctagactcacacttgactcttgaatacctgctattcatctgtccttttcgtcggctatcgactggctggaatcgtgtccttccatatcttgatatagatctgattactctatgttgtaacgtagcagaatggtgcctcaacgatcgcactaatgttcttatatagttaacttaatttgtttttggcccgggcattgatcgtaagcacttcggtgcctgatagatactctccgcataatgacgtctcctcgtaattccctccatgaaccaaggctcattacacctcactccctcgcctattggacgtgatccagtctatcatcagttgtgtgagaattctataatattaatatgtcatatattactttgccttctggctaatttccgtgtgagtgcccctgaaagataagttcagcgcaataaactcactcaggcatgtactaaacaatccggtggtgtaaagaatatccacttatacgatccctgttatggacttctacttactcatttcatcctaagactaagtgggcaaaagtactgtagttcatgtttgctactgggaccgaccaagagacgcgccgacgtaacatacggtgactgactcctgatagaagatgggtagcccatccatgccctttggttgtggctgttatgggcgggcctccgccaagttaccatgaatttcccctgaaaacccgttatatatccccagccatgactaacaaacgatgatcggagcacgccgaagtgcgtttgcacttggatgccccggggcaccacgagtacccagagatacacagagaaacctcagttgggccaaagagactggggtcccacaaccatggttccgggaccaaaccccaggttcttgaacaaacaccgggcgaaccagaaaaaaacacactgggcgacgaaagtcgcggaggccaaagaaccacgtgccgcgcacacacacatgtgcgcacccccgggctcacaacaaactctccaaaacacacaccagcagcacccgacacca

SEQ ID NO: 589651 - DNA, 526 bp, Homo sapiens
gggtatctagaggacccctcggctctacctgtattcaaactatagctttgtagtatagttgaagtcaggtagcgtgatgcctccagctttgttcttttgcttaggatgtcttggctattggggctcttttggggttccatatgaatttttagttttttctaatttggtgaagaatgtcaatagtagtttgatggggatagcattgattctatttgggcagtatggccattttcatattgcttctttctatccataagcatggaatgcttttccatttgtttatgtcctctgatttctttgagcagtggtgtagttctccttgaagaggtccttcatgtcccttgtagctgcattcctaggtattttattattttggtggcaattctgaatgggagttcatgatttggctgttggcttggctgttggtgtataggaatgctagcaatttttgcacattgattttatatactgagactttgttgaagttgctcaagaagcttttggggtaagacaaggtagagccgag

SEQ ID NO: 589652 - DNA, 391 bp, Homo sapiens
gctaggcttctggagcatgggagacggaggttgcatgagccacagatatgtggcactgcactccaacctgggtgacagagcgagactctgtctcacaaaaaaaaaagaatcctctctgtaactattggcaaatggtaataagtaacctttggaaaaataagaccagcctgctgggttaagcttagttgtagtaatggggttcgggagatactggagaagggaaatcctagtggtaggaggaaagtctgtagtgatattgccgcaggactctgaccctggacagtacctagaaactatagtactagtggggaaaagctggtacaaggactgtaatgtaatcccgaaggtccccaattgtccggagggtctggatcccattggtctccctacc

SEQ ID NO: 589653 - DNA, 148 bp, Homo sapiens
gctactccacaaacagggcacacaagtagggtcattcacgtgactggactgtcacaatgtggctgtcacgtgaagtgctggtgttgatttccatttaatgccagtggaatgtaggaggtaacactctgttatgtggaggtagcactga

SEQ ID NO: 589654 - DNA, 146 bp, Homo sapiens
attgattctacattagttaaatgtatcatagtggatgtgtgtgtgataaagtggtatcacaataatagcaatgattaaattcgggccaaaagtggattagagggagaatggggaataactgccaatgggtacagggtttctttttt

SEQ ID NO: 589655 - DNA, 837 bp, Homo sapiens
ccatactttgatactgctccatctctttttccagtctggctccagtatttaagactaatatctgctgtgttcttaagcgtacacaggtgtgactgcctattgtcaaatgctgccaacaagactcctttttacgtgttaatatattgagtcgtcacccttttgggttggttgacagagtcatatcacctgtagaaatggatctctcatattttttcctttcccttcttttgcatcaggaagattagttttaatctgcatcatccaaggacaggtctggataagaaggaattaatgatttaaggtgtgaattgttatgatgatgcgaaaacgtaccaccataagggatttttctgagcatttagacatatttccgtggtgataaagaacttccagatttagcgtcagagtcactgtaggtcatctatgagaaattatgcagaatacgttatcagaaatggtgagaaaggcaaagtctgtaattttttggcattttggtataaaagtggcgggttctggaaacatactacccagtaagcttgacattgatgtactagcgaactctaggtacagtttattgaaaatggtttaaggaaatgttaatgacgattaatgagtctgaattttaaaagttcacaatgaatagtgtcatttttgtttttgtttgcttgtgtttgttctttggttttctcgagggcaggatctcgctctgtcacccggtctggagtgcatgtggcgcatgtctcggctcactgcaacctccacctcccgggttcacgcccgagtctcgtgttcacctgatactggcatacaggccaacctctgccccccaaaaaaaca

SEQ ID NO: 589656 - DNA, 110 bp, Homo sapiens
cgcattccacttgaagaggaaccagagtcttctgcccaacgtgtcaaccttgaacaaattgtggactttggtcatgtgaacagacacgggtaactgcgtccgtcgaatgt

SEQ ID NO: 589657 - DNA, 152 bp, Homo sapiens
aaggatggttagagctacggagacggtagcctgtagactgaccgagccgttagctaggttagtccggcaccccttagtggtttttacagtactagaaaagaccttaataattacccacaccgttccttacgcacctttttatttcccgtgca

SEQ ID NO: 589658 - DNA, 134 bp, Homo sapiens
tcccagagtcccctttcatccggcgtcatgagaggcggcttcagcgttatctgcctctccaagcacgttcccaagcaaacaggtttcgatgcactgcattaggtggcagctgcctactagactgcgttaatata

SEQ ID NO: 589659 - DNA, 308 bp, Homo sapiens
aggagtctcgttttcatgagcgagtccatatttagatgagagtgggagaagacatctatagccagcattttcatagtcttcaccgagactaagtgtgaacaaaaaatttaatatggcagtctagtattgtaagctcacgctttaggggagtacattctcaggtcttctttaatgtgggaacggcaaaatataactgccattacatggtaatgggagttaaagaatagagtcctcatgtaaaggttagaacatactttactattagtccttcaaggacagactttccaaatgttcgattctaataatcc

SEQ ID NO: 589660 - DNA, 506 bp, Homo sapiens
  misc_feature (205)..(205): n is a, c, g, or t
tcttggcgggatcttgaaaaggcccgaggtcaaaaagcgcctttgagcccccgccagaagaatccctcgccgaggtcctaaaaaaggaccccctggaaaactttagaatcatggtggagcttaacccctatgccaaggccctggggcgggacccccttttttgcccgggccgggattcccagccccgggggggtaaggcaggtgntgcagcaacggcccttccaacccaatcaaattagaagggggcgggtgccggccaaaagcctgtgggtgggtaaaaaagaaaaaaggctgctgttgggggttaaaaaccaaaaaagcctttgggggggaaaaaggccgccgcctcccagaaacccgccccttaaaaaaagcctgccgagaagaaaccctcttccaagggggagaagcccgggggcttaactttttaattttgtttttccctaaagggccaatccttttgggccggttttttttaataaaggcccggttttaccggccgggga

SEQ ID NO: 589661 - DNA, 710 bp, Homo sapiens
attcggcatgagagagatgctgacagtaggtttgtgctttttacctaatacagggtaaaaacttttatttctacatttttcttcccccattatctctgccaccatcccttagacttcaggagcataatgacccaggtagctagggtggaaactgagcatgtggaccctacatcttttggggagggtggtgaaaaactgtgtcatgtcaggttagatctgaatctctaggagaatagcttttttgatctgtttgctcctttgagtctcccttttactttatcctttgaaaaccaattgcatacttcacttccattgcttccagatatggcatatttttcttaggctactgttgaaatttagcataatatttctcccttacctttctgtccttttaaaaaaataggactatagtaagtcctccgtgtcggtggtatgtttttggaaactgactttaaagaaaacatacaggaagtcctcaaatagtgtcatttcattataatgatgcaaacaaaacaactacctttgttatacgttattttgcttagagtcgcagtttctaagaacctatcgatgttaagtgaggacttaatggtatagacattttgaaatatttgacggagttgcattttggaaaaattgtatagagtcttcatgtctttttttatttctttaaaaaaaattagaatggaattctaatccgataaaatgat

SEQ ID NO: 589662 - DNA, 659 bp, Homo sapiens
gcatgccgcaggctttggacacagaaaggcacgttcagtgcgcgcgcagagattgggtgggcctaaggtgagaaagcgtccgagttcaagtccgggatacgagagactgttctgtagttggacattaacttgaatcactagggtcaacttaactagctgtatagcacagtaggtaacgaaactgatgttcgctggcggtcgatgaagatcaagtagcactgtttccgttacagatacggagtccatgcagaatatccatgtccggtacgttcgctaattgtaggaactgcgtatgtagctgtatgttagatactgcgatcagaggagaagtctgacatagtcataccgatatagccctaccttacattcgctcatgcgatccgagacacgtactatgtcaggagagcacgatgtgcatgactgaggacttggacagcctggctatagagcctataggagacatccaggaagactagatgggacatctatcatacagtgcatcacgtctgcgtgcagacgcacaatgtggcacacacgggtgaaacgtttttgatggctatgagacagtcacgggttacgatgaaagtgtgaattgccgcctttcacacgctgacatgcacggtgcactagggtttatcttcggactttcaacttagggc

SEQ ID NO: 589663 - DNA, 236 bp, Homo sapiens
gtgatgattcagagagtccccatattcatgaaccgacgcgcagtaccctctctatggctaaataatcggcatattgtcgtcatcgcaagtgtgctcggagggtacgtcctcttccacgtgtaaatcgccgcactagatcagcctttcgaagtgctgattatcggcggtgcgcgttcggcgcatttttgaggccaaaccaggctatatgaccatgcacgtggtcaaggaaagtcctt

SEQ ID NO: 589664 - DNA, 1077 bp, Homo sapiens
cccacgcgtcctgctactggggaggttgatggcaacaggagctgagactctgtcttaaaaaaaaaaaaaagttcaccaccatgcttggtttgtggccccatttggactgggaggtggagagcagtgaagcagccggcacgtgatgtgtggcctcccggggcagcagagctgtgcatgtgcatgtgcgggccaggccggagggctctgactggatcctcttggagcatctaataggaagctgacacacccattcactctcttagaatagctgtgcacctgacagataaccagtttcttgttgttggtgagtggtagttaaactaaataaataaagcaggcaacacgaacaggtcttgtccttactgtgacagtcatttgcttgctgtgaccactactatggtctaacacctcccactcactttcctcaatcagtgctgcctgcaatggcaggaactctggtgccaacagagcacctgaccatagcatcagagctcggtgcctgggacaaccataataacccacacgccccatgtggacccaccctgcactttgaaccttatgagaacccacatttggcattgacctagaagcgcaaacgatgatcatacctcacccatgaacgctacggaagcagctacatgggagacatacatgagacaatagtcaataacaatatagaataaaacacacaaagtaacagctggacaccagaccaacacaccggacaacgctgacagacaccctgcaaccacaacgcacacggacagcaccagcagagaggaacaaccgagacacggggaagacacaagacaacacccgagaccagggaacaacgacaaaaccacaacacacaaaacaccagagagcgacaaacgacaacaaaaaacagaacagaaaggcgcaaagcacaaagacgccacacgaccaaagagccaacaacacacaaacagagagcgaagcaaaaccgaacaacaaaggacagaaaacacgaacacaccagatcatcggacaacagacaacgagaagaacaaccacaaaacaggacaacacgacaacacacaaaaccaaacgaacaaa

SEQ ID NO: 589665 - DNA, 444 bp, Homo sapiens
acctaaagcatacccgactcagcctcctggggagctgggactacaggcatgcacccctgtggctggctcatttcttcttatagctgtatagtattccattgtgtatgtgccacaatttgcctatctgttcatccactgatggacattttggctgtttcccccttttggctatgtaaatactgctgctacgaacatgtgtgtacatgtattcgcttgagtacatgtttttcgttctttttgggtatatatccaggagtggagttgctgggtcatatggtaattctatgtttaactttttgaggaaccaccaaactgttttttcctcagtagctgaaccattttacattcccatcggcaaggtacaggtgttctaatttctccacattctaaacaacattcgttttattttattttttttgagacagagtcttgctctgtctccca

SEQ ID NO: 589666 - DNA, 152 bp, Homo sapiens
ggggtaaatttggggttttcttttttcctttttggggggaattcaaagtggggtgggcccctgggcgaaacacagctacctttgttggcatttttttaaaaccaggaacccaggggctttagcccctgaggggctaaatgaaataaagtgga

SEQ ID NO: 589667 - DNA, 267 bp, Homo sapiens
cgacctagaggatcccgtgcgacactgtactatgattggactgactgatcgtatgggcctgtgagtatagattgaatatacacacagaaatgctaagaaaaaaagacttagctcacatattgtttattatcaaaagtcgccagacaatccatttttaaagaaactgatggaaaaatgcttcccctaacatgaactatggttagatagcattgtcttgtcaggagagttcaccaatttcacgtagcctgatcctttattgtggaaaca

SEQ ID NO: 589668 - DNA, 397 bp, Homo sapiens
tgcggtctatctagaggatccctataggcgctagtgtgtccctgcgatactgccaaacctcagagaaggaagcccccctttttttttttggagacagaatctcgctctgtcgcacaggctgggggtgtagtgggtgtgatctcggctcaccgcaacctccgcctccctggcccaggcgattctcctgcctcagcctcccaagtagctgggactacaggcgcgggccaccacacccggctaattttttatttttagtagagatggggttcaccatgtgggccaggcgggtcttgaactcctgacctcgggtgatccgcccgcctcggcctcccaaagtgcgggggtcacaggcgtgagccattgcgcccggttcaaatttacctcttatctccctttg

SEQ ID NO: 589669 - DNA, 345 bp, Homo sapiens
aaaagggaaaagttaggtgttttaaagtccctcaaaatgggggggtcaggggtaaaggcatttcccccctttagggttttcaaacaaactttttacccctttcaagtttaaagcttttatgtggaaaaacaaaaggtgtggggaaaaagggggattttgtgtgtttgcaaaagtgggcgcttcaggccttgggagttggcaaaagggagggaaggaaggaaaccaaaatttttggaaggtgttttttgtacctaagggatcctgccctgaatttccaaagtttcccctgtgaaataaaaaagggaggggtgtgttggggaataaattttgtatgaggcccatcca

SEQ ID NO: 589670 - DNA, 393 bp, Homo sapiens
tgcagtcgtgtttccatcgccacataacctattcccattgccgacaggaaaacctgtaggggtacctcatcccgccgaatggggccctgccctgaggacatagaagcgagatcactccctgtgagcttacctcatgcgtgccataatggatccttagtttggctcatagtgacatgcgccccatcgatgtcagcaggtattcatacttgggctgatacccagggtattggagtcatgttaattccgcattctgagaatgtgtgagtcacattccatacattaaatggcatcctggtatcccaatctgaatttgctcctacatgcctaggcaaatgaggaggatctagactagtgtggttgtggatgctaggagtatggtggctttaatgtctc

SEQ ID NO: 589671 - DNA, 508 bp, Homo sapiens
agttatggaaaatcaaacacacgccacagagcaattttaaccgatagaactagctgcaatctacaggcacacggtaccacggcaggctaattcttagattcttagcaaagccccaaatattttacaattatataatcttggcaaaacattataatcatacacatttgacaattaagactcttacaaaagcaatctcaaatactcttagtcaaaacctcaaccactcaatacttagagagcttcaaccttataaccattagcccctaactatttttcaacattgactcaaacagactgcactctatatcactttacgaaacccgaacacagtacaggtgcattttcacatgccttagagaaaaaaaaccaatgtccattaacatgaaaaaaacatgaacaatggtcacaacaatgtcttacaccaatctatttactaccttttatcaaaaagattctccaacatgcaaagtacctctatatgaactttactcaattatacaattgtaca

SEQ ID NO: 589672 - DNA, 1368 bp, Homo sapiens
  misc_feature (935)..(935): n is a, c, g, or t
tggatactggcctaacatgcttgtgctgtaaaaatagttaacagggaaaataacttgaaatgatggcctagctttgggttataagtgctcttatgaaatttctcagtgaacaactccaagcattaattgtggttaagaaaccacggtgtttttaaatctcagtgttaaggtggcacataaagagttttaagtgaaagtggcactttctcaactatactttctcctcttacgaggctttttctcatgtggtaaattatagtctcgtgggggtctcgtgaaaacttctctctcttaagaggggaaattgtggtcacattttttgtgtgaaatttttattccctatatttcccttcttggggcgaggcttaaagtgggccctcttataccgaaggtgttttaaaacccaacaaaagatttataatatccagtaacacaagaaatataccatacctaaatatattaacctatacgcgtggttctcccagtgtgtcccgagggatattccccttctttcttttcccctttccccacacccgctgtgtaacacacacaaagtgtgagggttcccccaatattttttctctctgtgggggaaagacgcgggggggggggatttgtgagctctaaggaaagaaacacacgtgtctcgctgggtgtttctcccacttttctcacaaacctttgtgtggggcaaatatagtgggccacatttttctctttaaacccttattacggggaaaaggcccccaacaagagggcgtcccgtttgggggcccccaacttcctatgtgcaacccagttgggggggtataaggccaatttttacgccgtgggtaacagcctctccgggggggccctatcccccaaaaagctccaccttttttgtggggggcttcttacacacgcagaacaacctttcccgtgtggaaataacnctccttttaaataaggccctgtgtgccttttcaaaatttttgtggagctctcctataaagtaccctttgcccaaatttcgggccagcgggtggccccaaagaagttaccgctttcccggggttaataggccctttccttgctctgtgttctgcccaacagccaattttgttaacctgtgggcggggggcccagtgtcacttgtggtaacaaaagggcgcggcagtagtacacctttcaggggggcccccacacgcaggggattaaaggggcgccgcgggttcaccacttgggcacatgagacccccgaagaaaaatattcgcccaccaccaaattaacggcgcggcaaactcccttggaggcgacacaacagggcgtgatcacacccactataaacgcgcacaaatccagcagcggtgcgagggggcgcaacc

SEQ ID NO: 589673 - DNA, 166 bp, Homo sapiens
tgaagttaatgtatatttttcccatgtattttattaggacataaatattaactgtaaatagtatagtctatcataatagtatggcctatttaaaatgtttctttagcagatttggacatcactcagcttatttaaactcttttattggttatttttagtattttaa

SEQ ID NO: 589674 - DNA, 421 bp, Homo sapiens
cccagaacccatgccggactgcaagcaccggcagccccagctcatgtcgcgcctctccctccacacctccctggagcagagggagtccgctccagcctccgccagccccagaaaggggaccccacagcgcagtggtgggctgaagggctcttcaagcacggccagagcggacgccgagtccgaggaggccccgagagctagcaagggctgctagcacattgtcacctctcagaagtccaattctcttaccatctgcttagagtttttcacttctttgtggccctgggaactctttttcatatatgagttctggaatatttctggtgataatcttgacattgtacatttggttttggtttattgtggagggagtgaagtcagcatgcttctatgctgccattttagaactggaagtcctcct

SEQ ID NO: 589675 - DNA, 615 bp, Homo sapiens
gactttgttttttaattaatttttgattgaaaagtaaaaattatatatgtttatcatgtataacatgttgttttgaaatatgtatatattgtagaatggctacattgagctaattagcatatgcatcacctcacatttatcattttagtggtaagaacacttaaaatctcttttgcagttatgatttcacattttgcactttatttgcaattttcaaaaatgagcgtgtattacttttaatgttggaaaaatataaaactattacaaaaattgtttatgaatcagatatgggattcacacatgaagaaagcagaaagatgtgctaaatagcgtgttatttatttcatttgatttttatattatataagatcagaaatgtataaaaatatatgttcacttgataatttttcgtaaatatcttaaattaccctttatctatttaaaaaaattgtttagcatgtcagtgtcagctatgctcaattttccccctgcttttattcatccatattatgtgttctctggatttgcccttgcatacactccctttaaagctttcatttaagaaacttttaatcaattcgagggcagttatttgttgactttcacgttagtata

SEQ ID NO: 589676 - DNA, 420 bp, Homo sapiens
tcagtaattataagcggctatcgtaccacggtacgggatagcgtgtctaggtaccggggataacagcaaggaacaaggcagacaagttctctgtgtgcgtgggctacagttacctggaaaatgcttaatgtgtggagaaccctcgttttctgactgatgccagataaatgagtcattactgtatttgggaagtgcaaatagaattttaacgtgttctaatttgtttctcctttaagtggaaataggacaatcatctgaagacataattattttgacgtgaaataatttccagtgggtgcaaaagtgaaatgagaagtctgaatttaggcatgccgttaaatttaatagtatttgaaatagtatctaaactgctgtgttgaggaagtttggctgaaaagtggattttgtcacgttagctgt

SEQ ID NO: 589677 - DNA, 286 bp, Homo sapiens
  misc_feature (34)..(34): n is a, c, g, or t
  misc_feature (40)..(40): n is a, c, g, or t
  misc_feature (42)..(42): n is a, c, g, or t
  misc_feature (64)..(64): n is a, c, g, or t
ttggacctgactgcagtatgggcctgtgactatngattgnanaatacaaacagaaatgctaaanaaaaaaacttagctacataatgtttaatatcaaaactcaccagacaatccaattttaaagaaactgatggaaaaatgcttcccctaacgtgaactatggttagatagcattgtctgtcaggaaatatcaccaattcagtagctgatctttatgtggaaacaaaaatagggcttagtccttattcataagtacagtgatcgaccaaggggtaccgagctcgaa

SEQ ID NO: 589678 - DNA, 387 bp, Homo sapiens
cacccaggcgcacttctgaggctgactttggatgcaatataatacacaagctttaactagatgctagtgatgcaaccgttttcctttacaatatatcatacagtggtaatgcttttaccaagatggcctcagctccggtcagctatagcagaactaccactaaaccaatgtgtcttttatcacgagtcatgaatacaggatcacagtttgtgatggaaggagtgaagaacctggttttgtaacagcacaatctacctggttatctcgtatttctgtacaatcttatggcgatgaagtcatacccctacaatgatatactatcgattttttgattccccatatgacttgcggggcaataacagctcagttcccagacattaaaatcca

SEQ ID NO: 589679 - DNA, 712 bp, Homo sapiens
gggggaggcgaccgccgcggtggaaagtgcaggagtgggcgaggaggaggaggaagaggatggtgagtggcgacggaccaggtgagggggagatgctccgtctagctcagacgccacgcaggctgacgtcacccttccgggtgacataccggctcgtggggccacttgattgagttccggaggcgcaggttaatcaaggcataatggcatggtacttgtaacacagtaagcaaaagacatacagaagataatcagatccaggaaaccaacagaaaagtaactctgtagagcattgaagtgcagcaaaataacaatggatctcaagttcaacaattccaggaaatatattgctatcagtgttgccatccaaaatccaaacaatgtcaccgacagcatcaagtcagtgtgaggacgttgtggtactgggcatgaaatctcagcaagttgtaagaaacttactcaggttttttcatatgtgtagctggaggttttgtatttgacctaatttatgggtatttacaggaattaatattttcagtggagggttttaagtcctgtggtggtaccttaccttagtgcagtttggcttttactccatatttggctaagtagaacttcagcttatttccctggcactatgtgcagatgccgtcattggaaatgttcaagagaaagtatgaaattcataatgcttctaattctgaaatggtat

SEQ ID NO: 589680 - DNA, 543 bp, Homo sapiens
acaccacaggttttttataggagaccacccaaccacaagtgggggacacatgggtctgtgccccgcagcacccgcccgctctctggtcttgccaaagttatgttcatgtggcctccgcccttcatggtcaaaatatagctgtgggggtgcccccctctgcataggatattttttcctggcacgcggaccgacaatcgccaacctcccctgcgtggtattatgtgaaaatgttctgttttatatgtttaataggaagcctctagaacaataatgagcggccaccttattgttgtagtgtgtgcaataatataactacctccctcgaaatgtaggctctcttatctccaatggtgctttgaatagctccctatagccccgcctgtgcaagaacacaaagtttctacaggtggtgccctccacctgtgcagggaaaccacacccccctgatttgtttaacattgattactcctttcgaggcacccgtagtttcactctcaactcccccgcccctggcctcccacaagatccccctcccacaaaaca

SEQ ID NO: 589681 - DNA, 449 bp, Homo sapiens
aggagggacccaggctccggttgataagcgagagtggatcaaatcggcaggtccggttcatctgatggcacaggaatctcactgtgccccttgtctctgcaagcctgattccccattcccagccaaagagaggtcttcgatccctggtcatgctgatttgataccctgtggcattgtgggccctaggctgagagcttaaagcccagtctctcaataatcctaagaatcaagttgagccagacgagggcacaggaccagagagtctctccaggtacgccacacagtctttgagctgtgtcagagctggattgtttacctggggctggctgtatggaggccccaggcattgtcccccacaccaggaaagttggcctgtgggtaactcgtacttgaatgcagacacctgcctatgccatcagggtgacccaggagggtgagaaagcaggaca

SEQ ID NO: 589682 - DNA, 82 bp, Homo sapiens
gacagcagcttctacatctgcagtgctgggacagggctccctctaggctacaccttcggttcggggaccaggttaaccgttg

SEQ ID NO: 589683 - DNA, 351 bp, Homo sapiens
  misc_feature (351)..(351): n is a, c, g, or t
gggttttgctatattagccaggctggtcttgaactcctgacctcaagtgatcctccacctcagcctcccaaagtgttgggattacaggtgtgagccacagcccctggccttaatcctttttttagagacagagtctcactgtgttgccaaggctggtctcaaactactggcctgaagtgattctcctgtctcagcctccggagttgttgggattacagacataagccacaacacccagcctcctcttacttttaaatacattctttcccttattatcctagaagatgaacccagtattttccatgggcttgtagatgttgttggactacttctgtagctgctttatttttn

SEQ ID NO: 589684 - DNA, 255 bp, Homo sapiens
aaaaaaaaaaaaaaaaaaaaattcaaggtcccaaggcttgtttggggggaattggaccagggtttataaaattatcttcggaaatactaaacagaattgggtggcagactatgaaataatttccaggtcttaatttcaacaagggcaatttttatgggtcttttgagggattcccaattcccaggtggggtcccttctcttcgggcctaaacgggtgtctcattccctaataagggggctctcggattaacggga

SEQ ID NO: 589685 - DNA, 956 bp, Homo sapiens
aggagctaccgagtgccgacgtaccttggccgttgatcgtaaggcgtcctccgtgagcacggagcgacaagggacgaagtcagtaccacagaactgcgagcacgtgtcacgctgcgggtatgcgctggaggcctaggcccttagcatgagcggacaattagttgatggtgagctatgaagtcttggccgggaagctaaatactgcatctgctgggcatgtagtagctagtccggtacaccccggacgggaattgtctcagatagcggatgcccaggccgaccggtggctcgacacgaatctaatgctcgagagtcagagttagccaacgcccgggaagtccatgagggtgttggacgagtcagcccacctctcccagagtaaatgtctgggcacgtcccccttagaagtttgtaaataagcaaggtccgaggggtcgacgacgaaagcgttagactacggaaagagtggcgctgtataaacagtagtcttggaaaggactaccaactaagcgtgaaggatactccagaacatggcgatccaaggaggaccccccagggtattgcttgagcgcgcttaaaaagcctcacacaggttaaggatcgaaacaaaatttgtttgctctggcgaaggaccttacttactggaggcacaccatgacgtctaaagacacttgatgagggaggctgagcgtgttgcttttcagtacttctcgctacctaggagggtgagcccctgtttgtctcggtacaatcgaattgaaaacccccgaagtcaaaggctacaatccacgcatacgattgtttgcagggcctattatacgcgtgccattcttcgtgcgaaccaggttgttagtgagcatggggtccctaaaacccacaggatggaacgcacccgggtgtgggaatggtcccccgggggcttggaattgggcgcccataaacaagaggcgcgcggg

SEQ ID NO: 589686 - DNA, 145 bp, Homo sapiens
tgagctcggtacttcaggtctatcttttcacactcactttgctgtgttttcctaagggcctcttgggcagcgactcctccgtggaatgtgctgatgtgtgcagggcattctccaaactattactgacactgctgacaggggcctc

SEQ ID NO: 589687 - DNA, 128 bp, Homo sapiens
  misc_feature (62)..(62): n is a, c, g, or t
  misc_feature (124)..(124): n is a, c, g, or t
gcttccttttgcgggtggcggcgaacgcggagagcacgccatgaaagcctcgggcacgctangagagtacaagtagtgggtcgctgcctgcccaccccctgccacacgaccgcccctctccgcntgcg

SEQ ID NO: 589688 - DNA, 464 bp, Homo sapiens
tgtttctagactgtacagtgggtccctgggtaaagtgggtgacgagacaaaccggcggtcagaaaacagagagagaagtcgttaccactccgcctatgggaaaggagccccttctctttaggtaccaaacaacgggaacggttattgtttttacaacctttcagctcaccgtttcgacaacggtaaccgtagaaagtgcacttggtgcagttttctaggtcccacggagagagacaaccactagtgtggttaagaaggatccaatcgtggaggtcagtggtatgtgtccaatggtcacagcttgaactactttagtcattagaacggtcagagatttagttagacttaccatagtaagtggaactactcccctagccccatcgcctaccacgcccgtagtactcagtggtctactccctaaggaaaacacgggtgtttctagaaagagtgaaacgtgttgaaca

SEQ ID NO: 589689 - DNA, 171 bp, Homo sapiens
ggaaatcaggacacgcgcttcgacatacatacgtacagacagtggacccaccaccagtattagagtactgccgcctgccccggtaggtacctctgcacagcagatggaagctagaccagcccgtacagcctcaccaatatagcctagacgacaggcgtcaatgggtacaca

SEQ ID NO: 589690 - DNA, 193 bp, Homo sapiens
cgcaggtcataatctggccattatctccgctgacggtcccacttctctccaatcttgtagttcacaccattgtacatggcaccatctaggatgaatcacatctgaagatgacgcacttccgagcaggctaagcactggcacttagcagtgtaagagcctgattcagagcattcagttcccagctcatctccaa

SEQ ID NO: 589691 - DNA, 316 bp, Homo sapiens
caccagaaaagggaaagataaacaattattacctatgcatagtattgcaaggactaacccctataccttctgctatatgaatttacttgaaataactttgcaaggagagccaaagctaagacccccgaaaccagacgagctaccttagaacagctaaaagagcacacccgtctatttagcagaatattgataagatttatcggtagaggcgacgaacctaccgagcctggtgatagctggttgtcctcgatagaatcttagttcatctttcaatttgccctctgaaccctcttaatccccttgccctttctggtgt

SEQ ID NO: 589692 - DNA, 1447 bp, Homo sapiens
  misc_feature (72)..(72): n is a, c, g, or t
  misc_feature (74)..(74): n is a, c, g, or t
  misc_feature (1418)..(1418): n is a, c, g, or t
cttttttttgatggtagtgggttggtgtacagtggtgtatgttttttttttaattagatccaataccagctntnacatttcatttatttctctatataatgcaataaagtagatggattaaccgtgacgtttacagatggagcaggggagaatgaagaggcgtcagtttgggcatcaggctggatcttcacactctgacctcactctgctctatcctgcccagtgttgcttcacctgatatcaggggtgcaaggcaaccagatctgacaccagtttcagtttagatcctgcctttacctgggtgtgacccgggtccatctcttcagctcggcctctgctttctcttcataaacttttggggttagtcctcggatgatctctaaaacatggcccaggtgctccttgccagtagagtgtagccggatttggagggactggacactcagtgtgaacaagacgaaggcctcaggaggcagtaaaagctgacaagaggagagaaaatgaagcgcctacgggtgcatactggactagcgggcgaaaggccatgactccttagtttggagaaagaactggggccgagattggggaagtttcccagtgcaattaaaaaaaaaaaaaaaaaagaactagaagaattacccaggtctggcttctttcgtgtagcctggggctgagtcgcaggctgagaaatccagtctggccagtagggggctccaccaagcgcagtctcagaatgcccaagagctccaccgtcgcccggggtctccaccaagcgcagtctcagaatgcccaagagccccaccgtcgcccggggtctccaagaggagtgggtcgtggtgggcgttgaagggccgtaaaagacgagcagcccgcgtccgcgtccgtcctcccgggtctccagtccgcaggcggccgccgcctcggccccgccctcccacctccattcccggccccgcggacccgaacggtccctctcgcaaccgatctgctggctggggcgctggggatgcgaattcctagaagccttaagaggctgcccagcgttggaagttcgtatccccaagaatgctggaggttccggctcacacaccccctccgggcacagagtcagctggggggtgctgggagggagaacgccccgctcctcaccccccatccccgtgcaccctggagcccagctccatacgttcggccaccccaggcggactcggggtggccgggtagcgggtggtggcaggaggggaccgggtaacggcaggcccgagaggaggtcgctgggccgggccggaggcgcacaggggctgcgtggctacctcggcggcacccgccccacctccgccggctaagcccggagggggacggtgagtcagatctcgggcacccgcgggtcgggcggggagggggaggcaggtcagganatgacatcagaggcctgtgctcagggagt

SEQ ID NO: 589693 - DNA, 1379 bp, Homo sapiens
  misc_feature (72)..(72): n is a, c, g, or t
  misc_feature (74)..(74): n is a, c, g, or t
  misc_feature (1350)..(1350): n is a, c, g, or t
cttttttttgatggtagtgggttggtgtacagtggtgtatgttttttttttaattagatccaataccagctntnacatttcatttatttctctatataatgcaataaagtagatggattaaccgtgacgtttacagatggagcaggggagaatgaagaggcgtcagtttgggcatcaggctggatcttcacactctgacctcactctgctctatcctgcccagtgttgcttcacctgatatcaggggtgcaaggcaaccagatctgacaccagtttcagtttagatcctgcctttacctgggtgtgacccgggtccatctcttcagctcggcctctgctttctcttcataaacttttggggttagtcctcggatgatctctaaaacatggcccaggtgctccttgccagtagagtgtagccggatttggagggactggacactcagtgtgaacaagacgaaggcctcaggaggcagtaaaagctgacaagaggagagaaaatgaagcgcctacgggtgcatactggactagcgggcgaaaggccatgactccttagtttggagaaagaactggggccgagattggggaagtttcccagtgcaattaaaaaaaaaaaaaaaaaagaactagaagaattacccaggtctggcttctttcgtgtagcctggggctgagtcgcaggctgagaaatccagtctggccagtagggggctccaccaagcgcagtctcagaatgcccaagagctccaccgtcgcccggggtctccaccaagcgcagtctcagaatgcccaagagccccaccgtcgcccggggtctccaagaggagtgggtcgtggtgggcgttgaagggccgtaaaagacgagcagcccgcgtccgcgtccgtcctcccgggtctccagtccgcaggcggccgccgcctcggccccgccctcccacctccattcccggccccgcggacccgaacggtccctctcgcaaccgatctgctggctggggcgctggaggttccggctcacacaccccctccgggcacagagtcagctggggggtgctgggagggagaacgccccgctcctcaccccccatccccgtgcaccctggagcccagctccatacgttcggccaccccaggcggactcggggtggccgggtagcgggtggtggcaggaggggaccgggtaacggcaggcccgagaggaggtcgctgggccgggccggaggcgcacaggggctgcgtggctacctcggcggcacccgccccacctccgccggctaagcccggagggggacggtgagtcagatctcgggcacccgcgggtcgggcggggagggggaggcaggtcagganatgacatcagaggcctgtgctcagggagt

SEQ ID NO: 589694 - DNA, 150 bp, Homo sapiens
cagtggcatacatatatcaggtgtcacatccgttgctgacatgcctctggctttgcagatgcagtgatcatacactgtcgctgtggatctgagatagtgctgcatatactgtgggcagagggactgatagagaggttgggagagcttctg

SEQ ID NO: 589695 - DNA, 1290 bp, Homo sapiens
  misc_feature (72)..(72): n is a, c, g, or t
  misc_feature (74)..(74): n is a, c, g, or t
  misc_feature (1261)..(1261): n is a, c, g, or t
cttttttttgatggtagtgggttggtgtacagtggtgtatgttttttttttaattagatccaataccagctntnacatttcatttatttctctatataatgcaataaagtagatggattaaccgtgacgtttacagatggagcaggggagaatgaagaggcgtcagtttgggcatcaggctggatcttcacactctgacctcactctgctctatcctgcccagtgttgcttcacctgatatcaggggtgcaaggcaaccagatctgacaccagtttcagtttagatcctgcctttacctgggtgtgacccgggtccatctcttcagctcggcctctgctttctcttcataaacttttggggttagtcctcggatgatctctaaaacatggcccaggtgctccttgccagtagagtgtagccggatttggagggactggacactcagtgtgaacaagacgaaggcctcaggaggcagtaaaagccaggtctggcttctttcgtgtagcctggggctgagtcgcaggctgagaaatccagtctggccagtagggggctccaccaagcgcagtctcagaatgcccaagagctccaccgtcgcccggggtctccaccaagcgcagtctcagaatgcccaagagccccaccgtcgcccggggtctccaagaggagtgggtcgtggtgggcgttgaagggccgtaaaagacgagcagcccgcgtccgcgtccgtcctcccgggtctccagtccgcaggcggccgccgcctcggccccgccctcccacctccattcccggccccgcggacccgaacggtccctctcgcaaccgatctgctggctggggcgctggggatgcgaattcctagaagccttaagaggctgcccagcgttggaagttcgtatccccaagaatgctggaggttccggctcacacaccccctccgggcacagagtcagctggggggtgctgggagggagaacgccccgctcctcaccccccatccccgtgcaccctggagcccagctccatacgttcggccaccccaggcggactcggggtggccgggtagcgggtggtggcaggaggggaccgggtaacggcaggcccgagaggaggtcgctgggccgggccggaggcgcacaggggctgcgtggctacctcggcggcacccgccccacctccgccggctaagcccggagggggacggtgagtcagatctcgggcacccgcgggtcgggcggggagggggaggcaggtcagganatgacatcagaggcctgtgctcagggagt

SEQ ID NO: 589696 - DNA, 337 bp, Homo sapiens
actggctaaataagactataagtagagacaggataatgcatgtatgaccagatcagatctcgaactcacatgggatcaagcgatagggatgtaacatatgatcagggcaaaaggggctgtgctccttggacactttgcacagccccagagggcatcttacacctctgttagtgtggttaatgtacatctgcctgactcacctgagtcaaccaagtgtaacctcagccataacacgtactgcagacggaacggtgtccgcagatcagagtccctctcccatgcactattctgaactttggtcttactaaccaggtttcacagccgcgtagtcagatcg

SEQ ID NO: 589697 - DNA, 634 bp, Homo sapiens
  misc_feature (512)..(512): n is a, c, g, or t
  misc_feature (552)..(552): n is a, c, g, or t
  misc_feature (575)..(575): n is a, c, g, or t
atttgaagttttaattcaggtgaatcaaaatatctgataggatacaatttacaacagttgcatgcaactgatgcaaaagtcattctcaggaaatattaatttttctctcattcctggcagtttgttgatataaaattgaaagaatctcctactgctgaatctaatttaaaaatatatataaccatatttctccattgaaaattagaaaacattaaatctacttatttattttatattactttctatttgccaattatctctgcaaacattgaagtgctaaatacttcgattgtatatgcaagcgtactgaaataaggctgcataagtaaagttttacaccacgtctgcaaactaaaatttcctggggtgttacatttttcctaataaaatcagaggttaagaaatatgattcagtggccatttctacagccgaagtacatgagactgcagccctaggtgtcttgcccacgctcatctagcagacggcagagcctagactcaaactctggttntctgctacacatcaagtattccttctacagtgctcttccnttcactcagcattatctacatanttagaaacactcgaatttctttcccattctgctagttttccccttattacctttgcatt

SEQ ID NO: 589698 - DNA, 372 bp, Homo sapiens
  misc_feature (6)..(6): n is a, c, g, or t
gtcctngtcattgtattgtttcttttctctggtagcttttcagattttcttttgattcttgatgttctatcttacaaaagcatgtgtcaaggtatgaatttactacttttcgttctgttttgttttttgagatggagtctcactctgtggcccaggctggagtgcagtgctgcaatttcagctcactgcaacctccgcctcctaggttcaagcaattctcctgcctcagcctcccaagtagcagggattacagatgtgcaccaccatgctcggctagttttttgtatttttagtagagatggggtttcatcatgttgaccaggctggtctcaaactcctgacctcaagtgatccacccgcctcagcctccca

SEQ ID NO: 589699 - DNA, 634 bp, Homo sapiens
gtaggagctgtgggtgccgcctcgcctccacctgcgcaaggctgcgtaagcggctcctccgcgatgcctgatgacctgcagaagcgcctggcatgtgtaccatggccggggccctgcgagggcgccgagctgcggctcttgtgccatccgctgagctgcctggggcccctggtggaacagtgcctgtgtgcgggccgccattgtgggctcccgtggcctggccatgccgctacacgtgagcttggcccaggccttgaggtgcgagctggctgcggctgcgcggatggcgtgagatgggcaggccgggaccctgctgacgcctggaccgaggtgacgcggaccgcacggtgtcggaggtgcgctgccaagcctggatggaggcagggacaccagacaagattacgccttgcatggcgagaggccttacaagggccgactcaaagagggctggatacggacagccccatggtggaaagaacattgcaggcgccaggttgcgtcacgggccttggtggagaaggtgcaggtgctgacagttgggcaaccaagcgccagcaccatgtgacccaggagaaaaatcatgaacgcacgaaagactggaagacatgaaccccaagacaacccagtgactcag

SEQ ID NO: 589700 - DNA, 242 bp, Homo sapiens
gttgctccagtatgtgtttttatacgtgacgtgctaatctttgcattaagcatttttcccccagtttgaatatggccggcctacattatttccaggcacttggctggattctttttatttcatccagtcttcataatatcaagtagatagcatggtgtccatttcatccttgggggagctcattttgatgggaagagtggttcccccatgatgtctaaactgaaaacaggcctccccacaga

SEQ ID NO: 589701 - DNA, 152 bp, Homo sapiens
gtggaaagggaccgacctacggaggcggtgtccgagaagcctgccttggcttctgccaaggtcatatcgtcccggcgtgaccacgagctggccactccctggacctgctgctacctgcagcctgcgtgggcccactgccaatgtaactttga

SEQ ID NO: 589702 - DNA, 129 bp, Homo sapiens
gaatcatcggcttatagcgtcccgtcactgaggtcatacgcccggcaaaatatgcccccatcggcaagcccatcgccagcggcagcaagtgcaaagcggcgctgtcggcaccggaaccggtcacggtct

SEQ ID NO: 589703 - DNA, 175 bp, Homo sapiens
ctagaggatctcggcgaggcaggctgatcacttgaggtcaggagtttgagaccaacctggccaacatggtgaaaccccatctctactaagaatacaagaattagccgggtgtgcctataatcccactctacgtcgggaggcttgaggcaggacaaccactttgaaccgcagaagg

SEQ ID NO: 589704 - DNA, 487 bp, Homo sapiens
  misc_feature (71)..(71): n is a, c, g, or t
  misc_feature (115)..(115): n is a, c, g, or t
  misc_feature (212)..(212): n is a, c, g, or t
  misc_feature (235)..(235): n is a, c, g, or t
  misc_feature (260)..(260): n is a, c, g, or t
  misc_feature (262)..(262): n is a, c, g, or t
  misc_feature (266)..(266): n is a, c, g, or t
  misc_feature (273)..(273): n is a, c, g, or t
  misc_feature (284)..(284): n is a, c, g, or t
  misc_feature (286)..(286): n is a, c, g, or t
  misc_feature (288)..(288): n is a, c, g, or t
  misc_feature (316)..(316): n is a, c, g, or t
  misc_feature (321)..(321): n is a, c, g, or t
  misc_feature (356)..(356): n is a, c, g, or t
ttctcccgtagttcgtctttagttactaagaaagggtgtaggacacattagccttctggaaacaagtagangccatcacctggcccatgtccctacaaacccatgattgtcaggnaggtgccagttacagcaggtgattcagctacttgaggtcggtaacagaccttccattctcactgaaggtgggtgtgttgttgccctgtactccactngtagtcatctggtgtgtactatnacaacagcagaatctcattatcttnantacncttgccncctttagtcgngntntaaatatttgaggggagagaaatatctnccggnatatttggaaccaaataatgtggtctgctttatangatggccagatctacattaggaaaagtataagccccctccctaatggccgctggggggtgagggcggtgtgttgtatgtctttgggtgtttgtttttttataaagcatataataaaataatcgtgctccta

SEQ ID NO: 589705 - DNA, 126 bp, Homo sapiens
ataacagcgtcgttgactgtgaactaaccccaccatgcacaacccaacagggaacctagactaaccccatcatgcacaacccaacaatggaactaagctaaccccaccatgcataacacaccaggt

SEQ ID NO: 589706 - DNA, 940 bp, Homo sapiens
tggctggatcaggctggtgtggcggagagcggaccagagagcctagcaggccaccgcgcgcggctagttaccatcacaccccgggaggagcgcagctccgcagccggcccagtcaccatcaccgcaaccatagcagcgaggcgagacccagcagccgcccgccgccccccgcgcccgcctaggccgcgaaccaagcccggactaggcagcgggcaggagcggtgcccgggcggcctcacatcggcggcgcctgccggcgggcacacgaaggtcatcgcaacggaaggtttggggaacagtcacactggttcactgtaacgggaaccgggatatggttcattcacagggattgaaccccaaggaagatgtcttttgtccacccaagacttgcccatacaagaagattacccccagcgagagttacctttcgccacgctgttacggcagcattggccgcagccacctggtggccggctttggcatgctcgctcgcacggggccgccacatgcggcttggccggcagggccgccaaacttgtttaccggcgctcctggggtggcctgttccccacggtttccacggcccacgcttacattttgcagccagtaccggtaacccatttattagcacgcgcttatcccacgttcgtagggggttcctcccacgcaattacccagcaaaattacccagacataggtcgagcaggtgggggcacagaggacagcgagcggactcggacagaggtgctccccgaaaggggcagggggcccaaacaaacggccgggccctaccggcaggccgaaagggttccccagcctttcgtaccatttgcgggaggaccccttatggggcggtcagacccaacagattttcaacccttcctgttccaggcggcacagttgattgcccgggtgctgacaacccagtgttgcggagacc

SEQ ID NO: 589707 - DNA, 161 bp, Homo sapiens
cccccttgattgccaacaaggaaaacttttaagtagagcagaacctgaatagacaagacatttctttctttcttttggtagaaaatgatttaccatcactgtgtagttaattgtagactaggtaattttaactttgtgatttattgcccgagacattctct

SEQ ID NO: 589708 - DNA, 1044 bp, Homo sapiens
gccttctgcgtcctgctgagctctgttctctccagcacctcccaaccagtagtgcctggttctcttgctccaccaggaacaagccaccatgtctcgatcagtcaagtgtgtccttccggtagcgggggcagtcgtagcttcagcgacgcctctgccatcgaccccgtctgtttcccagcacccagcttctcctccgtgtcccggtccggtgggtggcggtcggtggtgtgcttccggcgagggtcagccttgcgggtgcattgtggcgtgggtggctcatgttgaagccgagaggccatctacaagccttggggggctctaccgatcatgcgatatccatcaggcacctaggtagagtgcgcaagcgttcacggaatccgggttctgtgtggcttggtgttaggacggctggctagttgtgcattctggagggtggtgccggtacgtgccagttagcgcctactgcgcgggtcgtcacttgtgcgtgggcttgggtcaaggcacgtgcaggaggctggcagctggcgctcttggaccgatgcggtctccggatggagcgtgggctcacacctgggttctggagcgcctccaccagaacgggtcatgcaacccaagaacagatgccattgcctcggtgaattggtgcctgacgctcgacacgcccattgcgcgatggtcaccactccgatgaaccctgaggggatcccaaggcaaagacagactgccgggcactctacactggcagcgagcactacggcaggaattcactcggttagggccagtcgaagccgtggtaacactaacatggctccccttgctgagtgcaagacacaacagactgtccgaggcttgcccctgcacaagccaggctccacgatggacacggaggctatatagcccaccgcacgaatgaggccacaaggagatcccacgacagaaccacaacgggacacccacagaagactggactgagaacaaaaatagcaggcttaagtccgcccgtttccggaatcccaaacatacgtaaagtgcaatccgctacag

SEQ ID NO: 589709 - DNA, 257 bp, Homo sapiens
  misc_feature (98)..(98): n is a, c, g, or t
  misc_feature (137)..(137): n is a, c, g, or t
gggaggggcgagggggggggggggaaaggtcagctgccttccctatccttcgcccataaaaggaccacgcgtgacagagcaatgatgaagtggctaanctgttcccggatacaagaagagggtgcagataactactnccaacttcagatggtgcgacttcagggaaagatcaccttcttccccaccatcccctttcctattccccattccactgtgagccacatccattgcccaataaaatcctccacatatactac

SEQ ID NO: 589710 - DNA, 132 bp, Homo sapiens
tgcttgttgtcgtctctacacggatcccggcgcgcagcttctcactctccagcacagtattgctcgtgtggttggctgccctttgtccgcgaatgcacgccgcggcagaactgtctggatttgtgacgcgcg

SEQ ID NO: 589711 - DNA, 247 bp, Homo sapiens
agatggagtcttactctgtcacccaaggctggaatgcaatggcgtgatcttggctcactgcaatcaccacctccctgattcaagcgattttcctgcctcggcctcccaacacttggggggccaaggagggaccccagatcattgttagcaaaaagcacatatagttggccaagcatatgtatatcatacaagcgataagaacgcataaagcatgtttggggagagcttatttaaaacttgtaaaaat

SEQ ID NO: 589712 - DNA, 1048 bp, Homo sapiens
  misc_feature (77)..(77): n is a, c, g, or t
tgcggtgcacgcggtgttgtggctcttcgcccctgtggggttcccaccctgctgggggtccgcgccctgtgacgcanccgcgctcccggcggagtggcgccagctggccacaacggggtttcaccaacattagtggtgtaccggtttcgtgtttcaaaaaaccgggacgctgggccgggcggcgaaccagccccggacccgggcctccgggcgcggccctgggacccacccgcgagaagccccgagatcccggcccggaaggggaagtgccacgcccggtccccccgcgcggatcagaggatcatgcagacggtcgaagagattgggaaggtggcggcggcggtgcctgtcatcatgctcccgggcgctcgagctcttcctagagttccctgttgaagaaggcctcgccacggtgacccacgttcgcggaaaccgcgaagaccacctgaccaccactcccaccctgagaccacgtgcactcgaagctggaccacgcccgcttgtgaactttctgtgaaggaccctcggtggcaattctgtttcccgaccactgccacgggggaccgcgggaacagaccacacccaccactggaatggggacccaagggccgccccccaagggcgcccggaacgcccaggccacgccggccgcgcccggaagacaccgcgttgggattgggacaccgaaaacgcccaggcacccagaacgcttgtcccgggaccagactccggacgcccgcgaggatgaatctgaggacaccacgagttctgactggggaaagaggagacactcccacacccccacccccacggccacgccaccccctctgcccacctttcacgagccccccgacaccccttcctgcccttcgcctctactctgcccttgcccccagcgcccccgggcccctcagcacctgatgaagaggacgaagaagattacgactcctagccccttttgccccccagaccatagccccttttagattggttttagattgctctggggggaggagagaaggtagaccccttcttaaaatttattata

SEQ ID NO: 589713 - DNA, 1605 bp, Homo sapiens
tggcgtggggcagtttaaagttattagttttaaaaatcagtacttttataatgggaaacaacttgaccaaaaattggctcacagaattttgtgagacccatttaaaaaagtttaaatgtgagaaaaaaaaaaaaaaaaaaaaaaaaaaaaaaaaaaaaaaaaaaaaaaacacaatacacaaaaaaaaaaaaaacaacaaacaaacaacaacacaaaaacacaaatacaacaaaacacaaataacatgaaaaccgtatatatcaccataataatcttaacattatagaactacatccgaatatactacgcatatcacgacatgcagcgaacgcctgacacgcaaacaccactagtatagctctatacgagttcctcctgcctacattatcatctcatatacataatatataaattccgaatacagactagtacaaataaattataggtataacagaaattaaattgattggaatcattgagaagctaaaaaatatactagaatattcaatattagatactaatatataaacataatatttgtaggtatttcaccaatagaccgagtatttaaatcaaaataacctaccacaagctgattctttatctaacagcaacgtgaaccatgagaaaaaaacgatacataattcatagaattatctcttgagtcaactcctcgtaaaccaaaatctactcataataaaacaaatgaacaaatgaagtagatagatttctattgagaatattagaatactacacgacatcaagaaacaatattgtatctctctgtttcattaataaattagaattactaatatcgagagtagtactactaagtagagaagatagaaaatctaaagaataatcaacctatagtaccgatctataataactagtattatatgaattcactaaatatatatatatataagtgtacaatataggaataaatctacgttacgaatatttcaataatagtcaacgacacatactcagactaagtaaaattctaactcacttctaaagattaaacaatagtaaaaatactatcacaacagaccaaagaggtgaaacaggtggtgaaacaggattggaagggaacaaaggcgagacacagagagtgaagagaagaagagcgcgggcaacagagagagatagagagacgagaagacgagtctagtggagcaaaaggtagaggaggtacgtcggtgaagcgagaagagaacagagctaggagggtaagaggactaagtacgaaggaggaagaagaggagcaagtgacgagaacagcggaggagaaggtcacacgcgaggaacgcggcaagcgaagaggcggaagtcgagaggcacggatcgaaagagaggagtgaggagaagcgcgcacgctagtgaatgaggtatacgactgagagagcaaactgagacgcggagacgacataactcaagtcgagacgcggcgagcgaggacggagagagagcaaagagagcgagggctgaggtaggacagaagagtacacacgatacgtaaggaacgtggaacggaaatagtgaaggcgagggagagtacgggcgacagctagaggctggagggcagtaagtgagagggaa

SEQ ID NO: 589714 - DNA, 487 bp, Homo sapiens
ggctcggtaccgattatgctcctagacgggatggcggcgggcagagacgctctcagtttccagactgggcagccaggcagaggggctcctcacgtccagacgatgggcggccaggcagagacgctcctcacttcccagacggggtggcggccaggcagaggctgcaatctcggctctttggggggccaaggcaggcggctgggaggtggaggttgtagcgagccgagatcacgccactgcactccagccttggcaccattgagcactgagtgaacgagactcagtctgcaatcccggcacctcgggaggccgaggctggtcggatcactcgcggttaggagctggagaccagcccggccaatacagcaaaaccccgtctccaccaaaaaaatacgaaaaccagtcaggcgtggcggcgcgcgcaggcactcggcaggctgaggcaggagaatcaggcagggaggctgcagtgagcggagatcgcagc

SEQ ID NO: 589715 - DNA, 103 bp, Homo sapiens
tgctcccaatcagactgctgtttataaccaacaagcaggtccatgtatagaaatccctgatgggacgcccagtcttgctcccatcagatcttgcaacaagagg

SEQ ID NO: 589716 - DNA, 945 bp, Homo sapiens
  misc_feature (484)..(484): n is a, c, g, or t
gggcagtccagcgagctgatcctcaaacgatgccttcccattccatccagcaaggacaacatatgcctgtccccgtctccctacgtggagagtgaggatgcacccccagagaacgaagataaagagcgaggcgtcccacgtgcagctcaagaagtgtctagtcccgcgccaacaggctagagagcttgagccccccgaagacatctgactcggaggagagtgagcgtcgcataaatcatgaacagtcctggagctgccagtcgccgcaatgatgcgttcggatccgagctttctcaggctcagggaccacgtgccggagttggtacagaatgagaaggccgccaaggtggtcactatgagagatagaacggccactgagtgatgtccactcctctccaggccgatggtagcatgcagctttggctggtaacacggcagagaacttgcaggccaagacagatagcacgcgcgtgaacacgataanattgaatcgacgtctcggcatcttagctagacgtcgttctcaagaactggagcagtcactgccacttctgcacatcatgattcagtatctaaacaaagcagttgggttggccttgccaatgctggtttacttgcaaatacgcgtcgccctgtcgagattcgagctctgtggtagcgacaggttaggaacgaacaaatgtgggggttctagctgggaccttggaaagcctgtagttccaggatgctggctgggccctgcatgctccttccagtcagctccgatgaggagtgactaaaaagttggctaacaggttggcgaagccctctggtggccctgttgaaggtcacccttggtgtgtttccaaggtttccaaacaatccgaaaagccattacccttctttagaggaacgtggtggctaagtaccaccggaatgcccgataaggggttgccattgaaaccc

SEQ ID NO: 589717 - DNA, 750 bp, Homo sapiens
gtgggccgcagagacgttggaggccggtggtggctgggtgactggcctcgtgggctgacttgaggtgtccctggccagtgtccttccacctgtccacaatgcatggtggaacatcttcgccaacctcttcaatggtgccttctttgtgcaaaaaagaaatgctgcatcctcatggtgtgtgcctggatgctgcagggaagaccactgatcctctacaatgcttaatgctgggtgagatctgtgaccaccattcccaccataggcttcaacgtggaaacctgtggagtacaatgaacatcatgcttcacttgttgtgtgtgactgtgggttgtgccatgtgacaatgatcctggcccctgtgtgcgccactacttccatgaacacacaatggcctgatcttcgttggttgtgacatgcaattgacatgatgatgctgtgtgaactgatggcccgtgatggatgctcatgagtgatgctggcctgaggacgagctcctgtggatgctgtcctccttggatgttctgccaacaatgcaggacctccccaacgccaatgaatgcggactgatatcacaagacaatgctgtgtgtgcttgcatctcactactgctcaacaggaacagggtacatatcagtgcctatctgtgaccaacagttgtgggacgtgctctatgaatgggctggactttctttcaaattcaactcggaaacaaattgacgctatccctacccttatcctattcctctgtta

SEQ ID NO: 589718 - DNA, 458 bp, Homo sapiens
attagatttataatacgtgcaatatatattttgtagataccccttgcctcttctaaattgtaactcctgggctcaagagatcctcttgcatcagcttcccaagtagctaggattacaggcgtgagcaaccacgctggccgataattttgatttggtatatctgccctcctcctccattgggtgaacgttttttgagagtaatatatgatgttgacatatgaagcctgtttcccaaagtgcctaggacaagtatttattcttgactgcttgtctattatttccttttacccagtacctggtggagctcttgattcataacaagtgctatgtaaatgctaattgtatcaattaatattactgcctacttggagcttcaagtctaatttgaggaacataaagagcaacagaacagagaacacttggtccaacacataataaatttagggttgagggtaccg

SEQ ID NO: 589719 - DNA, 950 bp, Homo sapiens
  misc_feature (206)..(206): n is a, c, g, or t
  misc_feature (947)..(947): n is a, c, g, or t
gcctgcgtagcgctaggggccccggaaaagtaaaagctgcggagctgaacattaccgggcactagcacttcagtatctgctcggaagacctggtgcactatatacccatgttgattgattgagtcgaatgtgtcaccgtaacattatctactagggattctgaccccagttcaaccgagtgcctcctctatgtgtgtggcacgacnttcctactacaaggaaacgaatcagagggttgttaaccatctagctagtgaagtatttgccacctaaacacacatgaattgtgatactaccgtcgacggagaacaaaatggccactgacctataccataagacatcgtttgtcacccttcggtcgaagcctactgtttacacttgtctaggttggccatgatacctgtcgtggacaaggcacgtactgatagttgtctaggagcaatgtgctaccttatggcttggggacctgtccttaattgcgatggacgctattgaaaaggctgtaaattggccctccagtattgtcgacggaatacgaattcattccacctatttgtacttagcaggcagtatgggttaccaagcttgtctgcatagatccagcaaaaagcctgtcctcgtgactccctgaatgagaggccctggcgtaccacaattgggtgtgaccttgcggcctggttggagctggaagctggacgaatatacataatcccggcgcgccaggcccagacttgctgggtgcacatccgggtttagtggggcacggtggtccctcttaaaatgggggcccttcttacacgccctgacacgcgtgtgttgggtcctcagtgtgtgtcccgaaatttaatgcccggggacgcactagatatcgagaatacccccgggcgccagtgacgagagtctctctccacacagcgtgcctcacttccgtacgaacttttcctctnttg

SEQ ID NO: 589720 - DNA, 177 bp, Homo sapiens
atttattttatcaactgcctgaaaggacccaatgggggagggggtttgggccccagcaggagccccggctgccccccttagggcagggagagcctgacccccttgggccaggccctgggtttgtaaccattaacctttttcccccactaaccccaatgaaaacccccttccccgtga

SEQ ID NO: 589721 - DNA, 749 bp, Homo sapiens
  misc_feature (45)..(47): n is a, c, g, or t
aagagtggtatcaacgcagagtgcccattacggccggggacagcnnncctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtca

SEQ ID NO: 589722 - DNA, 1421 bp, Homo sapiens
  misc_feature (145)..(145): n is a, c, g, or t
  misc_feature (147)..(147): n is a, c, g, or t
  misc_feature (303)..(303): n is a, c, g, or t
  misc_feature (334)..(334): n is a, c, g, or t
  misc_feature (339)..(339): n is a, c, g, or t
  misc_feature (349)..(349): n is a, c, g, or t
  misc_feature (360)..(360): n is a, c, g, or t
  misc_feature (600)..(600): n is a, c, g, or t
  misc_feature (984)..(984): n is a, c, g, or t
  misc_feature (1078)..(1078): n is a, c, g, or t
ttaagatcctatcgacttctgctctgaaggctgaagacggaagagggagtgtcagaggcgcctgccagctgtgtcatctcccccagctcagtttcacctgatgaccaccaacataatggggagctgagccgtcattctccccaananggagtccagattgggcctgaggaagccatggagaggctgcaggagacagagaagattatagctgagctgaacgagacatgggaggagaagctacgcaaggacagaagccctgaggatggagagagaagcattgctggctgagatgggggtggccgntaccgggaggatgggggaactgtgggcgtcnttctnctccaaaganagactccccancctggtgaaactctgatactgaaggaaccctcttggatgatcatgagtttgtcgtgtcgtctaaccaccgatcaaaatgagttgggccgctactaccaggagtccgggccagagttatcatatggactattccacatgcctagagccgtgactagggttcatatcgggggtagcagatagactgatctggttcgctggacgcattcgcgcccaagccacgaattggagcgaaggtcggtnggtacactctctggaagcccttgatcgaaagggaagctgtagcagcgatattgtgtaactggggacagccattggtgcaaccggaggtccgactgagctgactgcacacggtgcagggggaactacgcgaagttgctgcaatgaggggcaaggaaatccatcaggttgtttacccgggcgtaatcacattaccaaagctcggggaggccagggtgacaaaggggcatgggtaaacccggtgcgaaacctggacgggcgagttcgccgcgcacaaatctcgcccaagggacccagtgccctcctagaagacaccaagggtacggaatctagggtacaaacctatgtgggcgccccaagcacaggcttgacaatcgtgggctgggngagggcccatcccgaaaggggccagttcaggaagccagtacaaagatggccttgtggggaccacatcggggatgaacaccacaggggcgtaagncagggggacattccttgggaaaggaagaacctccaaagcgtacacacgggggacacagggtacaacaacgggggtaaaacgaacaagtgcactgacacctcgtttaccctgtagctgggggtgaggcccaacgacgcgtgcgacgaaaaacccggggtgactttgcccgggaacactttcgtgggaaccaaggccgggggggagtgtgcaacacgcgcctgtgccaccaaagccggcacagcccattgtagtaacacacgacacgcatagcgagccggcgaagaggggggatccccagcaggtggccatcacccctgatgtagtgcgcgggaccacgcacttg

SEQ ID NO: 589723 - DNA, 310 bp, Homo sapiens
taccatataaggtaagagctctaagactcctgagccactttatagtactggcaacctaggctagggctgactatgtaaagcagccaaggagacagatctagatagcagagaagtcagtctcattctaaaacattgcaactactgttagtgtccaccccatgaagctgtttcagatatgtgtatcttcgactgaattctataaagtatatattgtacagactaaaacaaatgttgctaagctaggttggctgtgcggtctcagtcgtacattgacagactccagctatcaccctctggcgaccttggacct

SEQ ID NO: 589724 - DNA, 757 bp, Homo sapiens
ggcgaatgcgagctgggcccggatcctggaggaggcgtggggctgagggaatggggcgcccgggtacaaggcacggctaaagtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtca

SEQ ID NO: 589725 - DNA, 584 bp, Homo sapiens
  misc_feature (159)..(159): n is a, c, g, or t
ccggaggaatgtgtgcccccaaataagatttttttaagggatggtaagcaatggaaaaatgtaaacaaaggggcaaataatttgggatctatccccggtattcaaaaatggttttggcttgtcatccacacaaacccaggacttaagacaaatgggacngatgtcatcttgagctcttcatttatttggactgtgatttatttggaggggaggcattgtttttaaaaaaaacatgtcatgtaggttgtctaaaaaaaaaaggcatttaaactcatttgaaaaaaacccttttagtttaaggcaaatttaaactaaattgatcctgtagggttcctggaaaagcaaaagcctgattgtaggctactactcatcaattaacttttccagtggagactacttttgggcctggaatataaaaaagaatcaaaggttttgattttgagttgcaataaagggaaagcccatgttcataacagggccaacatttgaagtggggacccttacccatttcatcccccacaacggaagtagttaactggaaaagattcccaaaaaaataaaaaaagactcattcagtggaagca

SEQ ID NO: 589726 - DNA, 369 bp, Homo sapiens
  misc_feature (26)..(26): n is a, c, g, or t
cggacgcgtgggtcgcccacgcgtcngcactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtca

SEQ ID NO: 589727 - DNA, 1004 bp, Homo sapiens
agcggacgggagatcatcttgcgattgctggagaaaatcgccccttccagcgcagacatgacgagcacggtgagggacaagcgcgtaggacacgaccacggcagcgcccgtgttatgtcgctgcggcacgagccggacggacgaggaaagcatacaccagtgaacgcagcgatcgaacagctcggggcgaccacatggccggtcggctggctgcgcgcatcggagcccatggagccgggaacgtgacctcgaggaggagagaagcagaggtgtgacacagtaaagagactaggagacgaatggtagggatgcaagagatagagcgatggatgtcacgttgtgagatacacgtgtacagaaggacaggaataacgagtgcgactaagaacgatggagagtagtccctatatagagatgacttgggaaaggtatgcgagtgaacattaagtggattaaaagcaagtaaagcaagaggaggtaaacgtggattgaaactgcggagaattattgggggagaactcgagcctctgcggttcacccgagggtcgtgacaagaatagtcgtcgcttgcggtgcatggacgccaccaacatggagacctgaacagtatcaatggagtgcgccatgcaaacgcgatgcgggacaccagatgggccgtggtacacacaacggcaagagggcctagtcaatgggtacccggggcacattggtgggccgtcagcacgaccatggggatcgacttcattgtaagtgaccaacacaagatcgtcatgggagcttaggcacggagaaggtcaggcagtcacgtcgagagccgtataggagtctctacactccgaggcattggaaacgtggagaccacgggcacacggcggtccattggtccacctttgaggaacggagagacacgttgcgtcagcagcaactagggaacgatttcacgcaccaaggatgcgcactgttctgtcccttcacccattgggacagaagatgggccgagttgg

SEQ ID NO: 589728 - DNA, 472 bp, Homo sapiens
  misc_feature (34)..(34): n is a, c, g, or t
  misc_feature (82)..(82): n is a, c, g, or t
  misc_feature (95)..(95): n is a, c, g, or t
  misc_feature (98)..(98): n is a, c, g, or t
  misc_feature (104)..(104): n is a, c, g, or t
  misc_feature (109)..(109): n is a, c, g, or t
  misc_feature (114)..(115): n is a, c, g, or t
  misc_feature (119)..(119): n is a, c, g, or t
  misc_feature (192)..(192): n is a, c, g, or t
  misc_feature (234)..(234): n is a, c, g, or t
  misc_feature (248)..(248): n is a, c, g, or t
  misc_feature (306)..(306): n is a, c, g, or t
  misc_feature (318)..(318): n is a, c, g, or t
  misc_feature (346)..(346): n is a, c, g, or t
  misc_feature (365)..(365): n is a, c, g, or t
  misc_feature (367)..(367): n is a, c, g, or t
  misc_feature (370)..(370): n is a, c, g, or t
  misc_feature (384)..(384): n is a, c, g, or t
  misc_feature (459)..(459): n is a, c, g, or t
  misc_feature (469)..(469): n is a, c, g, or t
gcaagaagcatggccaccgaggctccagcttaanggtatttggaggtgagcacggtgctcacagaagccaggaaattgtccngggaggcgtgcancgnaggggntgaanttggnngggnggtgggcggccagggttaccagcaggcagtggcttaggagcttgaagttgaccgggtccacccgaagcttgtncgcgtgcaggtcgctcagggcggacagcgcgttgggcatgtngtccacgtgcgccncggcgttggtcagcgcgtcggccaccttcttgccgtggcccttaacctgggcagagcngtggctcaggtngaagtgcgggaagtaggtcttggtggtngggaaggacaggaacattntnttnggagaagcagagtnaggggtggggtttgggtccggggccaggacggttgagggtggcctgtgggtccgggcgggcgaggagaccgggtnggagcatggntgg

SEQ ID NO: 589729 - DNA, 889 bp, Homo sapiens
  misc_feature (45)..(47): n is a, c, g, or t
aagagtggtatcaacgcagagtgcccattacggccggggacagcnnncctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgctatatgtctgtgtaaaagctagtctgcagatgttgcttgaatgctttgtcacacattagaaacgtcccagtgcacctatgcttgaagacataagtggtggtgtacccggactaatacgatacc

SEQ ID NO: 589730 - DNA, 1330 bp, Homo sapiens
  misc_feature (894)..(894): n is a, c, g, or t
  misc_feature (1091)..(1091): n is a, c, g, or t
cggggttactcgcatggtggcaggggtggccgtcaagacaccccggtaaatccaccgcaagggggtggttaatggcccccccacaaggaaaataggggggggggtggccgtcaataataaacaccacagcagtggtggtaactactcaattactctccccatgggggggtaggctcttttcaatatggggggtggaaggtgaatataatggtagtcactgccccatgacgttccctgcttcgtgggaatatggactttcatacataaaggcgcggccgatttgtattcctgcttgttctgttgtggtaagaagggtgcttctccacacgccttctgtccttaggcgctccacgaaggtgtatccacccccgcgccaaccggactattctttgcttgtggccgctccttttgctaccacaccaactagaggggcgattctcctcatcgtcgccgtctcacaacacgactctcggggccccgcttgtgatgttattatataggcgcgcgcgcttcccgacgatcttctggggggcgataatacaaaaaaggggggcccacaggcaaccacaggggttttataaccgcgtgaaaataataatatatagggaaatatttcgcgtgttttttcggcccccgcttgggtgtgtgggtcccctgcgaaataagaccgcgccccccacgcgtgttgtctctataaagaggtgtggggcaacagacctctttatcccggggcacaaagcgccttctgtggtcgcaactcatcactctgggtgtgtgtaagaccccacaggcttataacagtgtttgtggctcttcgagatagcccctctctcacagtgcgcctgttgtgcacagagagaggagagccagcagagactctgagccgcccacacncgtttgggggggctcctgagagagagtctccctgaaaaatttctcttatccctgtggggttgtgggtgagaagagattctcacacacataccacacatatgtttttttgagagggtaatatctctctcacacttgagatccacattctcactataaggctatatcacgagagagaaatccctgaacacacccacagntggagatcacccacaaaccacgtccaccacaggctacacgggagagaatggcgctggggctgaacaattctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtca

SEQ ID NO: 589731 - DNA, 198 bp, Homo sapiens
cttccattgctatatgcagctccagtgtctcgatgcgggtagggggctcagacggacaagcggttcgaactggcgcgcgtgacctgcgccttgttgaatcttgaaccagggatcgggctcgccctcgagtgagaactgcaaccgtgaccagagcgccttgcgtttgtcgtcatcgtcatacctcttctccgtgacatg

SEQ ID NO: 589732 - DNA, 1125 bp, Homo sapiens
  misc_feature (26)..(26): n is a, c, g, or t
cggacgcgtgggtcgcccacgcgtcngtaaccagctaaagtttgctcgaagccttcagtccgttgcagaggagcgagctggacgccactgtggacaggcgtagcagagcaagagatgtaacatggagctccggcagaaagactcacacaaaacaaaagcaaaaaagagagaataccaacaatagagaccaaaccaataacggcatatacagacaaaaaaaacgtgaaaacccaaagaggagagacaaacaaagacaagacccagacaaaagacacaagagagaagaaggcagaggagcgagaacagtcatgacaaggaccgaaaacaaaaacacagatgaaaaaaggacaaagaagagaacacaaaaataaaaaacaaacacaataaagagcgacggacgacaaacaaacacagcagagagagcataagaaaaagaacaggcacacaaggaagacacaacccatacacacaccatccacgtaaacaacagaacaaacagaataaaggctacacaaaagaaaagaacacaaaaaacaaaaacaagaaaaaaaaaacaagggattggaggaaacaggtgcgaggaggggcatagacgacgaggaggcggggctgagggaggacacggagagaaaggaaggagcgagacagagaggtagaagaaggatagtgggaggaggagagggaatgaaagagaggagacgaggcgagcggcaggaggagtgcgaggaagagagtagaagaagagagagaagagaggagggagggagggagcgcgggaggcgaagagaggggagaaggaggagaggaggtagaggcaggaaggaggggggagaacagaaagaaaaggagaagaagaggagggagagaggggacagggaagggcggagaagagaggaacagacagggagagggagaatgaggaagagaagggagaagaaagagcagaagagttagaggggagggagagagggggagaacggagttagaggagagcgcgtggagaagagggggagggaagaagaggcgcggggagtgaggaggatagagagtgggcggggagggaggtagagagaagagagatgggaggagggagagagcgcggagctgagagggggggacgagaag

SEQ ID NO: 589733 - DNA, 800 bp, Homo sapiens
agcgatctattgcagtctaccatccgccttatgatcgtctatcctcattcagaccatccaggtaccggggaccctgacgtccatcggagataggtctcccatcctgtgcaggccagtagttttggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtca

SEQ ID NO: 589734 - DNA, 949 bp, Homo sapiens
gatcatgtctatttttacatttatgggagccaatgtcatgcgcctagatgatacttacagttttcaagttattaacaagacagtgaaaatggttattcccgcagcttattcagtctgatagtggagattctatagaagtttcaagaaacgttgaagagattgtggtaaaacatcattagtgtatttgtcggatgcgctgccacacgtcccggagcacaggcgcctgcccatccttgatcaactatgtggatacactgggtgcagagaacattcctctggacttctcctcatcttgctatttcagaacagtagtgtcacagaaaacatgtgctggcggcgtgccatatggcgaacaatggatgctagtttaaggaagcacgacactgaatttgggctctcagtctgttgtgagtcggagcgtccagcatcagatacacagcttgatgaatatcctccagtacttaactaaaagctggcagaggaacaaagaagaagacattgcccaaagacagtgatcagtttaatacacgagtgaactcacaagaacgaagactgctaccaggtcccaaatcgtagagacatcgacactagcgagcaactgcggcatcttcaaattcggtcagtgctgcttcaatgttctccagactccttgtcttaccaaatcaattcttcctgaacacaaacggtaagtcacgacgcaatgggtgggtacctgcaaaattcaacagacaggcactctgcaacatgcagggccagcctcgccagaaacgcgcgagcgtcacgcagccatactgattccaagcagacccacgaaggcacaccagacacccaactgcaaaccgggcaaccggccacacaaacaaagaccagcccgtgaacagcccctgcgcgcacaccccgccaccctacagagaaaagccaatcacgacaacgtagtacaaataaaggg

SEQ ID NO: 589735 - DNA, 331 bp, Homo sapiens
tacctaaatggctgttagagaaatgaatgagctacagatgataggatgtttcatgtggtgtatgcacgtgggtagtccgagtacgtcggggcattccggatagggcgagaaagtgttgtgggacgaaagttagatttacgccgatgaatattatagtgaaatggattttggggtaggttcggtctaaggtggaggctgggaataggggaaatcagtgaagtgaagactccttatttattgtggaatacagctcctatttgatagggacattagtggaaagtggagcttacaacgtatgtacgtgttcgtgtaagtaacggaaggtctagtg

SEQ ID NO: 589736 - DNA, 695 bp, Homo sapiens
  misc_feature (45)..(47): n is a, c, g, or t
aagagtggtatcaacgcagagtgcccattacggccggggacagcnnncctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgtaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtca

SEQ ID NO: 589737 - DNA, 327 bp, Homo sapiens
  misc_feature (219)..(219): n is a, c, g, or t
  misc_feature (247)..(247): n is a, c, g, or t
  misc_feature (252)..(252): n is a, c, g, or t
  misc_feature (277)..(277): n is a, c, g, or t
  misc_feature (316)..(316): n is a, c, g, or t
gtgatccacccgcctcggcctcccaaagtgctgggattacaggagtgagtcgctgtgcccggctctctctgattctgatgaccccacagtgccaggctgagcaggctgcccaccatgtgcactgaggtacaagccctttttctttcctgggatccagcactcagaggtagctgtgggtgggcgggccggccagggggaagcagctcccacgggtcctgnagctcccaggcaaccctagaacccacgnagggnaacaaaatcctgggttccaaaaagntcgttcattaaactcgttcaaagtgtggttcactcaggnacccctccctg

SEQ ID NO: 589738 - DNA, 405 bp, Homo sapiens
gaaacggaaaaagggcggggaaaggcgacaaaagaaaagaacttcctagaagcgacctgggcgcactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtca

SEQ ID NO: 589739 - DNA, 1252 bp, Homo sapiens
  misc_feature (45)..(47): n is a, c, g, or t
  misc_feature (759)..(759): n is a, c, g, or t
  misc_feature (762)..(762): n is a, c, g, or t
aagagtggtatcaacgcagagtgcccattacggccggggacagcnnncctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcaaaaaaaaaanaanaaaaaaaaaaaaaaaaaaaaaaaaaaaaaaaaaaaaaaaaaaaaaaaaaaaaaaaaaagaagagggggggcaggcgcacaaataaacatcctcccccgcgagggggagaccagaagaactagcgcagccaggccagccagtgtttgttgttgagaaagagagggggcccccctagaagaggagagagcattatatatcaaacgagcgagcgagcgagcggcggcgcgcgttaaaaaaagatgaggggaggaggagagaggataaaggggtggattagtaggggaggtcatatctatgttggggagaaaggagaacacccaataaatgaggggggggggggaggagaacaacaatatgtggtggagcaaaaaatcattctctacagaagaagaatgataacagcggtcgtgcaagggggaagaacataaagagaatataggaggaggactataaaggggggtggtacaaaaaacagagaggaagtatgtgt

SEQ ID NO: 589740 - DNA, 321 bp, Homo sapiens
  misc_feature (46)..(46): n is a, c, g, or t
  misc_feature (157)..(157): n is a, c, g, or t
  misc_feature (195)..(195): n is a, c, g, or t
  misc_feature (211)..(211): n is a, c, g, or t
  misc_feature (244)..(244): n is a, c, g, or t
aagctttacgcaactcaatctgttctaaacatagagaaatggtatnggtgagaagccataaaaatatgaaaaatgtggaaaagccttcaaatgcttgtcacatcttactgaatataattcttactgcagaaaacccctaggaatattaaaagtgtgncaaaacctttaaccaatgctcatatctctttgcacatnatagcatttatacttnagaaaaattgtacaaatatagaaaatgtagaanagccattaatgcctactccatgtgttactaaatatcagagagtttgtacttaatttaaaagggatctcataaatgta

SEQ ID NO: 589741 - DNA, 226 bp, Homo sapiens
  misc_feature (72)..(72): n is a, c, g, or t
caatagatgggaggctctaatcaagtagataaattctatttttggaattgtgaataaagcagaaaagattcnttggaaactcaggaattgaatagattgatggtacaaatgagagactatatgttgcttaaagaaaacaaaagattgcctatcaggttttaaaatgtgagtcagctagtttatcataggtgattcaatgctgaacagctatcttggttattaacta

SEQ ID NO: 589742 - DNA, 211 bp, Homo sapiens
tcatgctgtagtccaagcattttagaatgcaggtggtgaggatcgtgtgagcccagcccgagaacacaatgaaaccctatttctacaaaaacttataaaaaattagccaggcatggtgcggtggctcacatctgtaatcccaactactcagaaggccaaggtacgaggattatttgagcccaggagcccaacattgcaacacggtctctca

SEQ ID NO: 589743 - DNA, 928 bp, Homo sapiens
ggccgctgcactccagcgtgggcaagacagcgagactccgtctccaaaaaaaaaaaaaaaaaaagaaagaaatgaaaagtgataagggctatgaaaataaaggaaaaaacagaacagggtaaagagggatgggaatgccaggcgagggtcacagtgatcaatggaggcagccaggcaagccctccggccatatgaaactgaacacttgagaaagtcttgatgggacaatgaagggggggcctaaacaaagccaccaaagagaaattaatccaagggacgaaattaatccaaagggaaatcagcaccatcgtctcatttcagatatgcgacaaattgagaaactagagaggtctaggaactggtccgagaccacacaattggatgatagaaccaggtggacacgggggatctgcaagaattccctgccacaagcttccttccctataagtgaccaggatataagagccattcggtataggatcaaatccaacaagtaagctccagaaatcacaggccagaaacagccgcgtgcatttacaagcacacaaggggttaacaaatacctggtggtgtatccagtgccaactttggcaaaacgtgtaaactacccacaacgtgctcctgcagaaggtccaacccttataacctcattccaaaacagggcaaccgagagcaggaggcctgtgaccatataaagatccccttgatacaaacttctagaagtggccaaagcgaggaataaactacgtccaaaacccccgagctggccataactagacaaaaggctccaattatcgcaaaaaaaaccaacaaaaagaagcatcatgaatggttccacacagaaataccaggtggcacaaaaatagcgctaagaacatcccaaactttcacaagacagatggtagaggcataacgaatacgcaatgcc

SEQ ID NO: 589744 - DNA, 738 bp, Homo sapiens
cctgacttcaagtgatcctcctgccttggcttctcaaagtgctgggattacgggcatgaagccactgcacctggcctattttattttatttttttagagaatgaggtcccactctgttgctcaggctggagttcagtggtgtgatcatagcccactgcaaccttgaactcctgggctcaagcgatcctctccacttagcctcccagatagctgggaccactggcgtgtcccactatgcctggctaattttaattttaatttttttttttttttcttgggtaaaaatgggtttcactgcattgtcaaggctatatcttgaaattcctggcctcgaaggtgatcctcctgccttggcctcccaaagtgctgggatatacaggcatgtagccactggtgtcgggccatatccttcatcattctggtcctggctatggctcaataatttttaagagacagggtctctctcgtgtctcccaggctggagtccagtggcatgatcacctctcactacagcctcgaacttctgggctcaagcaactccttccacctcagcctttcaaagagctgggattacaggctgagccactggaggctgggatttcacgtaatattggggtgtatacccagaaagtggcaatggctggaatcattatggtaatcctatttccaagattctctgagagaaccaccatgagtgtttgccatggtggtttgcgccattttcacaatcctgaacca

SEQ ID NO: 589745 - DNA, 293 bp, Homo sapiens
gattgggtgatgggggaagttgcctcatgaatgacttggtgccctcctggaagtgatgagtgagttctcgctgagctcactcaagatgtggttgtttaaaagagtgtggcacgtccctcccccaactctccctctcactccggctctcaccatgtgacacacctgctcccggttcgccttccaccatgattggaagcttcctgaagcccttaccagaagcagatgccagccccacacttcctgtaccacctgcagaaccataaaccaaaataaagctcttttctttatcaata

SEQ ID NO: 589746 - DNA, 355 bp, Homo sapiens
gggaggatacgagagataggattgtggcggttggagcgaggatgcatccgagtatctaacgtggccccatggtgtagtgggcatctgaatgtatctttactacaaatagccactttcatccaaaacagatcatgagccgggacttggacaatatagaacaacggatgtttctgaaaatgaacttgaaaaaggtcacactacgattattctacgtgggttctgagcggggatcctgagcagacctgaccgttgtccaccgcagtgaaaaagaaatcctgccttattttctttctctccatttaaaacggggcaaccttttgcgctgtgttccgtctacggtcgggtcccgaagctc

SEQ ID NO: 589747 - DNA, 334 bp, Homo sapiens
gagccaggcactgcaggggatctgggaaagccaagatgggcaaggaaacccttctatggccaggagtggtggctcatgcctgtaatcccaacactgtgagaggccaaggcagaaggatcagcttgaggtcaggagttcaagaccaacctgggcaacatcgtgagactctgtctttacagaaaaaaataaaatagtggcatatgcctgtggtcctagctacctcaggaggctgaggtgagaggatcacttgagcccaagaggttgagactggagtgagtggagatcacaccactgcactaaaccatccccgacaaagcgagaccctgtatcaaaa

SEQ ID NO: 589748 - DNA, 303 bp, Homo sapiens
  misc_feature (56)..(56): n is a, c, g, or t
  misc_feature (114)..(114): n is a, c, g, or t
  misc_feature (186)..(186): n is a, c, g, or t
gccttcgagcagcgcggtgccctggttctcgatgtcttcggaatcgatgtagcgcnggttgaccttggtacggttggtgatgccggcatgactcatcgcttcgatcagcgactngtaggcgtccagcagctccatgtacttgccgaccatggcgatggtgacttcatgctcggggttgagcttggngtccaccaccttttcccactcggacaggtcggcgccgttgcattgcaggctgaaacgctcgacgacgaaatcgtccaggccctgggcgtgcagcacggccgggatcttgtagatggt

SEQ ID NO: 589749 - DNA, 436 bp, Homo sapiens
aaaatgtcaccatcataaaagacaaaggaaaactcatgcctgtaatcccagcactttcaaagcccacggtgggaggatcactcgagcttaggagttcaagaccaacccgggcaacatagtgagacctcatctgtactaaaattcaaaaaattagccaagcatggtagtgcacacctgtagtcccagctactccagggctgaggtgggaggatcacttgagcccaggaggtcgaggtggcagtgagccctcatcgcaccactgtactccagcccaggccacaagagcacgaccctgtctcaaaaaattataaaaattttaaaagccagacatggtggctttttatcccagcactttgggaggctgaggcaggcagatcacctgaggtcaggagtttgagactggcctggccaacatggcaaaaaccccatccctact

SEQ ID NO: 589750 - DNA, 182 bp, Homo sapiens
tgccaaagcggtagtacccaggtgttggagcagctcacgagggcagacccctgtgttttccaagagctagatacacttgtcagatcctattggccatccaggcagcaaatggaataagattgcctgtgccactgccacagttccgcaggggcctaaggccagcaagcaaatccttgcgagca

SEQ ID NO: 589751 - DNA, 408 bp, Homo sapiens
cacgaggagcctgcggaccgcgacggccctgtcgcggccaaggccgctcccaccgggaacgcacccgacctgctgcccgagcctgggcaggggattctgtgggaggggtcttgaccccgacaacagcctgtatcgaggcctgcggaccgcgacggcccatttcgcgagggccgctcccacagcgggaattcgccacacctgctgccggagcccgggccgatgcctgcacaccctgccccaaaaaaagacgccgcgccggcacgatgcgtgcaggcgcggcgtgagaggacgctgtatcagcggatgatgtcgtacgagtagtcggtcttgcccggaacgatggtgttcacgtcgatcgactcgaagaactcgtcgagcagcatcaccagcacgcgcatgccgccttcg

SEQ ID NO: 589752 - DNA, 251 bp, Homo sapiens
cagagtagggagtccttttgattgctgagtagtattccatggtatggatgtaccacggtttgcttaaccattcacccactaaaggacataagtgtgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactct

SEQ ID NO: 589753 - DNA, 991 bp, Homo sapiens
gcactaccccagacacaaggccctgacgcactgctcctgtcaccttcagcacatcctgtgtcacagctggaagggtgcatggccgctcacctttgttcagatgggtggaaacgctgatgatacagatcctccctgcgtgccctgccacggagcagcattgtgaactggctggtgtttgcagtcccacgtggcatgggctccagccaagcccacagctggagactggacgacagggccattgagtctggtcgaggggcacgtggacgagtgtcccatatagggcgccccacccagacttatacaggcaagtgctgggcattggtcgcgacgcatcgacatcacaagcgtaaagcaagcctgactggcgtctgtgcacaagggcccgtccttctgcatttatatagtccatttctacatcatgaaaacataccgttctttacttataaggctgaggaggacgtgcttggtacggcaagaaaccaacaccacctgaacgacagacgagcagagggggcgaggtgtgtgtccaatcccagccacaacctgcacagaacctgcgggtggtggtgagaaggcaatgttccgtgttttgtgcgcctcgctgggctcgtgtcaacaagaacccgctcgcctcgggcacaatacatcgctggcggtgccgcgtgacggccatctcactcttgtaacatgactagcagagataagaccctgcctcacggacatgcgggcgtcttcacccaaacgtaaataataggctacgggcagtataaccaaaaatccatgtatgccaacggcccttgcgaacaccactaaattcgggctcctcccggcgacgcgcaacagtcgaatcatgcgcggccccctcgaacctactcagcattccaccgcatacatgtgtacactagggcagaggaaacacaatccacgcgttatccacggtactagcgaaagcagcaacactcacccccaccccccccactgcagcggcaca

SEQ ID NO: 589754 - DNA, 220 bp, Homo sapiens
cgcttagaggatccacagacgtctcgctcgttctctctctctctcttctctctctctcttctccccccaacaaatatagctaacgtaatagaaatggagaacaggatacaatgagatttctttcccttctctcacagcacgttggggttggctaggagaaggcaaggtatgggaatatgattatccctatttacggacacaaacaacaaacaaaaaaaaa

SEQ ID NO: 589755 - DNA, 422 bp, Homo sapiens
gctaaccactattcatatccttaccccttcttcctggctgatggaatctcaactttcgcttggttggcaatatgtcaagttcaggggcataaatcataaccagtctaaaccaaagggacaacatgcacgctccccttggtcagattatttaatgtggtgaatttataaagctctctgatcaatacgatggacagaaaatcgacttggggggtgattatccttcccaagtggaggggaggtatatacagacagcccactatgacgtactggacaactccaaacctattaccagttcctgcctctggatggatttgcatgtgaacatgatgcctgtgagacaaagcagacatcttgtggaattcacttggtccactcatcagtgaacacaagtcacagggtcttgagtgatcgtggggatgtaa

SEQ ID NO: 589756 - DNA, 1317 bp, Homo sapiens
ggaggaggtggaggaggaggcggctcgggagagcgagcagcgagctggctggatcgccgagcgcgagtgagggagccgagccgcccgccgccgccgcctcctgcctcccctccgcgaacaggagccctgggcctggggccctggcactgccgccccaagccctgtccctcgggcgtcagtgccgcgagggtagctgcgctgctgagctgagcgagggggagggagagcgagcgagcgccgggaggaggcggcctgtgacctgatgctgtggctgccctgctgcgtagttgtgctgtcgagggggagagcctgatttgccctggcatattctccccttacaatgaaagaccatcagtcagcagaagttcaggaacaagaccaggacgtcctgccgcagagaccagtgttacccgatccaatacagacacgatcggcagcatacacacacacagcctcatgcataagcaacacacccaagtcatacaaaatacaccaacaacactcggacagcgcagcgcatgactaacacaacagattcagtagcagcaagccgctgaggaaaaccaagtgagcggacacgaccgccagaacaccgcgcgaagcaaaccgatgcgggcaggacaaagcaaaacagaacacgcagagagcgcgccaaagaccaagagagacagacaaaactacgaacaagccgagaacagcgaacagagcagacgcacaaggccacgcacgcgcagcaggcagcccccagacaacaccagagaaaacgaagcagcaacagaggacaacgcaggagacaggcagcccagagccggaacgaacgccagcagagcctcacagacagcgagcgacagagcacacgagacacacaagcagcagacagagccaccaagaagctcacgagcgaggcaccccaaacaacagagaagacaacaagaacgaaaacaacaagaggatgagagccaaagacgcaggagacacacacgagccaacgcagcaaatacgagccgatcagccaaaccagagcccgcagcagagagactccaaagacagacagagcaacaagaagcaacacagccaggcaagagagacagcagcacgacataacacagacacagagggcaaaacaaagagaaagcgagcgagacagaaaagaagcaaaggcacgaggaaggcacaaacgaaggagacgggagcagcgaagggaaacaatacagacagcatcgcagacacaggaacagacaggcacacaggacgaggaagagaacacaaacaaaagtcgacacgagaacgaagtacagaccgctaaacaggacacag

SEQ ID NO: 589757 - DNA, 385 bp, Homo sapiens
ggaggaggtggaggaggaggcggctcgggagagcgagcagcgagctggctggatcgccgagcgcgagtgagggagccgagccgcccgccgccgccgcctcctgcctcccctccgcgaacaggagccctgggcctggggccctggcactgccgccccaagccctgtccctcgggcgtcagtgccgcgagggtagctgcgctgctgagctgagcgagggggagggagagcgagcgagcgccgggaggaggcggccggaccgagcgggcgcccgcgcgtgtggcgtgaggggaagccgctgtgggagagggagcggggggaagggcgggacgaggggggggggggggtggtgggtagggtgtgaggggggtggtgagggaaggggggg

SEQ ID NO: 589758 - DNA, 105 bp, Homo sapiens
ccttttggtggcctcatggtcagagatggtccagtatcctgtgcaatctggtgtgaagaccaggttgggtgggcagctgcaggctgccccagcccgttgctttgg

SEQ ID NO: 589759 - DNA, 164 bp, Homo sapiens
gatatgtgtagtataccaaagacacaacatccccctaaataattaaaaaactattaacccatataacctcccccaaaattcagaataataacacacccaaccacaccgctaacaatcaatactaaacccccataaatagtttatgctgtaatagtttatgctgt

SEQ ID NO: 589760 - DNA, 211 bp, Homo sapiens
gaagttgatcatgctgacaatcctagacagccatctccaaggttaagaaaaatcctgatgcactacactggcatcgatatccacagcaggctcttaatggacagaaacacagcctgcgatcaactatgtcaagtactctccagttctgcgaaaaggttatgttgggactatagattcaagtctgtacaaacaaacatgagaagaagataat

SEQ ID NO: 589761 - DNA, 233 bp, Homo sapiens
  misc_feature (202)..(202): n is a, c, g, or t
cctccccctaccacgcccggcccggggttccccggcaggctcccgggggctgccatgcagccattttctcacattttcccatcctggtgctcatgccatccttggtgggttcttccatccagggtctccttcccgggcccatcctggcacccaccacactcactcactcacttggtctcatcactggcacgggctttcaggngggtcaccggcagctcgcacattcggtcaca

SEQ ID NO: 589762 - DNA, 486 bp, Homo sapiens
acagcccaggtatactcctcctatcataactgggatatcactaaatgtagaggcgctccttggcaagcatgccatgctgagaactgggctctggggaggaggctcatggtactcactgcagctatcctcatcaccttgatgggctggagatacggctgcttcagaaagagtgggccctgtcgaagcgtgcttactgatctgttgtcaggtggactggctcaacttggagccctgattagcttagtcacttctggagtcgctctgaacgatggtcctttatgcatgtttgatgtctcatccttcaatcagacacaagcttggaaatatggttacccattcaaagacctgcatagtaggaataatctgtatgaccgttcgctctggaactccgactgcctggagccctctgcagctgtagtctggcacgagtccctctactccgaccttctgtgcatcagactgctccagctactcctggtggtcgtt

SEQ ID NO: 589763 - DNA, 377 bp, Homo sapiens
  misc_feature (325)..(325): n is a, c, g, or t
aaccctaattaacgcctcactgagtagttcaaccatcctgttgtttacagaagccagaaaagaagatcctgtccatcaggatctctttctcctctcatttccaatttatccccaagccctgtctacttgaaccagtacgtttctagtaaaaacttccatttgtttatatttacagtaccactgcccagtctagaggtaccattatctctcgccttaagtaccataataaaggtctgttttcactcagttcatcacctccagtaacttacctaccctcttgccagagttcccatttcaaaaggccaacctggagttcccgtcgtgntgcagtggttaacaaatctgactaggaaccatgaggttgcgggtttggtccc

SEQ ID NO: 589764 - DNA, 111 bp, Homo sapiens
gggggcaaagatggcggcggtcaggtgttggaggcctttgctacgcggtccgaggctttcattgaacaccgcggccgctgccgccgcgttttttacagaaacgacctccca

SEQ ID NO: 589765 - DNA, 106 bp, Homo sapiens
tcagactcaggatgcagatcatattccaggatatagggaagaatggcaaagtatcggctttgctcagatatcttagaaattatttaaagtgcgtacaagaacatgt

SEQ ID NO: 589766 - DNA, 195 bp, Homo sapiens
  misc_feature (195)..(195): n is a, c, g, or t
atttccacaaacctctaatcccttgtaattactttgtcagaggacactctttggacactaggaaaaaccttttggagagagtaaaactttacacccatagtagggcctaacgcagccaccaattaagaaagcgttcaagctcaacacccactacctaaaaaatccaaaccatatacctgaactccccccaccccn

SEQ ID NO: 589767 - DNA, 395 bp, Homo sapiens
gagctcgccaccgatgaagcgtagtaccaacaagatctacaatgacattgcagcatgtcttacacaacacaaatatttaaaacacacatgcacatatttatatttaacttatttatgaatttacaacttatgagaagtgtttgaccacaatttcttttgtctatggagtgatatttattttccatccattgcatgttactgtcatttcttttctcacttttccttttatccttgaatatatactgtgtcaattcatttttttattacttaacattttagaaggtaaggttttcttctcaggatgtttgcatatgattcctaaagctgggtatgtgccactttccttttggttgaaattttcattacaacctagttgggtactacgctttggcagc

SEQ ID NO: 589768 - DNA, 1521 bp, Homo sapiens
ttaccaacgcttggttgtgtgctcccctttatgttgctggtgtggggcctccccacagtggttgccacaaagaaccgcgcgcgtgttgtttactcccgcgtccccctgcttctattttctcctgcggtcttttatagtggtttgccggccgcccttggggggtgcgaaattttcgcgccacacgggggggtcttgtggcccacccttgttgggtcggagcgccctaagagggatgtgggggccccattgtaaccccgtgggggcggcaccaccacaaggaaagggcgccctaggttgttttttggggagccgcccccgtgtatttttcaaggcgggcccacccccgcccgccctgcccgtggtcgttgtctttggatctctttgggcgggcccctatatctgtggggccataattttcacagcgtgttgggcggccttgtggggcccccccgcttgtgggtgtgtgcacaccaacgggcgggcgcaaggtctgtgtgtgcacccccactttcggaggtcttcttactcccccctcgagtcttgtgtccaccgcgcccgttccagaccctccgcccgcggaattgggttgtggagttttttcctctggggcctttgttaagggaccccacgggttgccacccccttgtgtggttttgtgagggcgtttccccccggagaccttcttttctccccccccgctctgtgagggagatgagaagttattgtgaatgttggggcacacccccgtgggacacacctgggtgttttttcctcgagccccccctcgggagagaggagccccgcgtgttcctctgtcccgcgagaccccgcccttttctctctctggggaggaaatttgtggggccctcgtctgtgcgcgagaagagggagccacgcttggctatatctggggctgtagcccacacgctgatgtttctggcccccgggtgggcgcccacgaacttttctcttgggcaccaccgctgggcgccgcggagagcacgccttgtctcttggaggtgggccccaccacatggcccccactgtcgtgttctctcggagatacaccgcggagaggtgtggtgtggcccggccctcggaagaaaggccacttctacaccaagggccccaggcacaggcgagaacacacagggcccctcgagcttgcccccccccgggcccccactctctctcgggtctctcttcttcacaccccagccctgggtgaactcgagaaggtgccacgaacgtggcttcctcgctgaccctcttctgcgggctcccgcggctgtggttcctataaatgccaaagcaccaccctccgcgccgagggcctcgcgccccctcgaccactgctataccctctcttctgagaactgcacacacacctcggagttgtttcttttttaagactcccactcactgacttcctttactaacaccctcggctcagctatattattcttatatactaatatccactgtttttaaaataattaaaatagaaatttagaatcttta

SEQ ID NO: 589769 - DNA, 137 bp, Homo sapiens
agctgcgttcatctgcgggtggtacatgcccacggtgggcgaggcgggccactctactcgaagtgtgaccacgtttagattctgagacgggaagtggagggtgaatagtgtcacggtcggcctttttttttaaaatt

SEQ ID NO: 589770 - DNA, 161 bp, Homo sapiens
gtgttttagaacgggagaagaatgggcggaaaatgaaagggaagaaggaatgatgccgaaaggtaagggtttcctaactcaggtgaagtcatagctgcttaattgatagattgcgctagattgccatgtgctttcgtaacttggggctctgaggtctatca

SEQ ID NO: 589771 - DNA, 931 bp, Homo sapiens
gtcaacctcctctgcagtcggtgtgcggtcccgacctcagtgagcgtcgcgtcgccaaaagatgggcagcagcgccaagtgggtgcgcacagaggcgccacccgtgctgaacttgcggcggaaaaaagcacagtgcgccccctcctcccgtggggggcgcaggacaagaaatcaccagcgggtgtgaactctgaaccagaacggcggtgcgcaagtgccacaaaggaggccaacgaagagcctccgccgaacagagtggtggtcttcctgcccacaggcaaataggagcctcccaccgccaagtatgagcgaccctgggggcgcgcatcactgccagcagcgcgcacccgatttgtcgcgccaagacttgcaagagggcaaaaaaaacaggccgggaagtcaactggaaaaagacgagcccccggggttcataggggccccggggcaccctcctcacgcacgggacacccagggaacacgcgcgagcaacatgttaacaggggccccccctccaccagctcgtgtaaggtagatggaactgcatctagaaacgaccgcccaccctgcgtttggaacgcggctcaacagcaggccccccaccctccattgcacgccaggacactcctcgggagcacgcgcccgacgtatctcgcccagtagccaaaaatgtacaggctaattaggaagtcacatccgtgaccccaattgggcgcagaatgtgggtcgccgagaacacgaaatatgtcaatgaccttttcatgtattcagtgagaaattgttaaacactccaacctatgtgccatggcacgaccatggtcgtcattcgagattgaaacaggaggcacctgttgcttgtgtatctgagccggggggaaatgcagagggcgtcccacagggtttcaggcaaaaaaattcttttacgaaaacatgc

SEQ ID NO: 589772 - DNA, 345 bp, Homo sapiens
ggcaacatagtgagaccttgtccttattaaataaataaataaataaataggttgggcactgtggctcatatctgtcatcccagcattttgggttgccaatgcaggaggattgcttgagcccaggagtttgagaccagcctgggcagaatagcaagactccatctctacaaataataaaatattaaccaggtgtggtggtgtgcacctggggtcccagccacctgggaggctaaggtgggaggtttgctcgaggctgcagtgaactgtgaatgcaccactgcattccagcctaggccatagaacaggatcttgtctataaataaagaaataagtaaaaatataaat

SEQ ID NO: 589773 - DNA, 135 bp, Homo sapiens
ccagttcctgcttcttgaaacacttgattcctctgacagtgcacttcgtggcattgctgtttgtccttggacgaagtctcgggcctggtgacagtaggatggatgtaatctgaacactcctttgtcactaggtca

SEQ ID NO: 589774 - DNA, 656 bp, Homo sapiens
gcggacagatcacttgagatcaagaatttgagaccagcctggccaacatggtgaaaccccgtctctactaaaaatacaaaattaggtgggcctggtggtgtgtgcctgtaatcccagctacacgggaggccgaggcagaagaatcgcttgaacccaggaggcggaggctgcagtgggccgagatcgtgcactgcactccagcctgtgcaaaaagaatgaaactccatctcaagaaaaaaaaaaagccccctatggacatgtcattcctttagccttcttttcaaaaactttatgtaagtctatggttgccccaagtgttatccatgaccttaggcagctctgatgtcaaaatacgcaacaaatgggccaagtgtgggggctcacacccgtaacccaagcacttgggcgaggccacggcaggcggatcacccgagatccaggagtccgagaccatcctgccaaacacggtgaacaccaccatctcccacttaaatatcacaaaacattagccagggtgtgggtggttgcattgcccgtaattccttagactattggggacggccgaggcacgagaattcgcccgaactcgggcagacgggaggctgcaagtgagccgcagatcgggcaactcgactccagtccgggggacacgaatg

SEQ ID NO: 589775 - DNA, 116 bp, Homo sapiens
cgatttctagcaggactcccaaagattaaggatctgtcttaatatacactgtgtcacgtcgctattttcctttttacagtgttttctggacttggggtacccgagcatcaaattcg

SEQ ID NO: 589776 - DNA, 934 bp, Homo sapiens
  misc_feature (11)..(11): n is a, c, g, or t
  misc_feature (110)..(110): n is a, c, g, or t
  misc_feature (114)..(115): n is a, c, g, or t
  misc_feature (160)..(160): n is a, c, g, or t
  misc_feature (171)..(171): n is a, c, g, or t
  misc_feature (178)..(178): n is a, c, g, or t
  misc_feature (182)..(182): n is a, c, g, or t
  misc_feature (203)..(203): n is a, c, g, or t
  misc_feature (217)..(217): n is a, c, g, or t
  misc_feature (219)..(219): n is a, c, g, or t
  misc_feature (237)..(237): n is a, c, g, or t
  misc_feature (250)..(250): n is a, c, g, or t
  misc_feature (253)..(253): n is a, c, g, or t
  misc_feature (259)..(259): n is a, c, g, or t
  misc_feature (268)..(268): n is a, c, g, or t
  misc_feature (273)..(273): n is a, c, g, or t
  misc_feature (277)..(279): n is a, c, g, or t
  misc_feature (283)..(283): n is a, c, g, or t
  misc_feature (298)..(298): n is a, c, g, or t
  misc_feature (306)..(306): n is a, c, g, or t
  misc_feature (308)..(309): n is a, c, g, or t
  misc_feature (320)..(320): n is a, c, g, or t
  misc_feature (329)..(330): n is a, c, g, or t
  misc_feature (332)..(332): n is a, c, g, or t
  misc_feature (334)..(334): n is a, c, g, or t
  misc_feature (361)..(362): n is a, c, g, or t
  misc_feature (384)..(384): n is a, c, g, or t
  misc_feature (389)..(389): n is a, c, g, or t
  misc_feature (396)..(396): n is a, c, g, or t
  misc_feature (399)..(399): n is a, c, g, or t
  misc_feature (410)..(410): n is a, c, g, or t
  misc_feature (417)..(417): n is a, c, g, or t
  misc_feature (430)..(430): n is a, c, g, or t
  misc_feature (437)..(437): n is a, c, g, or t
  misc_feature (453)..(453): n is a, c, g, or t
  misc_feature (456)..(457): n is a, c, g, or t
  misc_feature (535)..(535): n is a, c, g, or t
  misc_feature (565)..(565): n is a, c, g, or t
  misc_feature (759)..(759): n is a, c, g, or t
  misc_feature (808)..(808): n is a, c, g, or t
  misc_feature (869)..(869): n is a, c, g, or t
  misc_feature (899)..(899): n is a, c, g, or t
cgggcgaaggngcttgtctggggggggtgtctggggtgtgcagaaaggtcaggctgggctgcctgtcacatcctgagaccacacgtaaacctttataagccattgtctcngggnngtattgtagcctgaaaaataaagcaaagtgagtcaaacctctggntcccacttccngacccantggnccccagacccatcttcaaggncccctcccgccacngncctgcctcctgatgaagngaagagcttccanagngaatgnagcctcagnagggncggnnnaganatggctgagtcctgngctgcccngnnggaggaaggancatgggatnnanangccccgggactcaggatcaagaatcannagtgcagatggatggactgtanaaatnaaaaaanttncggtaccttancctcacnagctgaacttgantaggaangatcatgatttgcttnaannaagcgaggagaaaaaagaaataaacatggctgtggggatgtgaaagaagtggctgattagggatggaaactggaaagngtcactgtataagcagaagaaagaaggaanccacaaagactggggaaaggatgcaaaaaaaagaataggtgaagaacaaggaacatggagaggccccaaggtgcttctgagagatgaacgagacacctcagtcatggcacactgggtggtgtgcttcccctccaagtcctgtctttgttttacacagtcatatgaaagacataaccccattgcccaaatcaagnctggaggagatgcgttactatatacatttttttctttaaaaaaattttntttttttggtggttttcttaaaaaagcctttgagttgcaggtcaggtgagttggttctggnagtaccggaagttctgttggtatgagaganacttgtctacaggcaggtaacccaagtttgccaac

SEQ ID NO: 589777 - DNA, 183 bp, Homo sapiens
atttttttggaaacctctgcgccatgagagccaagtggaggaggaggcgaatccaagggttgaaggcgcaaaagaggaagttgaggcagaggtccaggtaaaccgttagttttttgcaccttggaggccacaggggcggaaccatggattcccacggttgggattgcttggtccagttgtgga

SEQ ID NO: 589778 - DNA, 285 bp, Homo sapiens
  misc_feature (37)..(37): n is a, c, g, or t
  misc_feature (133)..(133): n is a, c, g, or t
  misc_feature (225)..(225): n is a, c, g, or t
cttcaccccagagctcctgcgctagaccctgcctctntgtcattgataaatggtatcattacacagcccaggccctcctcctggactcctattgccagattaaatgaactatacatttcaaatgctccatgtngcccttggggactttgatcccctggttcccctctttgtctgctgtccctgatcaccccttgtcaccgggtcagctttgtcctgtggaccctnccccttcaatgacctctcttcctgctcaggtgatgtgtaggaagcccagcccccagggac

SEQ ID NO: 589779 - DNA, 424 bp, Homo sapiens
accggctacagaatgagatcgaggacttgatagtcgacgtagagcgctccaatgctgctgctgagccctggaacaagaaagcagaagaacttcgacaagatcctgtgccgagtggaagcagaagtatgagagagtcgcagagcggagctccgagatgctcagcagaaggaggctgcgctccgtcagcagcagagctctcacatactgcaagaacgcctatgcaggagtccctgggtacatgctggaggacttcaagcgggataacaaaaacctgcaggaggagtatctccacttgactgagcagttgggtttcagcggatagactatccatgagctggagaaggtcgaatgcagctggaggccgagtagatggagctgcagtcagcctggaggaggccgagcccttggagcacgaggaggcatg

SEQ ID NO: 589780 - DNA, 364 bp, Homo sapiens
  misc_feature (39)..(39): n is a, c, g, or t
  misc_feature (161)..(161): n is a, c, g, or t
  misc_feature (189)..(189): n is a, c, g, or t
  misc_feature (240)..(240): n is a, c, g, or t
  misc_feature (242)..(242): n is a, c, g, or t
  misc_feature (248)..(248): n is a, c, g, or t
  misc_feature (263)..(263): n is a, c, g, or t
  misc_feature (307)..(307): n is a, c, g, or t
  misc_feature (315)..(315): n is a, c, g, or t
  misc_feature (317)..(317): n is a, c, g, or t
  misc_feature (332)..(332): n is a, c, g, or t
gtccccatgccctttgtcacagctactagataggctganggcaggagaattgcttgaatccgggaggcggaggttgcagtgagccgagatcgtgccactgaactccaacctgccaatagagcgagactccgtctcaaaaaaaaaaaaaaaaaaaaaaaaantacctttgaaaaaaatcccgcacttcanaggaaagcttttttcctgcttggtgtctttccaaagatagaatatttgaancntgtttnctagcgatggtgtgnatgagggtgagctggctgaggcatcgctcaagcgtggggggtgntgtgtaanangcacttggagccacnagaggcacctccctgtgacaagggtgcatggg

SEQ ID NO: 589781 - DNA, 138 bp, Homo sapiens
gaatgagccggtacctctaaaccttagttcagcattactctctgcgtttaagcatgtgcagcaaaaattcagcactcttttggggccaccgaccttgtgtccagccccattgcttggcctgcgcacgacagcccaaaa

SEQ ID NO: 589782 - DNA, 684 bp, Homo sapiens
aggcccagccaccctgagttggataggcttcctctttgggtgggctttccctctcagccccgaatttgtggacaatctatccatgcgcatccatgggccccctccattttcccgtacaccttccttgcccaacccggggctatagcagcccctgaagccccgtatactgccccttccccgcataagcgttttgatggtgtctatattgctccttcctcgtcggccttaatcccacaactgtatttctcccttagctcgtttattattcttcacccccggaatgcggtgggagcccaggccacatcccttttgccacctgtatctataatgtgttggagactataaacgtcacccaacggtgggcttttcctctggctgagaagatggaaggcctggtgggagtttgctcctgggttccctaggccctaatgtgagggcacgaagagaaacccactccttctccctttttacacccctgagggcccacgagtcccctcacgaaaggaaccagggaatgctgccctctccccatggtgcccctgcctctgtgctgtgtaatgtgagaccccccaagtgaggggataaacctcggccactaggttttgtggtttttttgccttcacctggacttgccccgataattttcctttttgaggcagctaaataaaagatcaatttgtgcca

SEQ ID NO: 589783 - DNA, 489 bp, Homo sapiens
gatcgcggtggggaaccttgaaggcgcgctgtggcggttgtcgatgctgatggccatcgctaacccaattgacctcgttcgtgagtacgtcgaaggcaataccaccggatggcgggttgccaccagactcggtggggccgccatctgccacgtccttctcatcctggccctggccgttgctgtggacgccgtgatacgacaccgtcaccggattctctccagcgtggctgccgtcagccatcttgcgtgtttggcagcatccgggtctcgcgccggaaccatcagcctggcactattcgtcatcgggctggtatttttcggacgttcttaccggacgcgcagccgaaaacagcggatcgtcatcgcagtgttgggaatcgtggcatcaggggtagccatatggctagtgacgacggtccgttctgggtctcttgtcgatccggcgcgtgcgcgaacctgggcattgtcgacgcgcccgcgaatttagta

SEQ ID NO: 589784 - DNA, 175 bp, Homo sapiens
ccgcagtctggggctggcgacgatcagagggtgctctgtgcgaggtgccttcccgccgccccctcccccgactcgaggcaatcatttccccctgcgcctcctcgaggaggcagatcttcccgttcccccgccgctctcctccgtgaggacggaggcgagggcctgtaggtcccca

SEQ ID NO: 589785 - DNA, 155 bp, Homo sapiens
gagatcctgcttccgaactccatcaagggttcatggacgggaagcaggcgtgcgtgctcatgattatagccctgtgtagctctgacatgcaatctgtaccgcattgtgccagtagcaatagttcttcttccgatgccgtgtgttgctggtcccac

SEQ ID NO: 589786 - DNA, 263 bp, Homo sapiens
ctcagtattgacgtcacttatgacattcatgccattggttatactcaatgtctctgcatgtgtgacaatgagtacgggaaaagagatacaatgattactatcactaatgacaagggccagtttgagcaaggtaagacattcgaacttatggtccagtgaagctgactaagtacaacagctgaaagatgagaagcagagggagcgcaggtgtcacttcaatgaacttcatcttgagtccatattgtcctatcaacacttaaatg

SEQ ID NO: 589787 - DNA, 678 bp, Homo sapiens
  misc_feature (39)..(39): n is a, c, g, or t
attcttggacataagtcaacagatagagtgctgggagcncatattctaggaccaggtgctggagaaatggtgaacgaggcggccctggcattggaatatggtgcttcctgtgaagatatagctcgagtctgccatgcgcatccgaccttatcagaggcttttagagaagcaaacttggctgcagcttttggaaaaccaatcaacttttaattagaagattgtttttcttaaaatctggaagcttttgtcaacattacatttttgaacaggataatcttccagttccaagaatttgcaggatgaaattatgaaacttctgggagatctttagtaggtttgaacagaatggaataaccatgtacctatatttcacgtatcttgttccagtgcattaatgcaaacagaaaactacatatagaagaatcctggaaagttttgacctgttttcatactgtctacgagattcaacttcactgaattagcactaatagattttacctctaatttagtggaggtgaatctgttgacaggaaggagctggaaaatatgtgtgaacaacttgaagaagactggcaaacttactttaaatttggttttcatattggaaacgagtcaatgactagaacaagattcaaatatgtacaaacaacttatgtaaataaaaatgattttctctca

SEQ ID NO: 589788 - DNA, 1025 bp, Homo sapiens
gctctctgtgtgtgctggcaggacatgtggcgccatcccggagtactcctggtgccgagctcttccccgatacactgggacctagacctctggagggtgactccgtaagtccaccagacccagatggtgcctcagactacctcctccactttgctggttcctgtgcctaacctcgagcaggtcaggtccccatggtgccaggcacgagcgggggtccagggtcccatggatggaaggatgccttccaatggatgatcttcccgtgtctcccgcgaacacccttatgggatgccatatctatggggcactctggccgtgctgaccctgcagctaggcaaggcagatccacttccagtggcatccctgtcagcagggacctcagtcgggtagaacactgctcctggcacagtcccctgtgaccgtttcttctcatctacccttgtggctagccatgctcctcacgtgcgacaacagcatcctaccccagctccctgatggacacagtatcccaggcacagtggactcagggaagccaggcttggccaggaagaagcctcagctcagccccggaacttcgtcgacaaagctctttgaggaggagctcgtccatcagggaaccctctgaggaaggtccggttgatttttggttcctgattgccagtagtagcgatcgagtccgaggcaaaaccaggccagcctcagcccacgtggtgaaccaggaacaagataactcaagaaagtcttccccttgaggaggctgtgattccaattcagcaggctcttccagctcaagctgttccatcggttcacttgcctgggaacaggagaacctgcagagtgggaacaacacggcagcgctttctcacttccagaaagcttgcagcccgagggtacaagacaagcgcagacaatgcgggctttgtgtccatgagctggcagagtgacccaaggaaattagcagcgggactaaatataggatggtgccgcacggccaggctggtcgacccgtagcagggcctctaaga

SEQ ID NO: 589789 - DNA, 176 bp, Homo sapiens
ccaagtcggggcttcatcgcaacagcatgccgatgggggtcacacccatggcaactggggcgagggcgcggtgctgtccgaccaggacgcggtcgacgtggccgagtacttcacccacatgccgcggccggacttcccgcccaaggagaaggactggccggacggcaagaagccga

SEQ ID NO: 589790 - DNA, 365 bp, Homo sapiens
cgtcgacgagacgatttctgtcccgtcatggttacgcctgtagccagcaaagaaagatcctctttcgtgaaagccatgttcgcccaggactctgtatttcagcgtaagtcgtgcgccgtgcgttgttccttcgcgggtgtcgtagctttcttctcgtctaaccatgatccaatgaagggtcgggccggaggggtcttttttatcttttacttcgagaatgaaataatgcggttttgcgttttttgagtcgcgcaggaagttcttttttcgtgtttctgagtacatgctgtcttccttgccatgaccgtatcaatcgatatagccatggctttttgcttttctttaccagcgaacacggtcgacgc

SEQ ID NO: 589791 - DNA, 114 bp, Homo sapiens
atgatatcaggccgaaaatatgtggctgcgcgacccagtcatgtacggatccgccaccaagcccaccactccaccggtaccgagtggtgcatctaccccacgtatgactgggca

SEQ ID NO: 589792 - DNA, 297 bp, Homo sapiens
tacttttcacaggcagtgcttacatgctcaaggattctcctaacagcactgactgcattatccaaaatggataagactctgtaatgctcaccaacaggagactgggcagatatgcctaagcattcctattcgatgacacgtcatgcagccaccaaatcgagaggcagctctctatgtgagcttgttacaaaaataagtctgagacatattattatcacgaaaaacaggacacgtgcaggaggaacagcttgttcagcattagccccactttcatggtttccgaaaggtctgtctttg

SEQ ID NO: 589793 - DNA, 1040 bp, Homo sapiens
aggcacactcatcatcagcgctaagctcgcactgatttcctaccatgagtaggcctagaaataaacatgctagcttttattccagttctaaccgaaaaaaataacacccgtcgcttcgcgagcagtaagcgtgcgcatcaagatagtttcctcacggcgaagcaaccgcatccataatccttctaatagctatcctctgtcaacaatatactctccggacaatgaaccataagccgaagtactacgcaagtcatagtactgcagtgcattgagagtagattccagtaactgtgctagtaggcaagtatacaacgtaggaataggcccccgtttcacgttctgagtcccagaggttacccaaggcagcgccctctgtagcgatccggtcctgccttcttgctgcacatgacaaataactagccccgcatctcaatcatataccaaatctgctcccatcactaaagcgtaagccttctcctcacgtctctcaatcttatccgatcatagcaggcagtagaggtggattaagagccaaatccaactacgcaaaatcttagcatactcctcaattacccacataggatgaataatagcagttctagcgtacaatcctgaacataagcattcttaatttaactattcatattatcctaactagtacggattcctactactcaacttaactccaggcacacgaccctactaatatctcgcacgtggaacaagctacatgaactcacgacctttaattccgtcaaccttcttcccaagagagctggcccattaacgcggtattgcccacggggccattaggcgaatctcgcaacactacgtccttatccacaatatatttacaactataccccttacacccattatcagagcacgatatcatccccatataaccccttatatcgcacacatcatgagcgccacacaacacccacaccacaactcagcccacctcctcacgctcatcacaacacaccacaaaaacatacgacatcaattgataacatggatatatattattacgataa

SEQ ID NO: 589794 - DNA, 596 bp, Homo sapiens
gacgtagatttcagcatcaaccagaccaaggattactagaggacaataacatcagataaatgagtgataagggtccatcagaggattgctcagcaatgtgagcataaaggacaaatgtctccactcctaccccaccgaaacatggcagagtgggtgcccatgcccctgggctgaatctatgcagtcccaggagaatatataactcaataatctatgcagtcccaggagaatatataactcaatcgttgagataatcactgtaggctcccacagtctgacttcctagcatattcaaatactatacctcattccgcttggtctgtgcttagagaggtaagacttctgagccagacttggcttcctctgaggattggcaacatcctaccggttcccccagcatgtctgggtgagagctccttctcaggttaaattaacaacctgattggcaacttaagcatcatctatgaggttggtgtatatgcaactccaatcctgaaacaggagattctcactcccataacaccattgagttctaaggtattagtctcaaggccagacatttgagactttccttgccccttctccactatgagacg

SEQ ID NO: 589795 - DNA, 197 bp, Homo sapiens
gaagccgcgggcgatctcgcggatccgggcctccagcgcccgcaggttatgcggcagcagcgagccttgagtgatcttgcggtaggcgaaatggtccgggttatccatctgcaccaacgagcggacgaggagaggggatccgcccatcatctcgcgcaccttgcggtcggccttgatcgtggtcagcaccgtggcgc

SEQ ID NO: 589796 - DNA, 405 bp, Homo sapiens
cgtgtctgataaaatataccctgaccgaagtgtagctgttacaaacaaaaccacaggaaggtccaaaactgtgtgatcatacttcatctctccttaacgttcgtcgaagcatgtctctgatcaacgggtgtgtagggattaataacaagtgtctactactgactacgcatagtaatttgaagcagatgtccttgacccgattggtacgcttgagcatacatgattctctccatgtttgccagaccatcctgtatggattgccaccaaatgcacacggaagattctgataggcgcttgagacaccacagtcttatcaatcttgtccttaaggggcttactctttcatccaatacagcagaggttcaaattctatctaatatgaaccacggactctcaggggatcca

SEQ ID NO: 589797 - DNA, 392 bp, Homo sapiens
  misc_feature (84)..(84): n is a, c, g, or t
  misc_feature (116)..(116): n is a, c, g, or t
  misc_feature (150)..(150): n is a, c, g, or t
  misc_feature (187)..(187): n is a, c, g, or t
  misc_feature (228)..(228): n is a, c, g, or t
  misc_feature (383)..(383): n is a, c, g, or t
cctaccaagggaccccctggaaataccaagccccccgataacctccaaggatccatacccacgggaccaagaaccttccaaaantttaatgaacaggctgataccctccatgaaantccaagacaaagaagaaaaatacctcaatgttantggacctaaataatcaaaaggataatgatttcataantttcctatttgaaaatgtgcctgaatcttggaatgtttcantctccagatttatgaacattttttcttgagcaattggtaaagtatacttttgtaaacaaaaattgaaacatttccttttgctctctatctgagtgccccagaattgggaatctattcatgagtattcatatgtttatggtaataaagctattttntacaagttc

SEQ ID NO: 589798 - DNA, 936 bp, Homo sapiens
tgtatccagtgacgcaattgcaagaagctccataggttgaacgcatggctctctcgggtaggggatgtgagattcgtacttctcgtgaaaagtagtgtcccctacctctgatgtagcaactcaatgctcatatcaccttttaaatgctgtttctggtgaagacgctgagtgacttgcacggagagaagttccaactgcatgaagcactttagcttagaacagatggactctgtccagggcttggtagcttaaatgcccgatggatccttggaggtaagggccctagggcactggtgaccaatcgactggtcgaaggccgaggaacatctccatgctgtcctcatgaatctggtctgctgctccttcagatgtaggatatgtcctcctaaggccccctgaaagaataccgaaactgcctctaggaccattatcttcgacggcccagggtggtactccgctttggacgcgaaggtgttatgcactggtttcgttgggggacaccttctattggatgcacccctgtgtatacgaccaaaatcatattctgtgaggacgcctgcatagattatttccaacgctagtggacttgaacaaagccccacggaaggggatgtaccaaccaactcgaaaaaggtacgtcgatgtagtacctttagtaaaggaatccttacaatcggatcggtgacggtccaacggttactttccctatgaacaaccaaatactctggcaccctttgggaggcgcgaccgtgatttcctcaacggacactctggtttgcggaggcttcgccggcgtacaaacctaagagatagctcacgatggggaacaccgatcggggactcgcatactgcacgggccatggattggaccacgcttatggttggagccaactaaggcattattgcaacacgacgtgggtggaacccacctcacaa

SEQ ID NO: 589799 - DNA, 120 bp, Homo sapiens
accgaggtgcactggaaaacaaccagctctggagaaactgctgccacatatcctgggggaatgtgggctttgttgtatcaccacaggaggcactcactgacgatcagtggacatgttgct

SEQ ID NO: 589800 - DNA, 723 bp, Homo sapiens
  misc_feature (541)..(541): n is a, c, g, or t
  misc_feature (604)..(605): n is a, c, g, or t
  misc_feature (621)..(621): n is a, c, g, or t
  misc_feature (634)..(634): n is a, c, g, or t
  misc_feature (652)..(652): n is a, c, g, or t
  misc_feature (654)..(654): n is a, c, g, or t
agcgtggcagggcagggagctggcaccggggttggagaggccttgggcagacgcagcccctccaccatggcagggagctggcctcaggcagcaaggcactgcgggtgccccagagacacagacaggctgcgtcaggctgaaccccagaccagctgagccaggtggcaaatcccatgtccgctccagacagccctggggctctgaatctgcacttgggagcgtgcaattgtctcctccaagactctggtggaggggatttgaaataatcccagctcagggagggtggggcttagggacagggcccagggagggtccaagggcaccacggggggttttgccacctgagcccagggatcaggcagggcttggccagcgctgagcaccctaagtgcctggcacgggctgagactcaggggccggctgtgcctctcctgaagccgtccctgttggcgggcaggcgggtggggcaggctgggggctgggcgcggctctcatatcttccccgttacttcatccattttgttcccactgatcccttgtntatctcactgggaaggcagccgcggtggaagacggggccaagggaaaggcagagcctgggtcnnctccagcctcactcgncctcctccctcanctggtccctgagctgagnancagggcccggcctgagaacctccaaggcagcacccagaggccgggtctgcaccgtgcctgacactgacg

SEQ ID NO: 589801 - DNA, 239 bp, Homo sapiens
tatggtcaacgccgtcagtgacttccttacccctcagaacctggacgccgagcctggcgcggggattctcaccctcaatctggccacgactcgacgccgcaaaggcatgttctcgtggggatgggattttgctccccgtatcccctcgatcggcttgacgggtccggtggagttaacccgtcgttcaccgatcgaggtgagccatcacgtcgacacgatggccatcggtgacggcgaca

SEQ ID NO: 589802 - DNA, 132 bp, Homo sapiens
gtctctcttcatcacaatgctatcacgagatttgtggacgtttcaccattagcttcttttgcacgcaccaggtcagcttcatctgtatctttccatttcattaggaacattacatcaacacaggaatctata

SEQ ID NO: 589803 - DNA, 543 bp, Homo sapiens
  misc_feature (20)..(20): n is a, c, g, or t
  misc_feature (98)..(99): n is a, c, g, or t
  misc_feature (379)..(379): n is a, c, g, or t
  misc_feature (387)..(387): n is a, c, g, or t
  misc_feature (431)..(431): n is a, c, g, or t
  misc_feature (436)..(436): n is a, c, g, or t
  misc_feature (467)..(467): n is a, c, g, or t
  misc_feature (479)..(479): n is a, c, g, or t
  misc_feature (531)..(531): n is a, c, g, or t
gtcagtagcgcggcggccgngcccgcaaatggtgctaccctggttgctgctcgagactgcgcgcaggggtcctcgggtccgcggaggctgcgctctgnnaatgaaaatgacagatgaaaatagaaaagtgtggctggtctgaaggtttgacgtcaataaagggaaactgccacaatttttatactgctatttctaaagatgtcacttataaggaacttaaaaacctgttgaattctaaaaatattatgttaattgatgttagagagatatgggaaattctggagtatcaaaaaatccctgagtctatcaatgtaccattggatgaagtaggtgaagctctacagatgaatccaagagacttcaaagagaagtacaatgnagtaaaancatccaaatctgacagctagtgttttcttaattagccggagtgngaaancaagaaggccctggacacagcaatatctctnggctttcacagngataatagccggccaagcgtggtggctcaccctggtaatcccagcactttgngaaggcccaggc

SEQ ID NO: 589804 - DNA, 229 bp, Homo sapiens
  misc_feature (51)..(51): n is a, c, g, or t
ctggcatttctccagatggagctgagagcttgtaaggaccatgggattctnctgtttgaaggactgtaggcatttgtggtggcaatgggggttggtggtgatattctgcttacctttttcccatgatggaaagttccctccgacgccaggcagatctgatccaggtcggggagatggggttatagaggctatgtgcttccatgctgccctcctgtcattacagatgcat

SEQ ID NO: 589805 - DNA, 110 bp, Homo sapiens
cgtgactcttgaggatcccgacgtaggccactgaagaattacggaatcgattgctattcaatcactgaaaaacggaactcaatttatgacgcacagaatatctctgaaag

SEQ ID NO: 589806 - DNA, 910 bp, Homo sapiens
gtgaagttcgaccttgatgaaagtatgccagaggacatcccaaagcaaagttggtctagcggattgccactgatgattccaaagcagtctgtcgtctcactgtgaaattcggtgccacgctcagaatcagcaggctccttttggaacgggcgaaagagcgtaaagtagtcgatgctgtaggtgtcagctatccatgtaaggaaacgcggctgtaccgagtcctggagaccttcgtgcaggcaatctctgatgcccgctgtgtcatctagacatggggactgagcgtcgcatctcagcatgtatctgcttgatattgccggtggcattacctggaagtctgagagactgtgacaatcgttaacactttgaagagatcaccggcgtaatcgagcccagcgtaggacaaatactttccgtcagactcgtggcaacgtgagaatcatagctgagcccggcagatactatgttgcatcagctttcacgctgtgcagttaactatcattgccaagaaaattgtattaaaggaacagacgggctcgtgatgacgaagatgagtcgagtgagcagaccctttatgtattaatgtgaactgatggcgtctatggatcattttaattgcatactcttatgagccacggcacatgttgcaacgcccccttctagcaaaagacgaacctaaaccagaatgagcacgcattaattccatcccagcacaatgccggaccacaatgtggatggccaccaaccggagaaatcgtgaaccccgggacacgccggaaatgccaactgtgacaaaggcgcgcccttgagccatgaggctaacacgtgtcggcgccaccacaccacagggcccagaggcgaacaaatataggcgcacaacgcggagaccacagcagacaagagacgccat

SEQ ID NO: 589807 - DNA, 710 bp, Homo sapiens
actaagggatcactgcagttcaatcaaactggaaaatagagaaccgattgctccgtatgtagcctctgtctgaaccatgaccccataggtctaaggagaaagcacataggataaatgtttacgcttgctcgtggtgcacccagatccatttttgtttttgagtctggctatttcgtgtggatgaagatataccgcagtcagcaggtaatggctggatttgggcgcccccatttgtttcttctgcttccctaaaaaatttttcatatttgtccaggtatggtggtcgttcaggtagtaggtaataatgtgttgaactaaccttcttcccattttcaataatgggcagaatgcaaggaaccttactggcagatccttcgctgttctgtctttgcagtgctttgctgctgacatacttgggatcaggggcaaagctctgtgtcgggggcatgaccccattgaggtaagacggaaggcttttgggactcggtgtgcgcgagttactcggtgacaaaggttctcttggcggtactttgggaggcctgtcttcatcactataggtgctcgaagtaacttctgctgaccatcttctataatctggctttactgctctaagaggtatggaactctgggggaactcaggtttgcttatcggagtaggaaagctcgtgtatccacagtgatccttatgggtacgagtcgatcgacgacgg

SEQ ID NO: 589808 - DNA, 172 bp, Homo sapiens
  misc_feature (61)..(62): n is a, c, g, or t
tactggctcagcatctcccactcagctccgagcagctggacacagcacattcacacgctgnncactttaaacattttttgtagagacaggtctcactatgttgctaggctgtcttgatctcctggctcaagcgatctcctagcttggctcccaaaacactgcgatacaggca

SEQ ID NO: 589809 - DNA, 261 bp, Homo sapiens
gtgaggtgtggcaggtgtataaactgagtcataggcttcagaggatatgtaaaaccccagaaacggaatgcaaaaaaaaaaacgttggtgggtgtcttcccaattgggtttatttggagggaaggatcccaaatttcccccaaaaaaaaaatttttttaggttgccactgtgcccaaccaaaggttggggacccctaccttttaccggcgggtttttccataaaagcatgggtaatctcgggcattgtaagcaaaaaccat

SEQ ID NO: 589810 - DNA, 264 bp, Homo sapiens
  misc_feature (5)..(5): n is a, c, g, or t
ccttnagaaaattccagttgtttttttccccccggcatcctgcctgaaaagggccggggagggttttaaaaaaggggggcattgggttccacaccatcggcagccgattccgtgttttgatcccgggggggagggacccggggggtccctgggtggggcccatgggtgagaccctccagtattgagccctaaggtccaaaggtttgtgggagccaagtggggttttaagtattttcttaaaacaaaagaatccggttttcccca

SEQ ID NO: 589811 - DNA, 1302 bp, Homo sapiens
  misc_feature (766)..(766): n is a, c, g, or t
taatcttatgaacagtggctgtgagactgaatgccatttgtccaggcttagctctaacacagcccatccttgaatcacattgacaacacgaagaaaacatgggacacctctatagcaactatacaggatcatatcaaggatatgacttaacatactatggcaatctttggacccaccattgcattgccaatggacttgattaacactcacttgaagcatgactgcatcttacacactggctgctcattactgcaccgatcacaacgttctaagggcaacttcacttcttcaaagcactatgcatacacacgtcgcagtctccacatgcaccaaaagccgcaactggaaccatgcgtctactgctgctatagacaccatacgctgacaacactaacgccacacacactcagctctactagtctcagcagtccagtaagtcatatcgactgtatagacaacgatattaaggccttattatcaacaaaatggcagaaactcagctatacaccaaggctccacggaacacgcttgcacgcccccctctgcgaccaggccacccatatgcggctgggacttacaacaccccggctcgtcagcaccttagcacacttctcccacaacggcttgccacacctgagtgacttacactcgccgcagcttccaccgcaaccagggcctctcaccctggacacacgctttaatctgtcacgcacacaccactgggcatggcaccatgggccgtgtgtaacccccacacaaaaggagngccaataacccggcctcccagggatcacaacctccatacgtggcaacctacgggcatcccctctaccacatcaacaaccccgggaaactcccaaaacaacaccgcacaaacccacacgggaagcctccctcctccaaacacggcggcaccaactaacccatccacacagcatagaaatatcgaccccatgggccacaacaacgcacccaaaacgaacacacccacgcccctgggcaccatactctgctcgacatccaccgacaacccttgggaatcgactccactcccccgaacttcacacaccagccaacatctccaacacaggcaggacccccgtcaccgccacgagcaacaaaacccgaccttcgcacaatcagccgacacgcaacgagggctgacagagccaacatctaccacccctgggccgacacctccgcggccgcaacaccttacacacgcaccctgccgaccacacaccacagacgaaacgtagccacacacaacaaaccgaccctcgcagcaccacgatcagccaa

SEQ ID NO: 589812 - DNA, 103 bp, Homo sapiens
gccgactcaccagacgcctcaagcgcctttacatcaatcgcccagatcactcgagacgtaaataatggctgaatcatccgctaccttcacgccagatggggcc

SEQ ID NO: 589813 - DNA, 325 bp, Homo sapiens
actctagaggatcgcgctgatcgcttaggtccagaagaatgaaggaacatcagcagcctgttcagaaggtggtttgaaagacttcatttgctgtagtttggattaactccccttccggcttaccccattccaaactggatttataattttgggactgaggatcatttgtttgttaatgtactgtgcctttaactttagacaactttttattttgatgtcctgttggctcagtaatgctcaagatatccattgttttggacaaataaatttactgaacttgggctaaaatccaaccttgggcacacaggtgtgatacaacttaagc

SEQ ID NO: 589814 - DNA, 282 bp, Homo sapiens
gagcagagatcatgccacatggacaccagcctgagctacagagtgaggctccgactcacaacaaacaaatcaatcataaacactggcaacattggaaggactacttgacactgctggaaggactgtaaaatgacgcagctgatggaaaacagtatgatgatttctcaaaaacccaacccacaagacatgaaagcagagactcaagctgtcatttgtacacccatgttcatagcagcattgttcaaaatagccagaaggtggaagctacccaagggtccatca

SEQ ID NO: 589815 - DNA, 464 bp, Homo sapiens
cgtgcacttatgaatttgcggaataagatccacatctgatacaacaaactataatcagataatttgggtggggagtgttacaaaggaggaggggaaacaattacagcacaaatcatgttgataagagtaaagctgaaatattttagacaagcttaagcaatcactgtcagtgaaccagagttcatcagaaagacctgtaaaattgtggttcccaaaaggcactttcattttgataccagcttcacagtcactggtttcactaacacctgatgcttttcctagtaataattcaaaggctttcagagttaaaaattcccataccagggactggtgacttgaggggaattttaccatgtaaataataactataaaattaagtctcactgcagcttgaactttggaaggatttttttgttttgttttaaataacagaagcaacgacaagagaaacaacaacagcaaca

SEQ ID NO: 589816 - DNA, 318 bp, Homo sapiens
cgaggcggtggtggggcacgaggcagtggtgggcagaggcagtggtggggcacagcaggatctcaacgggaaagcagccagaggggttgtggtggcctgaaccccgtgctcccttgctccatgtaatccgcacctacccctgtaatgatagggattcccgttggaaaacaggtctcacccgctggtagccatctgccgcttcccatggacgagccagtcctgacacttactctccagcgtgggtttgaaggggctgcccttcgctttgtgtgacttgtcctaatcctagccagatgtgttgccccaccagtgcctcgg

SEQ ID NO: 589817 - DNA, 178 bp, Homo sapiens
  misc_feature (47)..(47): n is a, c, g, or t
gtcgctcaaggatccccagataattgtagaaaagtatcagagattancttaatctgctaatgcgattttgctgatctgggtagactgtagcctgtgtacagatgagctgctgtgctggcagttccgcagccagcaaaccttttatctttttttttttttctagaacggagtctcgctc

SEQ ID NO: 589818 - DNA, 175 bp, Homo sapiens
aacgatggtcctcagcgtggtagaggctgaggcaggagaattgcttgaacccaggggatgaagttgcagtgagccgagatcacgccagtgtactccagcctgggtgacagagcgagactccgtctagaaaaaatatagggactggatgctgaaatccgcaccaaactcttccaag

SEQ ID NO: 589819 - DNA, 147 bp, Homo sapiens
atttccctatgtcataatataatctttaaaaacatgattgtactgactggataatcatcccctgtactataatttgtaaaccatttcctgattgaagaacatttaggttttgtgttttttttgctataataaatactgtagcaatga

SEQ ID NO: 589820 - DNA, 1198 bp, Homo sapiens
  misc_feature (775)..(775): n is a, c, g, or t
  misc_feature (1198)..(1198): n is a, c, g, or t
gatccaggccctggggagagctggccacggacaacatcattctgaccgtgccgaccgcaaatcttcgtactctggagaaccctgagccgctgctccgccctctgggactgcacggctgactgcaggctgtggcgcgacctgggagctgagccctatccctttttgcgcccttgcctcagacgcgacttgctctgcccgacgctgcagactctcacgtgggctggatgcactgcacgggatacccccactccactgctgccccatcctggcagctccagctgcacggagcctcatcgaacgcaagcaagcctccatttccacggacacctacaccccccccgaaacacaaccacgcggacaagccaacgtcccattgcgattgccgcagcgaacccaccaggtcttcgccacattgcaccgccctggagcgacacagcaaaaacccaacgcaggccgagcccacgcgacgctgcgcgacgattacccccacacaacaaacaacgcagcccagaccggccaacaccttgccctaaaccccccctctgctgccgcgcttgggttcggcatcggatcacttcgggtcgacccaatttgcaaaggcaaccgccgacctcccctctagccacgctccactttacgccaccagtcccagagcacagcggcaccccacgcctacgcccccaaacaaattacaaattccaggcgctctccccttcgggcctccgcctcgcacccccccccccccaccccaagaacgacttatcccgcgaggcgncaacggcaacgacgcaaacaggcaaggccttcccacggcaacatagcttcccgttaagccccctttggcaaaccgccccaccacacgcgcggtgacaaacgacacctttacacccccccccgaacagagtctcgcagctagctcacaccctaaccaattcaccacatcgacctcgcacaacactttcgcccccccattggcgcgccaaacccccccgaccagcaaacacactgcccccacaccaataccccccgacttacacattcttatccacacacctaaatgcacctgtctccccacccagctcgccccaaatcacactccacccataaatcatagcaccactcactagctcacacaccacagcccccccccgtcatatcccacccaaactatcccaccgcgccatcctcacgtttcacn

SEQ ID NO: 589821 - DNA, 508 bp, Homo sapiens
  misc_feature (336)..(336): n is a, c, g, or t
  misc_feature (351)..(351): n is a, c, g, or t
  misc_feature (359)..(359): n is a, c, g, or t
  misc_feature (383)..(383): n is a, c, g, or t
  misc_feature (417)..(417): n is a, c, g, or t
  misc_feature (421)..(421): n is a, c, g, or t
  misc_feature (425)..(425): n is a, c, g, or t
  misc_feature (429)..(429): n is a, c, g, or t
  misc_feature (469)..(469): n is a, c, g, or t
gggaatgtgcaagttgtgttgcaccctaacctaagccatgacccctggcatgccaggcaaagtgggaggttctctgctcccagggcctgtccggggactgaccccttcatacccaaagggcaatctcccggcagggttttatgccctgtccaagcgtaaacccttttggaacttctttttggggcaattttcctgtggccttcctggcctttacttccatgtgggcagccccccagacgttgttgagcaactcgccagcctcctgagctccatgcccatcaggactttagcctttgaccttgctgttgactttgaaatcaggatttggaagttttngaattaggagtaaanagatttgncctcttgccaggaatgcccatggntcatgtgattggcttttttacccataaagggccntgcncctnatancccctgggagtgagggtcccaaaggagaccttggctcccncaggtccccaataaacctgtttttttatcaaaaaaaaaa

SEQ ID NO: 589822 - DNA, 143 bp, Homo sapiens
ggtgagcttgcagtaatgtagggttaggcgtacggcgaggctattggttgaatgagtaggctgatggtttcgataataactagtatggggatattggtgagccttgcggtaagaagtgggctagggcatttttaatcttagag

SEQ ID NO: 589823 - DNA, 334 bp, Homo sapiens
gggccttttgatgtgaacagatgttttttaggccaaactataagggctaattttaaacttcaaccattccccttttggaatttgttttaaattgttttatgtatagtaagcccaactgtaatctagttttaagagaaaccgggggcttcctttaggtccatttggatttccccgggtactggaaaaggctgtttattaattgtttccagtttgttgcaacagccattttcttgggagaaagcttgagggtaaagccctttgtaaaaggctttgccatactcattttaatatgggccgggtgctgttaacttttgatgaataaaaacctttcttt

SEQ ID NO: 589824 - DNA, 520 bp, Homo sapiens
caaaaaccagtggtcccttattaaatccagggttagggggaaatatttttgaaaaccatacttcccgggaaatatggaaaccggccggtaattaacttatttggattttaaaaggtgaacccacccttaaatcccgggaaaaattccccttggccaatgaataaaaaccctttttatgggtggcggaatcaagttggcaaaaattttggtaaaggattttggggttggaataaaaaggaaatatgggctaaaagtttcttggggaggccaagccaagatccagggaaatcctgcccaaaagaaagtgggaaagggtccttccttccctacctttaaaaaccaggggcgaaaaattaagggtaaatttaaaggttggcaaaaattaacaaagcgccccttttgggccgtggatttcttttgggaaattttaaaaatcactaatccagtattttcctttgaaatgccaatggatttttaacccaccttttaggtgggcccaagaaagaaggttttttctccg

SEQ ID NO: 589825 - DNA, 153 bp, Homo sapiens
ggttcaagcctctcttcagcttgaatttccttgcacttaagtaacgtgatgctgtgcctgttttccatgggttcaggacctgtggggaaagccaggactgtcctcctcatacaaaatcactgtggggctgggtgaaagggtcttaattctata

SEQ ID NO: 589826 - DNA, 140 bp, Homo sapiens
gtcgctctagcggatcctccctggtggtgatggtggtgatcaccaaaaaaaatcacttggctaaaaaaaaacagtattaaaaacgagttggctgagaaacaattggcaaaataaagggaatttaggcactcccacacccc

SEQ ID NO: 589827 - DNA, 811 bp, Homo sapiens
gcccatcctaaactggacacaccatggaaagagatttgttcacgggaagagaagcagaagccccaggctgagcggaaggaggagaaaaaggcggctgcccctgtctcctgaggcaggagatggttttaatgtgagcagcgcgcatggcatgctgtagcccaagagccaatggacccgcttcggctcaccatgcccattttttaccgtctgtagttgcgatgaattctacagcgcaagatactccaaatgagtgacacacatctactgtgagcacatgaccatatatcctgggacgcacattatgactaacggcacgcgctggatcccatagtggtacctcaggagatatcagctatcccatgacagaacctcagctcagcaccattcactgagactgcaactctcgatcacatggcacatgttccgagcgtactggcacaacgctgcaggacagaaatgccattcggccacgtgtcgatcactttagtaggaaaccaaaccaacttagcaggctaccgatattctcggacgtctaggcgtcgttccagaggaccagcgagcattgcactatatccagctgatgtccagcatactggcaggctggaactaacgagctccatcacagcattggcggtacaactgcgatcctgagcagacgacggagagcccagaatcgctgcgttcggagacgtacgtttatccatgcggcaggggagcctatccacgcgatgctcgggcaaatgccttcaactcaagggccaaagatcgttcaagttgaacactctctttgccatcaacctaagcttgacct

SEQ ID NO: 589828 - DNA, 111 bp, Homo sapiens
atttgtgatgtaatagtacgtgtgggagcttcaatattccacagtcgattgtacaatgagtagatgctatgtttgggaagaaacttttcaacttgaatttgccttaatgaa

SEQ ID NO: 589829 - DNA, 412 bp, Homo sapiens
ggatacataagggaacatggatcatctctcttcatagactacgtgtcaattatagtatacatgagtacttagaattaagaaaatggacccctttaccaacaatacccacttcctacatgcttctccccaagacggtcgtgaagactccgaaattctttttatcttaggaacacagaatactagctgaaaaaagataacattactgagtcagttgattagggcagactggcccaggacttccactgtgaggagacacttacctctgctgggcaccatatatatatactgaatgaagcagttggatgatgaacatagggatgtacccccaattcttgggcatgactcacagttcctagcaaagattcacggtccccaggtccaccggtactcaagagcagagggctgacatggc

SEQ ID NO: 589830 - DNA, 335 bp, Homo sapiens
  misc_feature (82)..(82): n is a, c, g, or t
  misc_feature (226)..(226): n is a, c, g, or t
tagaaattctatttgccatatagatggccctcaggagcctctcacgcatgtcattccttatgatggaccactaggggatttncaattgggaaagccaacctttcttttagtaagggctcccataatatattgggggtgtccttgatgaaggagggggagtcccgggccaaaggtttatatagtaatgggggtgcccccttgggcggtttcttgaattccccatctnagttctttaaaggtccccctcaatggatttacgatggctcccatgtaaccttttggcgaattcaaaatcgttataggcatcatctgcagaacgcttaaggcgatgacca

SEQ ID NO: 589831 - DNA, 121 bp, Homo sapiens
gtagactctagagatcccctgcaaggttttgcgaccctcaagctcgaagtacgccgcagatcacgccggagaaaatcatcctcgaggtgacatcaacgaggccagccgggcgagaaccacc

SEQ ID NO: 589832 - DNA, 1562 bp, Homo sapiens
  misc_feature (37)..(37): n is a, c, g, or t
ggaacgaactcgtcggtcgtagatgatcgctgtgttncgtaggtcggaattatttgcctgcgtgtctacttagaccatcgccccgtacgaatggtggtgtttcttccctccgccaacagtatgttgtaggtaacgtcccccacccttgtggtggtgagacactgtgtgtagaaccgccgacacataaagtggggtgaaatacaagcttcgtcaaaagaagtggggttttgttttcgcccctgtgcttgggtaacacccaataagggattatttactcctgggggggtatatataagtgtacgtgtgactccccaaagaggattttttgtgccgtatactttcgggtcgttataatgggtggaaacaaaccaacgggggcctcccgtgtttgttgtgctggcccccaatacgcggagagatgtgtacactccttctgtgacaacaggttggtacatgggcgtttttccaacagtgaaacccccttttgtaagtatatagggttgcacacatatatggtctttgtatataggaatgttgtgaattgacataagtggctaatagtaatagggggggacacataacaatggggttggtttccaaaatgttccccctagcatagggatatggtgttcaaaaagattgttggaaagagctcccctctaaaattcgccgccgttgttcgaaagaaactactttgggcacaaactcgcccatcacttcttcgtgttgtgggataaggatttgtgatcgacatgagccgttgttgcaaaaaaggcgccacagggatttttgtagctcgcgatcttagtacggggccacacaattatctacggcagagcagaagttttcccgggagcaacaaaaggagtcgtgggaatatgggcactattttggattgccaacagctggggctcctttggaaaatagagaggagaaaatctctacgctcttctgtttctggtgagatacagggtgtaagacaaaactctttggggaaccattcccgacaccacgaggatagagagtgtctggggtgagagaaaaaggttctggacatagccctctattggatgcgagcacacaaggtgtgtgtatcccaggtaactcgcacaagtgtaggcccacaggcacacgggtagggatatagccctgggggggatatatgtcctctgggtggggtagagaagatctactctctcccttctggttggtgtctgtcactcagggactccacccattttgaaagagggcttgattgtagaacccctcatcctcaagggtgtaagaatgtaaggcacttgtgttccacacacacacattttgaacacactcttgaaacggaacctaaatttcgctagcacaaattcatgtggcacgtcttttaaagaaagttaagctgagataatacgtaagcgtactgtggcaattctcaaatatcttgaaatatatggtaccatattgctccatggggacaaggaaataatctttgcactttataaaccctgtattgtaagtggaacatgctatgtctttaataaaactatattaaaattggcaccata

SEQ ID NO: 589833 - DNA, 193 bp, Homo sapiens
tgctgcgacacgatcgatgcggcactgagcagacgcgagcgccacaacgcaccagacactcagagcaaggatcgagctgaaaacgtgacccactctgtcctgcagcgactgggaagcctagagaaggctgtgagcaaggaggcagggtcttcctttggcatgggatggggatgaagtaaggagagggactgga

SEQ ID NO: 589834 - DNA, 444 bp, Homo sapiens
gggtaatgcatctattcaagggaactggaaggataaattcatgaaagaagccacgacgaatgcaccattcagattgaataagaaagacagaaaaactgtgaaaatgatgtatcagaagaaaaatttgcatatggctacatcgaggaccttaagtgccgtgtgctggaactgccttaccaaggcgaggagctcagcatggtcatcctgctgccggatgacattgaggacgggtcaacgggccttaaggagatttaggaacaatttgactttggaaaagttgcatgagtggactaaacctgagaatctcgattttcaatgaagttattgtcaagctttgcccaggtcaaaccttggaggggagtacactctctacttccgacctaggccgctagggtgttccagggtctccttaccagtaggcaaggcttgttctctcttggctag

SEQ ID NO: 589835 - DNA, 547 bp, Homo sapiens
ggtccagagggttaatcagtgtgagacacaacatatatttagagataggaatagacgtagacacaagagacatatttcacatccgatagcataatcatcagtataccacaacggggtcaaagtatttagctgactcgaccacacgtacaaggaagcaatatgaaatgatctgatgacagtgcatctgagccctaggattacatctttacttttacaacgtaggtggcctgaatggcatggtatatagcaaaagtcatcactagacatcgtaatacaggacacgtactacgtggtaggctcacttacactatgtcctatcaataggagatgtataggacatcataggaggcttcattcaatgattataacgctattctcagggtaaacacatagagaaaagctacgccaaaaatccatataaaataatgatattcatcgagaggtaaatctaacttatgagtacaaaaagagttaatgagaatatccggaaggacacggaagataaatggaaataacacgaagaatagagcaaatgaacattgtatca

SEQ ID NO: 589836 - DNA, 367 bp, Homo sapiens
taagagacgtttgcaatgaaaagtacggagattggccgggcatggtggcggccacctgtagtaccaggtgctcgggtggctgaggcacgagaatcgcttgacgccaggaggcggaggttgcggtgagctgagattgcgccactgccctctagcctgggcgacagaagcgggattctgtctcgagaaaaaaaaaaaaaggaccggagagtctctcctcctcttattaaaggggtaaatataggcacgttgggaaaactcagcaggttatacaagatttcaacttctcttcatcctcagtatatccgtgtcatcagtgtaagaagccttctttaaggacagatttaacctaagctatggtttaattggc

SEQ ID NO: 589837 - DNA, 532 bp, Homo sapiens
  misc_feature (400)..(400): n is a, c, g, or t
cgggtgaccgtatttaccggtttcgcctgcatccagaatgctcatcactttgaagttcatctggccgatttccattgaacactcaagaagcgcgttcatatcggcaggccaggtccccagccacgccatgattttatggtactgggcataaatatcgttgtcgtattgaccgagaacatgcgcgtgttccatataggccgccgcacctttcaggccatacaggcacagcagacgcaggccgagaatgttttcgccaatcgccgctttatctttgttaggggtaaattctgctgcctgacgttgcagctcgccgagatcgtcgctcaccagttgcaggtcagccatcgggttatcgacgcgcgcgttggcatctacagccaggcattgcgctttcagcgcntcgcgcagggcaatcgcttcacgagcgtagcgaccaatacgcggagaatcgaagttaacgttggtcagggttgagaaaaaggcacgtggcgcgaagtgttcaacatcgtgggttgatgatgccgtattcacg

SEQ ID NO: 589838 - DNA, 274 bp, Homo sapiens
agtacgttgaccaccgtgcctgccccaacagacatttatttactaataattattactgttgctgtaaattctgtgccatacagcttatggttctcccatcccatgttgattgagacgaacggcagttcgagaatgtctctgaggaattgactttgaatggtgaaacctaagaatgaagggaggatctaagactgtcctaagtcgagcagatggcacaggtggaatgtcctgaggagggaaacactgtttgtatttagacgtagtccgtgaggag

SEQ ID NO: 589839 - DNA, 459 bp, Homo sapiens
  misc_feature (80)..(80): n is a, c, g, or t
  misc_feature (82)..(82): n is a, c, g, or t
  misc_feature (216)..(216): n is a, c, g, or t
  misc_feature (244)..(244): n is a, c, g, or t
  misc_feature (353)..(353): n is a, c, g, or t
caaaactggaccaactggcctcttcctttcccctgggaccaaaatttaggggcctcagtccctcaccgccaatgccctgncntattctgtctctccttcttccccctggcctgttctgtctctgagctctgtgtcctccgttcattccatggctgggagtcactgatgctgcctctgccttctgatgctggactggccttgcttctacaagtatgnttctcccacaagcttgtggctgcaaggnaacttaaattttataagggaagaagccctgttggaagcttgcttgcccccaagccaacaagctggcaacttgaacttgtgctcaaccacacaatctggggggcaagccnttcccttgggcaaggggcccttcggtggcttcctcaattttccaattccctttcactgtgggctaaggggtggggtgaggggatggagagggaggggctgcctaca

SEQ ID NO: 589840 - DNA, 236 bp, Homo sapiens
gcgtcgacgaggcaggagaatcgcttgaggccagcgtgtttgaaatgagcctgggcaacatagtgaggccaaaaaaccgaaataattagctgggcatggtagcatgtgcctgtagtcccagctacttgggaggctgaggcaggaggatggcttgagccctggaggctgaggctgcagtgagctgtgatcatgccactgtatgtactccaacctgactcaaaaaaaaaaagtcgacg

SEQ ID NO: 589841 - DNA, 210 bp, Homo sapiens
tgctgatacaatcagctctgtaccctcaggagtatattctcaaagggagtggtcagcagccctggccaggaaatgggttcaaggtgatcatatgaaaattgcccatcagttcttccagttggtgggaggatcagctagtgaatgtgatacaataccaggtaggcagtgcatggcttcctgtttcttcctgcttaagcaatatgatgatgt

SEQ ID NO: 589842 - DNA, 407 bp, Homo sapiens
  misc_feature (204)..(205): n is a, c, g, or t
  misc_feature (212)..(212): n is a, c, g, or t
  misc_feature (219)..(219): n is a, c, g, or t
  misc_feature (237)..(237): n is a, c, g, or t
  misc_feature (252)..(252): n is a, c, g, or t
  misc_feature (261)..(261): n is a, c, g, or t
  misc_feature (274)..(274): n is a, c, g, or t
  misc_feature (279)..(279): n is a, c, g, or t
aacattttagagtaattttaacacttttatcttgcccagaacataaaaaaatcttcattttcaatccttataactttgtgtgagggaaattaggcatcagggtgggaaacagaggtgacttttatttgtctaagtctaccaaattgctgaactagtaggtaaaactcccccttcctcttaactgagctgactgattttgcgcannattttcnctttcgngttcctccatttgggttncttcggttcccgggnattccaggngggattccttttnctaangcacaacctttggggtgtaggttaagagacatttttccctgtgtccccaccaccccttccacacatgtgcaggtctcccctgagtgcccagacagcgcaggaccacgcagtccactccctctgcccct

SEQ ID NO: 589843 - DNA, 423 bp, Homo sapiens
taggtggaaacagcgactgtaagagagacagaagtcctgacacagtgcactgcgcgctgcacacacacagacacacacacatgacgcacccaccccaacacacacacacacacacccatgacgaacacacacgtacagcagggaacaccctcccgcaggcagcccctgaagctgccgggttctgctctccgcgactgatagccaccggtgagagagccgcccacgggcacgcaggcggacctatgctctgtcatcacaagggctccacttttggggagactcgcccgcacacctgtccgcgcacgcctgagtgctgggatcccgcgctgtctcgccggcgatctgtctgaggtttcttccctcctggggtttcttcctgctgctggaccctccgcgaatcccggcctccggagaacgtcctgg

SEQ ID NO: 589844 - DNA, 939 bp, Homo sapiens
gctgagcgggccgccgggctccggggcttccccttgcctggcccgaagccgtggagatgagagacccgtcgagccccgagctctgtagatcttcccctgactcggaggccgctcagccgtacctctcgttcccgctcggagagctcccaccgtcagaagatcctagtagatagtccggtgccgaatccagaaaccccgcctgcccaccctagtttccgaaacctctccctcctgaaccactgaaagtccgttccccgatcatcggagtctcacacagagaatctgtcgcttcagggccaaagctctgagacttgcccgcagcaccctgtgcttggagctccgacacccgagactgcaactgacctccctcgccagctcggagccctcagtcccctccggggcttgagggcccttccatcccattctggactcgaagtacagtatccccatcagaatggtttggtggatttgagccctttgtcccatcccagagctcagagcctccatcctgcatggaggcccaatcctggggctctgaggattgggcagcctcccctcatctaagaatatatttcatacccctggctttaacaccgggttgttcggggtccttcactcttccttcgcgctcaggtgtctgcgggtggctcgtaaaccggaccatccgcggcgctaggggacctaccaggccctgtaggcggcagtgtgcaagcgcactaaacagcgattccaacaaggggtggtgagcccagaagaaatgccgctcgcaagcccaagcttcagacttcacccggattgcgtagaaatccgggccacagacttgatctagacccgcgaagatccgagcagagacaaaacggctgtcaacaacacacaccagaaacctccaccggcacacccacatcacagcgacgcctcctcgcacgcgaccctcaccag

SEQ ID NO: 589845 - DNA, 227 bp, Homo sapiens
aaaatatggtacattcgtgtatgacaggtcactccaccagcatccttatagtctgagtgcctaccatgcagaaagcagcaagtaaatacatgtgagggcaaggatcatgtctcacacatctttataacatttttggtaagacatggtgctgggatctaaaataggagtatacagtcatgcgtcacttaacgatgggaataccttctaggagatgcgtcataaaggta

SEQ ID NO: 589846 - DNA, 125 bp, Homo sapiens
cggttacatctctctatgaagccctcaggaatgtccactcctctctgcttacccctcctgtgtgacaccttgcacctctgcctggcccttcccagagcccacagagtaaaaatgttctggttctg

SEQ ID NO: 589847 - DNA, 322 bp, Homo sapiens
aaccccgttggtgctttgcagaaactggtggtgcaaaaaggctggcggttgccggagtacccagtgacccaggagtttgggccagccccccccaaaaaattccccatgacctgtcgagtggagcgtttcatttagattggtaactgggcaaaaaggggttttccccactcctctcccccagcactttggccccaaccaaggaccccaaagcctcagccagcccaggatccgtcctcttttttttggtgattatgaatgggaatgaaatcagggggctgtttactaaagcctggaataaatatgctgctttgtggttttttta

SEQ ID NO: 589848 - DNA, 154 bp, Homo sapiens
  misc_feature (80)..(80): n is a, c, g, or t
  misc_feature (83)..(83): n is a, c, g, or t
tcgggctggcggggcgtcctgagggtagagccaggagagggatgtttcgccattaagggggccaccacctctgtcatgtnctngctctggcgatctttttggactccagctgcttctggtgtttcagctctgctccgtgcttctggagagactc

SEQ ID NO: 589849 - DNA, 1049 bp, Homo sapiens
gcctgaagtgttctttggctgtttaacaacttatttgtatgagtgttttattaaacataacggctgctgtctttggtaacatagatgagggtggatttttaaatggcttcgtatcgacccctttctacaactaatggacgtagtctatgttgctccatataaattacagaatgaaaatagatggggcaaaagtttgactaaactttacctttttatagtttcactttttaagttatatttagaatatatcgatagattataaatcgattgtgaaacattttttctctgaattttttcaacagtgtctcacatcagttacatgagttacaaggatattctcagatcctgctatcttcaattgcagtctttaacaaaaaaccagcctatgtgtactactaggtatatatgtcatattcatacagtaaattcatttcaaggttttatgccagtgggtatactggagcttaaagaagttgaggtgaaccatccaggacaggtcttgtcaatgttatgctcactctactcatggactagggggcacatatatactatcttcactactcgtaacccattgtacctgcaataagcttacatcaccccctcgaaagccacactggttggaccagggggatgaagatatgggaattcaccaggtctaatggaccatatttgaagacagaggtgtgagctaatgtggacaggtacaaatgggacattgaagggaagaaagatatccggtaaagaattgctgcattatataacagtggcaataaagtgggatatcgacatagctgccgccaagccgggtctttaaacggccaccacaacgaccaccaagaacagagcgggacaccagacaccgggacacgacagagacacccttaggcccgaagaacaaggcaggaccaaacggcccaagcgacccatgatacaaaacggctccgacaacaacgcaacacacgggcgcgcgcacacaacaaggccgggcaaaaacaaaggaccaagagatcaaagcaacgccagtgccgatcacgaacaacgtgcatcga

SEQ ID NO: 589850 - DNA, 292 bp, Homo sapiens
tggccctgtatgcccttctatccccttagctgctggtgtgatcatagcctcaaattgctgggctcaagtgatcctcccacctcagcctcccaaagcacagggattacaagcgtgagccaccatgcccagcctgcaaaataattcttaaacttgaagaggtccctggcaaaaaaaggatgatttcatccataggtgacacagcaagaaggccctcaccagatgcagctcctcaatcttggacctcccagcctccagaagcatgagccaaataaatttctgttcattataaatt

SEQ ID NO: 589851 - DNA, 843 bp, Homo sapiens
  misc_feature (21)..(21): n is a, c, g, or t
  misc_feature (76)..(76): n is a, c, g, or t
  misc_feature (116)..(116): n is a, c, g, or t
  misc_feature (269)..(270): n is a, c, g, or t
  misc_feature (289)..(290): n is a, c, g, or t
  misc_feature (325)..(325): n is a, c, g, or t
  misc_feature (331)..(331): n is a, c, g, or t
  misc_feature (336)..(336): n is a, c, g, or t
  misc_feature (338)..(338): n is a, c, g, or t
  misc_feature (340)..(340): n is a, c, g, or t
  misc_feature (343)..(343): n is a, c, g, or t
  misc_feature (358)..(360): n is a, c, g, or t
  misc_feature (370)..(370): n is a, c, g, or t
  misc_feature (386)..(386): n is a, c, g, or t
  misc_feature (395)..(395): n is a, c, g, or t
ggcttcgtacatgagtaatanccatcataatcggaggcttgtgtaccttctaggtaacgaccagatctacaacgtnatcgtcacagcccatgctttggtaataatcttctacatantaatacccatcataatcggaggctctaggcaactgactacattccccgtaagtaatcggtgccctgcgatatggcgtcgccccgacataaacaacgtaagcttctgactgcttacctcccttctctctcgtagctgcctgctgcgcgatctgnntatagtggtaggtccgganncaggaatgaggttgaacagtctgaccctcccttancagggnaactnananagntggaaacaccaaaannnacaaaggganatataaaaacgagaantactcagantaacacttaaaagaagagcatgcgctggtgtcgtgtgattattgggcgtgagagagggcaatgagagactcgcggaacatgttccctttggcatacctgcccaatgcaggggaacttcttgcccacgctctctcgtgtctttttgtactgcaaacgtcgtgtgtaaaagcttctttgctagtagcccaccttaatgcgtgtggggacggaggaacgaaatacctatatacatctgggcgagcacaattccactataatataagggccctctggccatcctggcccacgttgccttggaaatctcttttctgctgaaccatttgcccctggcttcctattgagaaagctgctaaacaggttccgcaatttcaaaaccccagaccacggttattgcccaaacacttctgcacggggatcgcaagctcccaaaatgttctcccgacagaaa

SEQ ID NO: 589852 - DNA, 207 bp, Homo sapiens
tggtgatctagaggatcccgtatagagcataccctgggtcgaacatctcctttacttggagaagttgatcgtctgaagccttcttctctcaactcatcaaagccattctccatccagctttgttccattgctggcaaggagctgtgttcctttggaggaggagaggcgctcagatttttagaattctcagcttttgtgctctgtagt

SEQ ID NO: 589853 - DNA, 252 bp, Homo sapiens
tgcaggcttgatgattttggccccatggatgttcttctgcagtgaactgctgcactcaccatcttctcctgtttcttcttggtcccatgtagaaggttgtcatgcttctcactaaatctgggtgtcctgctgatcttcctggctaaaagttagggatcatcaagtggccagagatatccacaagcactacccaacgggcatagcatcgccatcctgctccccaggtgctctgtaacaggtgcatccgaaaga

SEQ ID NO: 589854 - DNA, 808 bp, Homo sapiens
agcgaagggtttcagcggccgaagcagagcctttttaaatagttcccaatgggcgctcacggccaaacgtgaacacctcccctcctcacctgtcacctcctgaactttacagggttgcgagggggagtgtgggatctgggtgtcgcctagccgtggtcgtactgtccgggtgtgtctgagagcccccgtctgtcatccctgtctgtctttccgggcctttactttactgtcttaacacaaccagccccagccactgggtgccgggggtggtgtgactgtgccttcaaatcgtgcctgggtactgacccacgtgctgggggagaaatggagggcaagagacaaacaaagtactcctgctcacttctgcctggtagctgggtgcagcaggtatagggggagggactggggtcttcagtacgtcgtacgaggaaggaagtcttgacgggaagaaccatattctacgaaatcaatgctctaacacagggctccggaaaacaatgctgcctgctggggtatcctaccttccaggggccctaaagcagtttgatacattcctagataccctacaggagtttccctgggtcacggagaaagctgaagaagagcgaggggaaagagggcactgagcgagctgtctgcaggtgacagattgactggggatcccctcgcgacatcctcaaaagtcccccatcagaccggggagattaaacacgctggtgccacaggctgggccctgagtgggagcccctggtgctgtctctgggactgtgcccgacggatattaccgctgtaaaggcgacacacccaa

SEQ ID NO: 589855 - DNA, 885 bp, Homo sapiens
aacggctagtgagccgcgcgtaatcggccgagggagagcgaggtacttggttactcactccatggctgcagcaaggaagaggcggctggtggcctcgtgctgaagaaagaaggtgggagcggagagcgcaggcgtgccgaggtggatgtcctgtcttttctctgttgcagaaacccaccttgtcccatccacatcagtgacatcccagctggagttcaaccttcatcccttctgtggcagttaggatgacttgaatcaaggtccagagaatgtgtgtgagtgaatcctgatacttgagctgaaatcttcccaatgtgcttgcagacacctgactggattttgcttttgtggatgccagagtagcttgcctgccaccatgagtcctggagccatgagctgtggtttaatttttgggaggctaccttggtggccccatacaggctgggttcacagttttgtgcacattgcaaatgacgtgcaatcaaaccacacacttgcatacatggggtttatcgtttctcacacacatcatagggcacttggacgtggtatataattatattgtgagagctcccctttccaaaccaagccaccaaagtacccctttccaagactgtgcccttgttctcaacttagccaacccatgatatcctgtgcccaccacatgactgaccatggcttcacttttatgtgaacagacgactctttgctctccgcgggcggacacttgtgacttttctattgtggagatcagcgtgcttcaaaagctcaacatttgagcaaccaaaatgctagccaaccccagcccatggcaaaacccccaggcggacttttgggctgtgtcatgcagcaaacctcaactaaatgccataatctgagcaacgc

SEQ ID NO: 589856 - DNA, 127 bp, Homo sapiens
aatacaagggctatgtgtttgatagaagagtatgcaactgagcgatataaggtctgtttgtcgtacgcaagatggagcttgtcataattatgcctcatacggatagtacaaggaggtgctgaaggat

SEQ ID NO: 589857 - DNA, 879 bp, Homo sapiens
gctgccctctggttccttaatggactggaccaggggctgggttggcccccatgtgggaaggtcctgcggaagtggtttgagccatctcagttggcactgtggtggggccatcctgtcaaccagacatgaacctggctggagggcatgggaccctatcctggcaaccatccttgccagagactacgatgctggatgacagaagctggcctatctggggcactgtgtgtgtgtggtctccttcctctgttctcctgttcatccacaagtgaaccctgctgatgtggactccgaaactgtgatgcccatgccctctgatgggcactgatagggctccttgaatgcgaggagaggaccctggcaggaggctgctgctgtgcccttacctgtgggtgctctccatggtaacgcttgtggtgttcgaagtaaagacctgctagtatggactggggcaggttcttccttattcaggagaactggacagttcggcccttgtaggtagctcctacatgagtgcccttgaagttcgggggccgttgtatggtcagcatcgaagctggttacgtgtcaagaacggggctatggacaaaggcggggactgtccaattgacgggaaaccctcgactaggggctgtaggggggtgcatgatggctggcatgacaggggtccaagtgcctcttccgtgtagcagtgaccagggaatcccccaaggtcgaatcggatatgggaacgggtttcgggtcccacgaatggccattggccgttgggggctagccaagaaaggcctccaatggttggctccacgcggggactaggaaaggggggccggaggggccacacgtggcacacaagggcccctggggagaagcggacaagttcca

SEQ ID NO: 589858 - DNA, 931 bp, Homo sapiens
cgcccgctactcatggttctcccggctgctcccgggtgcctgccgctccccggtatggtgacgccgcgtggttcttcatggcacatgggctcactcaaagctgttagatcttcgggccaccttggtgacgcagatgccccccggcaaccgcgggttcccctccaggaatatcgtggccctcccgcgccttttgccccgcgtgctccctttttggttgtccccccgttcatccaccaagatcactcgttctcttgctgagggacgggtggttgccccgcttttgcgtttaatcttcggcagagccgcccctaatttctgaaggccgtggtgtagcgcaccctgggtcataatggtccgcggcaaacacccccccgggagtggaggcagcttccaagtgcacccaaccccccgggagcgaacctatccaggtcggaccaaggaccaaaccaagcagattactcggcggggggttcataccaaaaaggcacgcggggaaccacacaaagtcctggggcatcgaccgagagccaaccagtagttgcccgccagatgctcacagagggcacaaggagtattattccccgcgtggaatccccccgccccccgcttcatgacaacacagggtagaacaacacctcatcacaacctggttgtgatccacatttgccaatattcaacatacactccttcctacaaactgtgttcaatagaataccacatgctcgattgtcaccgccacctcaagaggaacaggatagattcatttagtgagcccaccttggtcttattttatgtgttctagcaccgacctaatagttaattatgatttcttaaaccccctaacctttttgaactggaaccacactaggcccccaaaacacctccaaaatgttggcaaccccttacaaaataaaaagcagcaaacaaaaca

SEQ ID NO: 589859 - DNA, 602 bp, Homo sapiens
atccgactttggacatgcttggagaaaagattggcctagatgaccctttctatgctgagattcctgctactaggctgactgctgctctctacccccacaacatcccggttactcctggaagtactttgaaacacagcgaggctcagccgggtgtatcttctaccaagaagggcgacgtctgtgccaccccaggatagcaagttcaggttgcatgaaatgctgactgacacacggtcagacagaagaattgacttgcaagggaaggacacagtgcaccccaacttttgctcactccttctgaatattttttaagagcttattcttggtctgattagagcattctctaataacagttctcacttaaaaaaaaaaagttgcggcgagctattccttaggaggtatttagctgcctgccgcgttcacgcggatggaaactgcgtacccactatcgctgcgacatcccttcgcagctgcgtatacgaaagccgacgacgccttcacagtgcgcgctgatgcatggacccctgacgccatagcgcggggtggtacccaggacgtcctgcaggcctcgcgtcttgctctcctctctgccgtcgcgcttc

SEQ ID NO: 589860 - DNA, 204 bp, Homo sapiens
  misc_feature (5)..(5): n is a, c, g, or t
  misc_feature (25)..(25): n is a, c, g, or t
  misc_feature (63)..(63): n is a, c, g, or t
  misc_feature (70)..(70): n is a, c, g, or t
  misc_feature (84)..(84): n is a, c, g, or t
  misc_feature (116)..(116): n is a, c, g, or t
  misc_feature (120)..(120): n is a, c, g, or t
  misc_feature (139)..(139): n is a, c, g, or t
  misc_feature (145)..(145): n is a, c, g, or t
  misc_feature (160)..(160): n is a, c, g, or t
  misc_feature (176)..(176): n is a, c, g, or t
  misc_feature (182)..(182): n is a, c, g, or t
tggcncgagaaacagtgaaaagggnatgataaaatgttttttgaatgaactgttttttttgtngacaagntgagaaattgttgncataaaaaaaaaaattgaaaaaaccccttttncccntttgtgaattgttttgaanttaaangtcccctaaaacaanttagacttttgtttgntaaatntgtttttttttttaatatttta

SEQ ID NO: 589861 - DNA, 621 bp, Homo sapiens
tccttctgtcatcagcaatcctgactctatattggatgtaacttttcccctcaaatcccaacatttccatatccccttgccgagtaaattaggtccagagctatagaaactgttctgtaagtggaaaatgcttcagtatagattttgattttcaggtactcattttatttgatgagtttaaacctccattctttgagaagctcattttagattcattagactcattttttatgttgataatatatcatttaaatgtccatgttctactatccttcagtaaatgtatgaacttcattgaaagctgaaacaaaggggtttcaaattaaatgaagttgttaattgtctggtttatcttgggggagtgcaagtcagtgtaatacttcactaaactaacacagtagtaccatgaggactgtcagagagccagaggaggggacccaggtttgaggggaaaagaccctggggtaccgagcggaagaatgatgtcctgactgagacagggataagaaggaattgggtggagtaagagtctagcatagagccttctggtagagttagaagggagatgagaagaaaacactgtatatatacatagaatactattcgcctttacaaagaagg

SEQ ID NO: 589862 - DNA, 277 bp, Homo sapiens
  misc_feature (68)..(70): n is a, c, g, or t
tagcatttaccatctcacttctaggaatactagtatatcgctcacatctgatatactcctactattgnnnagaaggagtaatactatcgctgttcattatagctactctcataaccctcaacacccactccctcttagccaatattgtgccgattgccatactagtctttgtcgcctgcgaagagcaggttgggcctagccctactagtctcaatctccaaccacatataggctagactacgtacataacctaaacctactccactgctaaagctat

SEQ ID NO: 589863 - DNA, 555 bp, Homo sapiens
  misc_feature (1)..(1): n is a, c, g, or t
naggcttccccacccacattcatatcctgcgagtaaataggcagagtatagaactgtctgtagtggaaatgctcatatagatttgattcaggtctcatttatttgatgagtttaaacctccattctttgagaagctcattttagattcattagactcattttttatgttgataatatatcatttaaatgtccatgttctactatccttcagtaaatgtatgaacttcattgaaagctgaaacaaaggggtttcaaattaaatgaagttgttaattgtctggtttatcttgggggagtgcaagtcagtgtaatacttcactaaactaacacagtagtaccatgaggactgtcagagagccagaggaggggacccaggtttgaggggaaaagaccctggggtaccgagcggaagaatgatgtcctgactgagacagggataagaaggaattgggtggagtaagagtctagcatagagccttctggtagagttagaagggagatgagaagaaaacactgtatatatacatagaatactattcgcctttacaaagaagg

SEQ ID NO: 589864 - DNA, 429 bp, Homo sapiens
gaagccggaggtgtccggcgggctgcagttccggttatcgcggccttcccacaccttcgcgtgtaccaccacggggctagaggggccggggagcgcatcccgcgcccgcgacaagagagaaggcaaacagaggaacacagatagggaccacatacggagaaaagacagcaatagcaacgagcggaaatacacgcggatcccacgaacctggctacctactaacaagaagagacaagcaccgaaaaaaccaaaaaaccacaaagagagcaaagcaacacaaaaaacacacaagacacaccacagaagaagacaatagaaacacgtcaaaaaacaacaagccgacaaacaagtgacacaactcaacaaacaaaaagatacaacaaaaaaacaaacacaaacacagtaacaacaacaagaaaaaaacaaaaa

SEQ ID NO: 589865 - DNA, 454 bp, Homo sapiens
agcagtaggctctaaataactcccataagcttagcgttccaataatggaacactagacataaatgggtcaagatatttttcttgagattcagtatctttacctagtcactgattattatttttacaaataattaagctgaaataactaaattcctctgtagcaccatttatctgatttatccagaagtttgcatctctttgttatctttttttgttattctattatgttcatagtatattaagtaatgtacagttgcaccttctctaatacataattatgtaaagtccaaagcattgatgaccattttgaattttcagaaactgtatgttttctcacatgggaacaagaacaaaccagaaatataaaatagaatgagagtttcatgaaagaaaaggatttagcccacatttccccttaccactaaagaattcacacaccacacacttcttaaca

SEQ ID NO: 589866 - DNA, 181 bp, Homo sapiens
ttccccgcgccgattgggcctgtagctggcttttcagctgaggcccgaggacaccatcttaaagtctgttctgctgctgcccccgtcactcaccttcgctggagatttgctgccctttgtacctgggagagcttgaaccccgttgtggtcgcagctcgtggggcgtagtcactgtggtcga

SEQ ID NO: 589867 - DNA, 581 bp, Homo sapiens
gtggaacctctctgcgtcccagattgtgctctgcccagtattcttgcgttcagctagctgtgaatgtgtttgctctgcttctctacttcttttaattgtgatgttagggtgtagattttagatctttcctgctttctcttgtgggcttgagtgctataaatttccctctacacactgctttaaatgtgtcccagagattctggtacgttgtgtctttgttctcattggtttcaaagaacatctttatttctgccttcatttcattatctacccagtggtcattcaggagcaggttgttcagtttccaagtagttgtgcagttccgagtgagtttcaatcttgagttttaatttgattgcattgtagtctgagagacagtttgttacaatttctgttcttttacatttgctgaggagagctttacttccaactatgtggtcaattttggaataagtgtgatgtggtgctgagaagaatgtatattctgttgatttggggtggagagttctgtagatgtctattaggtccacttggtccaagagctgagatcaagtcctggatatccttgttcaccttctgtc

SEQ ID NO: 589868 - DNA, 407 bp, Homo sapiens
ggaccatccatagctctgaactctctgataccttcacccgcaaacggcttctaaaacactccagtgaaacccctcatgtggctgtcatcctgagtgccgtgaaactggctacaaaatgggattcctttggcatctctaaaggaattcccaactgaatgggcaccaagtcagttcatggcattttactatctcttttctgctctcgttgctttgtgctctgtagggatttttgctgctctcctccctggtcgttaatatcagcacattgccgctgactgattgacttaggccatgcatgcagttggatcattctagcacatccaacatgtgttccttctatttccttctctgatcacatcattcttaggaaagacaggaatcagaaggctgcaccatcactttctgtt

SEQ ID NO: 589869 - DNA, 235 bp, Homo sapiens
cttgaacctgttttttggttttagagcctgcccccttccccccccccccatattgtgtagcataaaccttcaggggggtaaaagggtttttttctatttccctgggggcattttttgaaaaatttgaatcttataaatttgcttcaaagaaaccaagtaaatcaaaatggaagttttgatccagaatgggtagcattcatgaataaataataggcctttttggttttaaataata

SEQ ID NO: 589870 - DNA, 331 bp, Homo sapiens
tttggtttttttggggggcccccccccccagttttttgggcttgggaagggaaggcccctttaaaaaaaaaacccccccccccccccccgggggggggtgggccctgggccgggcttggggtttgtgccccccccccaccccggggccccgggggggggttttttttttcccccggtttttttttttaaaaggggggccgggttttccccccgggggggcctttttttcccccccgggggcccccttttttggggggtttttcccccttttttcgggcccgttggggggttttttgggggggacccccccattaagggggggggttcccca

SEQ ID NO: 589871 - DNA, 134 bp, Homo sapiens
cactgtatgggggagggggtgatctcgaacactctttacgccggtttctattgactatgggttactcgtgtgaccgcggtggctggcacgacattgaccacccctggggttagtatagcttacgttacacttat

SEQ ID NO: 589872 - DNA, 126 bp, Homo sapiens
gcagggaatggtggcttacacccgtagttggagatacttggggaactgaggagggaggatcgcctgtgcctgcagtgagcataaatcgcagtccagcctgtgagacaaagtgtgactgtgtcacca

SEQ ID NO: 589873 - DNA, 1050 bp, Homo sapiens
cctgggtcggggattttccctcgggaatccaatttccctcattgggtccagatggtcaattcaaggaatatgcgaacagctcacttcgcaggatacccagccctgcaaaaggaccatgaatgtcatgtactcttgctgtgcttttggctggaaggagaatttcttggattgagactcatatactttgggggctaacactggggccaaaatgtaaaagaaaccctttgtggcttagtaaagttaaatggccttgtggtttgtaacaggccataaagtctaacagcttgatctggatacccatcaagacacgtgaaatcattatcatgagcctagatgctgagcgaagagacctccgggaggatcccgaggactggcccatgttgctagccatgttgagactgtacggctgaggaggacccctaactgtcacgagcaacacctgtcgaacacagccacccacctggggacagatcaagaagtctgtcacagatggcagatagcatacctgaggaaagcgggactaaccgagtcacacatgagtgaattgtcatggtagctatgatagcagttatcaccacttgcttctgcagatgtggatcctaactcctgcgagaagtaactcacagtgacaaagctgccttcgcttgttatcgagcttgcaaatcaagagtaaggggggacatgttgggaatcaggccccccatagatctggccataaactggccccatatactggctataaacaaaatctgcagcactgtgacacgttcatgatggctcgtgacgcccacgctggaaggttgtgggtttaccggaatgagggcaagggacacatggcccacccagggcggaaaaccgctataaaggcgttcttaaaccacaaacgagtagcctagagtgatctgtgcctgtaaagacacactcctgctgcagataactaaccagacccaccgactttacttcggcccatccattcatttcccataagggatactgttagttaatctattatcgtatagaaacaatgctaatgagcctgacttactagta

SEQ ID NO: 589874 - DNA, 1494 bp, Homo sapiens
  misc_feature (50)..(50): n is a, c, g, or t
  misc_feature (883)..(883): n is a, c, g, or t
  misc_feature (1209)..(1209): n is a, c, g, or t
agtaacatatttgtctccggaaggagacggcctctctcaccacttcactngtccgggaaagtgttgttttcgacccgattaatttccgcgctatagaattgtggggaaggtctgccccgagaagatagatttgtacttctctcccgatcataatacgcctgggcggcaacaaagataatattttcttctcgtcaaatccacagacaccgtcgtgtatagtttgtggtttgtgtgggtcctcctttcccccacccaaagagcatccgctgtctgtgtccatagtttcttccaatggggggccacacaccccattgtgtccccccttccgctggtaatttccccgggccatgatcctcacttttcctcgtgttaccccacaggagatggtgcccccctcggcgtttctctctgttgttgcccacagggctttctcagagccccacaatgggtccgtggatattcggctccgcgataattaaagagattgcctcacgctctttctatgccgttgtatcgaatgagtttctttggggggaaacataacccgagcgggaacgcgtattgtatgaggaagtgggattgtgtaagtgttattataatggtaaggagtggtagtgagaatccttttctaaaggcccaactttcccgatcgcgccgcgactgttaatataccctgctagacacttgtgtatggacccaccgcaggaattttcgtcggagaactaaaacgctcgtgtacacacgcgggcccccccaagcgagctcgtgcgctctccccccctcgagacgcccgcgccccacaaaactcggggtggttctcggcgccctatatatgaagcgggagagccccgcggggggcttcccgcgcactgtgtcccacacncccacacacggtgtgccccgcgagatattggcccctcataggaggggccccctctctcgagggaagagcctcaagaggttccccacggcacaacagggtggccacagcctgagccccctatacacactgggcctcgtggacacacattgctggcttggtggtcttgtgcccttctgggtgtcctcgtagaggggctatatagggcgagacaacattccccccacaaaaggggtatataacaaccccctgggcttctgcctacactccactgagaaccacgccccacggcacttccacgcccacgctgaagtggggcacacccacantgccctctctccacggaatgaagaccccacgctataaattcccgcgaagcgtggagacctgggcacaagcctgtggaggccccacggccaccacggccacatctcgccttggctttcatgagctgtggtggtggagaataagtgtggggagagcctcgcccacatggtttcacacctggccaagaaagtgcccttatagcttctggaatccccaccctttggcacagctttggccccaaccaggcccctctggaattgtccctacctccacccagtttcccgaga

SEQ ID NO: 589875 - DNA, 84 bp, Homo sapiens
agccccaaccagacctctctgtacttctgtgccagcagttttaccgtggtgaggctagcgggggttcgggagacccagtacttc

SEQ ID NO: 589876 - DNA, 959 bp, Homo sapiens
gaggcagaggaacgcaaagctgagcaacatggacgttgaatatcgccccactccgctcctgggacgatttacttcccgggttcgcgatcgcttgtgcccggacgactacagggacatgtccaaagtggacacaaccgcggtagttgagcaagctgctctaattaccgagaccaaaacttacctgtgtgggctggtctggcattgatgaattggcgcacttgtgggggttctagagtcccttcgacatgatcctggagaggaatcgtggtgtgtgctggatgttcaccacggttgtgtgtgtgggggacccaccaactaaagatgtctttcgggcggatgaagaaagcgctaagccgacgacgtgccggcaatggtggtcatgttgagctgagctattttcacttatctccaagtgttgacaggagtcatggtctgtgtgtgcgggcattactttctccttctgctcgtggctgttgatccatgcatcgttgcagaccttcgggaacctctacagaatcacaacgtggagtaataaaaccctggacaggactcggcgtctcgacagaggacacccgatggcctgtgtcctgggatgccctaggacctagcaggacagatgggcattcgaccagactcacctggaacttataattcagtcaacagtgaaggtcgttaaacagtaatcaacggagcctacggtttgcaggaagaaactgcggtggccgttgggccattgtcaagaacctaattactggtggggttgagaaacaaggagtgccggtacccccaattattaagggacgttcaggataggcgaaacatattagctggttcgatgagcccggaccaagaaaccccctcgatgtggtcatccctgtcgacacgtaagggccacacttgggacaacacaagtccggcgctttgaacacgtcgcaaaacgcacataccgccacgacgcc

SEQ ID NO: 589877 - DNA, 1434 bp, Homo sapiens
  misc_feature (687)..(687): n is a, c, g, or t
  misc_feature (1167)..(1167): n is a, c, g, or t
gctctcttctttgtttgtgtccccccttcttggggggcacaccacacagtttttgtggcccccacccttattttgtgggtgcgcccacttcttcttttgtgggtggggcccccctcccccgctgtgggggcgcccgccccccccctctttgttgcgtccccccctgcgaggtgttgtgggaggcgacactctttttggtgtgagagggatggtggggtgtacctcctcttttggcgacgccactcatggggggtgttgtctccccccccacctggggcgactaccacacaggggggggtagagcccccccgccatatattttctctgcgctttggtggcacccgctttctccccccgtggggtgtctcaccccggcggtgtgtgtgcctggatcgtctttatatgtctctctccctctcgtggtggagtccccccctccccgctcggctctcacatctagttcccttctctgtttggtgcgccgcggcggtggtgttttctcacagcaggcggctgccccatcgtcgtggtggtatttgagtggtctcaagcgagagagagtgtgatttttttcccccacagcagagatataatagaagatatgttttacctactacacaacacagcacacacagcgtgtgttgtggtcaacagcacgacccgccgcgcgctctcgtcgtcgtcgtntagagtgaagagagagacgctcccctctctgctcccacgcccgagtgtctctcatcacgcgggggacgcgcacaccactactgtgatgagagagaggagactatgttgtgtgatgatactactgtgtcgtcgacatagagaagagcgacgactactctcttctcctctctcatgaatgagagagcagacagctcctctttttctttcatctccaccacctctgatgatactatactgtgtgtggtattctcttcctcctctcgcggcgtggcgctcatctcttgtgtttgtgtgtgtatatgtctactcccccgtcgcaccgcgcgcgtcgttgtgtgcactctcgtcgtgtggcagagactacacacgacgcgtgtgtgtgcgcgccccagagagcgcaccacctctctctctctcttcctcaacagcgcgcgctgtgccacactctctcccgcgagacctctctcgcgcgcggggtgnttttcgtgtgtgcgagagagaggccctctcgtgtgtctccgcgctctctctcgtgtggtgatatctctctctcgtggtgtgtattttgttgtctcctcacgcacaccgagcggcgtttctttgtggcggtgtctcccccaccccgcgacgagagagggtgccctctggggcgcggggcgccgcgtgccccctctgggccccgcgcggctccttttcctccccccccctttttctttttttgtttatccctctctcctctctttttta

SEQ ID NO: 589878 - DNA, 100 bp, Homo sapiens
tccacacctgcacggtagtctacacctgcacctggtagtccacacctgcacctggtagtcccactacctgcaccgggatgtccactaccttcacctgtgc

SEQ ID NO: 589879 - DNA, 858 bp, Homo sapiens
  misc_feature (20)..(20): n is a, c, g, or t
  misc_feature (122)..(122): n is a, c, g, or t
  misc_feature (140)..(140): n is a, c, g, or t
  misc_feature (148)..(148): n is a, c, g, or t
  misc_feature (163)..(163): n is a, c, g, or t
  misc_feature (206)..(206): n is a, c, g, or t
  misc_feature (270)..(270): n is a, c, g, or t
  misc_feature (284)..(284): n is a, c, g, or t
  misc_feature (349)..(349): n is a, c, g, or t
  misc_feature (375)..(375): n is a, c, g, or t
  misc_feature (408)..(408): n is a, c, g, or t
  misc_feature (417)..(417): n is a, c, g, or t
  misc_feature (421)..(421): n is a, c, g, or t
  misc_feature (448)..(448): n is a, c, g, or t
  misc_feature (453)..(453): n is a, c, g, or t
  misc_feature (458)..(458): n is a, c, g, or t
  misc_feature (465)..(465): n is a, c, g, or t
  misc_feature (572)..(572): n is a, c, g, or t
  misc_feature (631)..(631): n is a, c, g, or t
  misc_feature (635)..(635): n is a, c, g, or t
  misc_feature (643)..(643): n is a, c, g, or t
  misc_feature (726)..(726): n is a, c, g, or t
  misc_feature (815)..(815): n is a, c, g, or t
cattacctgaagttccaggnaggccctgaagggcattggcacatccagtcccagcccaagatccagtctacccaggccatgtccccgaatgggcaggaggccgtctgtccagtttgtatatntggatcagtctctctgantgtctganccgctgcctgcaggncccccccattctccgcacatggtaggggctgttaggaacatancgtggcatcccccggtggaccactgggccccagtgctgaccatggggattagggccagggattngaggtggcagaggnccaggcacaaagttcactccagggccacatcctaagtggggtggcatcgagaagtcctccactgnattatagttgaagaattcatggggtnggaagggctggcctgggaaaaaaaggatatcanaaaaaaagngtanaaaaaagggaggtggcaaaggctaaanaaatnggtanggaaaangcatgggaggaggcaaagaagaaggtgggggtgggagcaaggccaagtgctccccgaagtctggggtctgcctatggcttccctggaatggatgattcatctctgcncagtcctcaatccacgggtcagggggatagccacgcttgggcagctccacgccccaggntcancaccatgnggtcagaagcaggtgtgagaggtggcggtgtgcatgctggtcccagtggacaccatcccgatgacggtgctgtactgcatgcnggaagtgaaagtggaggtctaggacatcaaagcagtggtccccggccagcgtagacttgtagaagttcccttcaaccacatcccgccgnagggagcctgccaggggctggagctctggcaggaggaaacccc

SEQ ID NO: 589880 - DNA, 643 bp, Homo sapiens
  misc_feature (274)..(274): n is a, c, g, or t
caaaaatattgcttccaaaatcgccaatgagttaagctgtaccccagtgattatgatgtaaattaaggagcaataaaggtgttttcttgaccacggagggaaatgtatagaataatatttaggcaaacacgtctgcatcttctaaatcatgaaattaaagtctgaggacgagagcacgcctgggagcgaaagctggccttttttttacgaatgcactacattaaagatgtgcaacctatgcgccccctgccctacttcggttaccttgaaagtnggggtgtggccccatctccatgtgcctcccgtttgggtgggtgtgagagtggacggtatgtgtgtaaagtggtgtatatggaagcatctccctacactggcagccagtcattattagtacctctgcgggagatcatccggtgctaaaacattacagttgccaaggaggaaaaaactgaatggctgctaagaattacccttaagaccagttcatagttaaaacaggtttccagttcaggccgggggttttgtgtttgttgttttgtgtttttttagggcaaaaggtttaaatttaaagttgtgaacattgcttgggggtgtttttttaagtagattcccaaaataattaaaaattccctttttctcagta

SEQ ID NO: 589881 - DNA, 481 bp, Homo sapiens
aggtttggtttccctaacggttaccaggcggggtatttctggccataacgccgcacctgttccttgcaccccgagaaagggcaagccaacaagaataaaagactttgagctgatgcaagatatggacctggatgagcctctgatattggcacggagacgtggagcagaagcccggaggctatctatcaaagtggagatgagggcaaccaacggtttaggggcagggctgatagcagcaggtcatctgaaccaagggatctccctgttggcggacttcatcctgagagggtgatgaagagctcgctttctgttattataactgtccactgcacgcagggatacataaatcgcaatatttaagctctgaaggccgatatcccccaactgtaagccacatccatttattattctggaaggccctaagaccgtccatgcaagcttcttagtgaacttttgaaccatgcttggggacggctcctct

SEQ ID NO: 589882 - DNA, 125 bp, Homo sapiens
agatcaaattggttttatgccctttcccccagatattgtagagcaagtctgtgttacaagcccagtgtgacagtgtcatgatgtactagtgtcttactggttttttaataaatccttttgtatag

SEQ ID NO: 589883 - DNA, 356 bp, Homo sapiens
  misc_feature (10)..(11): n is a, c, g, or t
  misc_feature (19)..(20): n is a, c, g, or t
tttaaaaaannaccccacnnccgcggacacattaccaaggctcccccccacctctttttcctattaaagatgtaattcctctcattgatataaaaatgatttggaccttaagctgatttaaaatacttatttttatacggttccgctcatgagaaccagtgagaattaagggtactcatgagcattaaattccgtttaaattgagcccctttcatagacctgatacattcatttccctacctacctctcgtttttttttttaactttctccctctgaacttgtgtttgtttaaaattttcttttttcaaccagcattaaataatagattagcctagatattatttttaacggaagc

SEQ ID NO: 589884 - DNA, 317 bp, Homo sapiens
acgctcgggacagaaaaaaacattttcaataagactaaacacccaatgaagctaagtaataaaaagaaatgttaggtttaagtgaaagtgtagaagcagtaaaataataagttatatccatggaagtggataaagagaatgaaagctccacctaagtccagtagctgccattaaaaataaaattaagaaattgataacagaaatgatgaattgtattttttctttgaatcataaaattagaatttgacaaaggaaaataaggaaagatagggtagaagcaggaaatttaaagaataaagaaattataatctaattca

SEQ ID NO: 589885 - DNA, 531 bp, Homo sapiens
  misc_feature (18)..(18): n is a, c, g, or t
  misc_feature (61)..(61): n is a, c, g, or t
  misc_feature (66)..(66): n is a, c, g, or t
  misc_feature (112)..(112): n is a, c, g, or t
  misc_feature (268)..(268): n is a, c, g, or t
ccggcccgtaaatccaanatgtaggcccggcaaacaagggggccgcatcccccccgccccngtgtngggtccctccggccatttgtgtgttgcccccggttgggtccacacnaaggtgggcgccggccccggtttcaccctggaggagctcaggttggccggcattcccaaaaaggtggcccggcccctcggcatttttttggatccaaggagggggaaaaagtccccggggtcccttcaggccaacgtgcagcgggtgaagggggcncgctcccaatttttccttttccccaggaagccctcggccccccaaaaggggaacagttttttttaaaaatttaaattggcccccccactggccgggccggttatgcccgtccggaaggtttttaaaaaggagaaagctcgggtcctcccttgggaaaaaaaaaattttaaagcctttgctagtttccgtttgggccgggcccacccccggctttttggcatacgggcaaaaaaaaccaaggaagcccccgaaccgggttttta

SEQ ID NO: 589886 - DNA, 368 bp, Homo sapiens
acggagacgagttctggctccatttttgggagtcgtggttactctgtaaccagtaacagagagaactatgaaggcagccacttacactaatgctgttgtcctgaacatcgttcactatgtgtctggagcctgttttgtcaatttctgttcggtaattaatggaaattggcttgctgcttgcggggctgtctccacggccagtgacagcatacacagtgatggtataatcaactccaggtttaaggccgctgatggtagctgtagacttgctcccaggcacagtgaactcctggacagggctatttcctcctgtttctccgtaagtgatcctgtaatatctcactgtgacagcaggagcattccagctg

SEQ ID NO: 589887 - DNA, 397 bp, Homo sapiens
ggagtgcaatggaatgggatggagtggagagaaatggaatggagaggaaaggattgctatggagttgtctcgtatagaatgtaatatatatatatgtaaaacaccaggtgcctaacctggcacagagcaggagggctaagcatgacattccactccactccactcaagtccattcaattccattccactaaactcctttcaactccactccacactattccattccccttcattccactgcactcctctccatttactttccactccactccactccactccattccactccattcctttccattcctgttcactccattccgttccactccactccactccattccactccattccattccactacaatccattctactctactccattccagtcc

SEQ ID NO: 589888 - DNA, 748 bp, Homo sapiens
  misc_feature (206)..(206): n is a, c, g, or t
  misc_feature (209)..(209): n is a, c, g, or t
  misc_feature (222)..(222): n is a, c, g, or t
  misc_feature (332)..(333): n is a, c, g, or t
  misc_feature (351)..(351): n is a, c, g, or t
  misc_feature (364)..(364): n is a, c, g, or t
  misc_feature (374)..(374): n is a, c, g, or t
  misc_feature (424)..(425): n is a, c, g, or t
  misc_feature (441)..(441): n is a, c, g, or t
  misc_feature (443)..(443): n is a, c, g, or t
  misc_feature (463)..(464): n is a, c, g, or t
  misc_feature (497)..(497): n is a, c, g, or t
  misc_feature (514)..(514): n is a, c, g, or t
  misc_feature (516)..(516): n is a, c, g, or t
  misc_feature (550)..(550): n is a, c, g, or t
  misc_feature (561)..(561): n is a, c, g, or t
ggcaagtacgtagtgtgatcaaacatgatcatccagaatttatattttttcttgtgtacagaggttacatatcgtggtgtcctttataaaggaaacattttaaatcccacaaattgacacttctatcttcaatgactaagatttttgtgtcagtaatctctgaaatttccttaaattatatattaacatagcagagaaatgatttnttngtatataagatgnttccacctgaaatgctgtcataagtactggggggtgggggagtgcccatcttgtacatgatattcttagaggtaataaggtaatgatgcatgaatttattttataaatcnntggactatgtatttgacntgtacaatatgtncagtattaangtcaaccatctctttaaagttagcctataaatattgttgtataatttctnntggtcagaaacacttngnactgaatagtgacactcggnnaggatttccagtgccatttagcaaaacgtcttnagtctatgcaactagcnanaaatctgcataatgcaacaacacagttttcacanttcaaattttncatgagggttcttcagattctcctgaacccagttagcaaaatgagaggaaaggcctaggagatattctgtaaatattaactctgtgagtatgaaacgtgttatattcaactcaaattgagatgtggctgcatgggaatttagggggaagaaaaaagggcgaattaggcatggcccataaaagaaatg

SEQ ID NO: 589889 - DNA, 897 bp, Homo sapiens
  misc_feature (143)..(143): n is a, c, g, or t
  misc_feature (273)..(273): n is a, c, g, or t
  misc_feature (603)..(603): n is a, c, g, or t
agcgggagacgcacgcagctgacttgtctactccggacgaccgttacagaggtctccgagacccttctctctcctgtgcaaaatggcaactcttaaatggaagaactcgatagtctagccagatttgcggtaggatggagggnaacagtttccgaaagcaactatagatccagctgtagtgggagtgtctggtaggaagttgggtaatggccgtcgtgcctatccaggcaattcgtagggcaaagctcattcctgggctgtatagaagcgttngactgcatttgtggaggatgcttctatggcaacggaatacagcgtgtacaatggagagaaactgagtcggcatcttggacgacaatgtggatgccttagtatgtctgtacatgagacactctaatcatagtaggccagactaagagacttagtgtctgtgacacgccacattcataaagatggtacgatggtaacttgcaagagagctgcgcgctactaggcaacgaagggaggagagcctacggggtcgacattctgggtgtcaggagcaagatgtctgagagggtctctcaaagttgcagttgattgccgtgcagcatcgatccaagntacaggtgccatgatcgccaatcataactcgctggggtttatccacatgcgcacgtgggtagctattgcattatcgtttatagattcagcgctggtaaaacctgatagtggcaattaatcccattaacagcacggctgtggattgtgagagtgagagtgttaactcatggtagttcatgctaggagtttctcgctagcattagtgagctgatgaacatttgggcaattcattcccgagacgagctgccactgggatggatttgcggggggaaacatggatgacttaagtgttgg

SEQ ID NO: 589890 - DNA, 172 bp, Homo sapiens
gtggggatgctaggagcgctgggtcgtcctttgttcggctggaggctcagaggatgggctggggtggggttctcagtccacctgtgtgagtgagggcagaaaccctcaggggctgggtttctgcccatgctcctgggccagccttacctgattcccccccactgcctcgtgc

SEQ ID NO: 589891 - DNA, 456 bp, Homo sapiens
ctcctaacgagtttcgttctgtggtacataccatgtagatacatagcactttatcaagaatttcccttattttctaccaataatctagaattgggtaatcgtgaattatccaaggtgatgcggtgtttttgtcgtttggcagtcgctcaccggtacaccaaggggatgcgctcagatgagccaggagatcgagcggtacctgcaggccggcactcgtgccaacacccggcggagctatcagcaggcgcttgagcacttcgaggtgacgtggggtggctttctgccggcgactagcgatacagtcgtgcgctatctggtcgatcacgccgccaccctgtccagcaatacctttgaagatgcgcctcgcggcggtggcgcagtggcattgcaagcaaaggctttcccgattcggaccaagattcggcttgtcgccagattctcaagggcattcgtact

SEQ ID NO: 589892 - DNA, 376 bp, Homo sapiens
  misc_feature (189)..(189): n is a, c, g, or t
  misc_feature (256)..(256): n is a, c, g, or t
  misc_feature (263)..(263): n is a, c, g, or t
  misc_feature (281)..(281): n is a, c, g, or t
  misc_feature (321)..(321): n is a, c, g, or t
  misc_feature (342)..(342): n is a, c, g, or t
  misc_feature (362)..(362): n is a, c, g, or t
gtcggggacgccgggcgcctcccaccggccgaagccttcctcccgcgcccactttcggggctctacgtcctatcaagtctaagcacccccgcctcgtctcccctagaagagccgccccggcgcggcgacacctgccccaggcaggaggcagccaacggcaacccattgtgcggactcatcgtccacagnccacccgggcgcaagagccgcaagctggtgtcccggcgtcctggggtcggggcgggggtcccagggnccacagntcacccgcacgcccgggnaccaccaggatcggggtcggtcaggtctccctcggttggncccggagccatcaacagcggnccggtgtcccttaggctggncccggagccatcag

SEQ ID NO: 589893 - DNA, 221 bp, Homo sapiens
cccccttccatatgcgacacagtgagttttatctcttggtctacactacacacacacacacagcacacacacacacacacaaacacagagtcaggttttatctcgtgtgtctacacacacacacacacaatcagttttactcgtcttggtctattctacacacacacacatattttttctctcttggtctacacacacacacatacacaagtcatgtttgg

SEQ ID NO: 589894 - DNA, 281 bp, Homo sapiens
tcatgcctgtaatcccagcactttgggaggctaaggcaggaggattacttgagcccaggggcttgaaactagcatgcacaatatggcaagaccctgggtctacaaaacataaataaataaaatccaaataaaaaattagtcaggtggtggtacccctgtagtcctagctactcaggaggttaaggtgagaggatcccttgagcccaggagatcaaggttgcaatgagttatggtcatgcccctgtactccagcctgagtgacaaagcaagacattttttca

SEQ ID NO: 589895 - DNA, 931 bp, Homo sapiens
  misc_feature (327)..(327): n is a, c, g, or t
  misc_feature (377)..(377): n is a, c, g, or t
gacccacgcgttcggacccacgcgtcgagacgctacttcccctattcatagaagagcttatcacctttcatgatcacgccctcataatccattttccttatctgctttcgctagtcctgtatgcccttttcctaaatactcatcaacaaaactaactaatactaacatctcagtacgcttcaggtaaatagagaccggtcttgaactatccgtgcccgctcgatcgatccttagttccttcatctgctcgcttcgccatcccttagcgcgactccgtttagcataatcaagatcgcaggtcagatcgattgccactccgcgttaccnatctagagatcgagatttggtcgcgagcgctacatggtggtactgtaganccgttatcgcaggtgacactcgtacctaacgtgtcgtgaacttaactcgttacgaactctcgtatcagttatcttgccgccgctagttattccctagtaagctcaggtcgatcgctgcgtactccgattgcacagttgcactcaatgtcagaagcggtagtacggtccgctgagttgcgaagcccacgctattcccgtatcaactatatgtacgattctagcgaagactgttcgtatgctacatctattgagcatggctcgcccaacaagttacggcgttaaaatactagagtgcctagttccgcggacgatctaagagcctaaacctagtttcgaccggtaacacgacccgggggtattactactggtcaactgctctgacaatcgtgtgtgagcagaacctacgagtttgtcagtgcgccagtcgctgccttagtaattacattcccgctaaaaaatcttgtcgaacatacgggcgcgtaatttacgcctgatagcagccgctcttttaaccgctcttagatgcctgggggcctcgagccggaacccaaagg

SEQ ID NO: 589896 - DNA, 964 bp, Homo sapiens
  misc_feature (964)..(964): n is a, c, g, or t
gggcacagcagaggtgaacatgaggatgatgctgcgtctgggctgtatccatgtgtaaccagctgccggtacaaattgcaaggtgaccttcttggcagtgacaggtccagattggtggcctgaggtggaggttgtgtgtgttgcctttgatacccctgacagagcctagtcaccagatgcaagagatagagagaatcaatccattccttagaaggattgctagcacattgaaccaagtaccacagatctagccaactgagaaaagacagagatgtaccatcaaagggcgaactccaatgacgacacaatcaagagataacatacacaaatcaattacaattgatgcgtggcaacacaacgagagcacttcgtttagcaaaaaaaagtacctaccaccgaataaatagtatcacgcacacggtgaacaacgatagagaataccaaccaatgaggccaaattggaacatgggagagacaatcaaaacagtaaccacagacatatcatcaaacaataggaaaaaaaaaatgaaataatcctaatacaacaactagggaatgcacatcgacaggagcacaacataggacccgacagatggtatagctacggacgcattgacaacaatatcacccaccaaaacgaaacaaaagaacacgggcaggcattcaggcgccgataacattggcatccacaattccccacttggaggcacgaatactatcacccaatccatttgacttttcacctatccacattgctaaaataatacaataaagattcacaaaaagaaactaactcattacaaaatatgagaaaaaaaacaccatagcaaacaataaacccctaatacactaccaacgatgtactaactatgactaaacatcaaacaatacacaacaacatatccacagaccacccactacaaaaaacacacaacaaacaacacaaacaactactacactacan

SEQ ID NO: 589897 - DNA, 486 bp, Homo sapiens
ccggcatgaggctgtggcgcctactggccctggcggtgcagtgtcgtgggttcggcgctgctcggagtctggtctggggtgctccacagaagctgttgctgggcttgggaggcacgggcatgtccctctcccggccatgtgtgagacggcgcccatccgacagtgtcagctattgccatgtggccgcctgtccagatattggggccctcgacacccttgggcgttgagggtgggatagagcctagctccttcctgcagagcccgcctaggtgggagagatcatgcggttggtgaatgcctactggggcaaccccgtcctcactgtagaggccctgtcgcaggtcttctcctccatgccaagatctgctagatagcctcccctcccaggcagcgcccgggcctggacgagcccagggacggtctggctgctgggggcggctgccggactgagcctgccatgaggtcaggacttccctccggccgcag

SEQ ID NO: 589898 - DNA, 151 bp, Homo sapiens
tactatctctatgcctcagctcctgagagctggggttacaggcacacacatcaatctggctaatttttgtgggtgagtaggagacaggttttgccatgttggcaggctggtctcaaactcctgatctcaagtgatccccctactcacctct

SEQ ID NO: 589899 - DNA, 632 bp, Homo sapiens
agcggagccgagttcgcgccgccggtaggtgctgcatgccaggggcgggatcgtggagcgcctcggagaagcgcacgaaagcaataaacaagagccatctctccggagcagaaatagaacagacgtgggcggggaaagccgaaatatttcgctgccgtcctggtgaacacaatcgagcaaggcagtgaagcaaacatcattaggtggctggactcagacacatcacgctccagtttgggttccaaggtgcttctctctggattttcaccaggcttgccaaagaatgatggattacgctgggccaacctgggtgtccggcaatacccaacaaaagtgacgtttggcccctaacagcaggtcttgggccagacgagaaatcaatattgtcaccattaaaatcgtatcaaagaagagttaaggcaccatctgtgcctggcgactctcatatggtgtgtgaacattaaatccgagacttgtactagcatgggtaatcaatatatagtggtgcacagatgcattggtggttcctttgagcagtgatggctgtcgtggaatcgtgtgatgcagtgtagtcagaccattaaacaagattcgtgtccaaagaagaagaaaagaaaagctctcgcagcgcc

SEQ ID NO: 589900 - DNA, 360 bp, Homo sapiens
tatatacaacgtgattgactgggacccgtttctaaatacatctgctgcctacattcctgctcacacatacgcttgcaattctgacggtggaaacggtgcctgagcatccttatgagagtatgtggctttaaacttttgcgaaatatactttgcccttgcaaataatggcttgtggcagccaagctttcatagacacataccttttgaacccctacgttattccactctctgttctaggcactgggacttcaccaagcgctggattgctcacctacttgtactgaaccttatcttatagtgaaggagatgaaacagacaaaataaatctataaaatatgtaatacgtgagagagggaagga

SEQ ID NO: 589901 - DNA, 670 bp, Homo sapiens
  misc_feature (237)..(237): n is a, c, g, or t
  misc_feature (508)..(508): n is a, c, g, or t
tgggtcccggcaattggtttattaaaacacaaagcaagggacagggaaaaacaatccggatttggtacttttgggggggaggggggggggactgggaaggggtagggctcagagtggagacagcccagaagaggaaagccagcttctatccaccccttacgagcttctcccgcgggccaaccgagggttcaaagcccactcagttattattctcagcgtggtgccgcgtgtctcaangtgcagtggtgggtggcgtggtgtgcgcaaaagggaggtgtgggtgtggggcccctccacagagaagagagagagggagttgggaaacacttgaggcggtagaagagctcacagaggggcttagagaacacttggagagtgcgtttttctctctccgagttcacgtgggctcacgaggacatagaacgcagccgagggcccccacagtggtggcacgaggggtgtggccatgggggttctcgcgtgaaacaagaggccgaggtgtttagcncacccaattatacagtgggggtgtggaaagagaggggctgtgccgcgtggggctctcagaaaaggggggcgcagggcgtggtctccctggcgcggggggagaaaacgtgggggaacggggcaccccgggcgcccaggggggcgcggggtagaccgcggggga

SEQ ID NO: 589902 - DNA, 99 bp, Homo sapiens
cagtgctagctgagtatgcgtctttgcttgccctttgctcgtgcactcgttaggagaagttgctatgaaagatcagtagcatcagatcatcgatcaaaa

SEQ ID NO: 589903 - DNA, 289 bp, Homo sapiens
tttggagtttttccgttttttggaaaacctacattggtttgcctgaaagagagcttgaatttggagaatttttattccccacccaactttatgtttttaaaggccttttgtttttttgaggagagaaaaaaaaagccttttggtatatttttggtaaccttcaaccctgggggtttttttttatgtttaaagattttttttattttagcccaaattttggttcaattggtttttttttcaaaccatttgaatttttttttttttaaaaataaaaaaaatggttgtttta

SEQ ID NO: 589904 - DNA, 325 bp, Homo sapiens
aggtcggacctggggtgcacactagggtagtttgcaggtgtaaagccatttaccaagatagttgtaggtaaagaagggcagatttattagagaaattgtgaaaatgttgtcgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 589905 - DNA, 102 bp, Homo sapiens
  misc_feature (28)..(28): n is a, c, g, or t
  misc_feature (36)..(36): n is a, c, g, or t
ttggtcccaagaagttgggaccacacgnataagccnccatgcctgaactgggaggcagaggttgcagtgagctgagattcggccattgcactccagcctggg

SEQ ID NO: 589906 - DNA, 144 bp, Homo sapiens
gtggcatgatgggcactggttaggtgctcgatatcgcaggttgagtatatgagaaagtcatattgtgcacgcccacctacagtggggaggccaaggtctgccggactcacgtgggggcttgagggcagctggtgatcctgggga

SEQ ID NO: 589907 - DNA, 107 bp, Homo sapiens
ctactactagaactctgaagtcgctttttctgtataaacaagccttcatacttctgcataatgaccattgatggtatggtatatctgcaatactgattttatccaca

SEQ ID NO: 589908 - DNA, 329 bp, Homo sapiens
  misc_feature (26)..(28): n is a, c, g, or t
gcttgggccaaaaggtttggcaatcnnncttcttagtacactgggaacagctaatgttcagtaagaaaagaatatttttagggccaggtgcatggctcatgcctgtaatccccagcactttgggaacatgaggcagatggagtgcttgagtccaggagtttgagaccagcctggtcaacatggtaaaaccccccccatctctaccaaaaatacaaaaaattatccaggcatgttggcacatgcctgtcatcccagctgaggcaggagaatcacttgaacctgaggcagaggttgcagtgagccgagatcagtgtgagattctgttgaaa

SEQ ID NO: 589909 - DNA, 126 bp, Homo sapiens
ttgaaagatcaggctgactgctgccatagtagatatggtatccatggcaagcccatgtgtgttgagagcttctcagactatccacctttgggtcgctataagctgtatcgtgcatatgaagacaga

SEQ ID NO: 589910 - DNA, 966 bp, Homo sapiens
ggcgcgagccccgtgtccccacggcggcagcagcggcggggcgggctgaacgcggagggggcggagggagcccgcggggggagagtacaggaaatggcggagaccggtgcttgacaccgggggggtgatcaccaggccgcagaacctgaattgacggccttaggggaccccccaagcaaattccttcgagatcgatgtgagccacccccgcaaacgggtgggggtcggccgggggcccgttttccaccatttttaacgaaattcggggtcaaaagaacaattttcttccttatttttcaaggcttgaacagactcttacttggtaggcaccgacgattcccgggtggacttttgggaagtgcgcttggcgaaggtggatttacggaaaaggagaagacgcaggggttcggtagtttccccccccgcttcccgttgggaaaaaaggcggtttgggggcggtacaggcttccccttttgacggagggaagacttggatggacattttgggatggaccatttttttgggccggaaaggaacaaacgggggcgtgggagcgcgtgttttataacccaagggtcggcctggtcttcctcggtgacacaggaacgaaccgtgtgtcttccaccgttgtttttacccgcgatgacattattagataaaggcttatctttcttctaaagttaggacgtgcttgaatttgtgggcaagagggggcacaaccgtgccttttaattggtggttacgccccagtgacagaagtcctactttttagcgttgtggcccagacagttggttttacttgccttcagtattctaacactcatctcccagttggttggtgcgcggtgacaacaagttttgctgttgaaaatcctctcaggcgtttattataaaagcctcttgggttaggggcgccacattcccccaacttgttcctgtgtggggcggcacatcggtgggttgca

SEQ ID NO: 589911 - DNA, 1139 bp, Homo sapiens
  misc_feature (1139)..(1139): n is a, c, g, or t
agatagcagctctgtatcagctaagacggctgaatcgatgtggttgagttactgtaatcccgtcttatagcaagggataggtctgacacaaatacaacttaattctctaactaacgctgccataatcaacgtatgattgcaatcgtgacttctcccgcacggctgggatcaaccaggcgggagaagcacccgagactcgttagcttatgattctctccgtttctgctgtccccaatgaaccagtcacctcgccaagcctgcgtgccccatgacgggcctatgcccgtgtattggcaattgactgtgcattcgtccatcagtcgcgcccatctatatagcgtcagtccccctagcgtaggatgctatgtggcgaccgggtggacatgattgcgtgcatagctgagagcctctgaatgacatcgcgaagcacttagtacccaaaattgagttcgggtgcatgtagccggagtgcgtaggtctagatctcagcatccgtatgtgtagaccgaagcatgtgggttcgggacacaaggccgtacccgttgcgttaaggttctagcggagctcagcatgcatagcaaaagtggttacgtgcaatgatgggtcatgacatctctgtactttagtctctcgtgtcatcagtagatacccgcattcataactccgcgtaggcttttggcaactgactagttcccctaataatcgtgtgccccgaggatggccgtttcccccgataaacaaataaggttctgagtctttacctccctgctctactatcctggtcggttctgtattagttggaggccggaccccgggaccaggtgcaccaggtctacccttcgccttagaagggttgagctatcccacccggggcgtcgtttgaacggaacatttggtccctggaacccaaacggggtctgcctaactgggggcgcccttttgtcccaaaatcgttgtttagagccgtggaaccagtataaagcctgtattatcgctgtggaaggaatgattcccacttcgcgcaggaggagaacaaagggggtctcacactaggcgcgggagaccatcaacgatgtgcgaatagagaacacgttgaaacgtagagtggcagaattcaaacgcgactagacacaatcacn

SEQ ID NO: 589912 - DNA, 1113 bp, Homo sapiens
gcaggatgatggagagtaagatgattggcatgccataacactcactagagagttgcatgatgcgcagcagcctagttgcaaattatcagttcctatggtcacatgctagcgatccagcgcatctgtggacggatgcattgccgtttaagcaactttcctagtgcgcgacaaccttaggcatgcttctcatgaaaacaggtaacgtccgtcctctgctaggcccgatggtcagccactgaagccctttggtccagataactgtgatgcagtttcaatatgactccaaactgccagtagcggtccccagaggtgtacctccaccatcagaataaattggagcagcaccaagtgtatggtgccaggtcagagccaccagcctccatgggtcttcgttataacacatatgtggccccaggaagaaacgcatctggacagcactccaagccatgcagccgggtcgagtatgtgtcttcttatgagctcctctgtcaggaatacctgttaccccgaagacattccaccgtaccctaccatccggagagtgcagtctctccatgctccgccgtcttccatgattcgctctgttcccatttcacggacagaagttccccgcagatgatgagccagcctagtgcccaagagctctgtaacaatataagccatatcagtcctcgcaggccgctcagattatcaggtcactcagcttcagccttactttgagaatggccggggtcactacagggaatagccatagtccagttcttctagtcctattacagtgcagatgggggcctgagtgatgtggaatgcgaatggaaagcacaggtggaaccccagtacaggcatccacaatcgcaacattgggagttgcaacacaaacccataagccggtgaacagaaacagtgatggtaacagaacatgcagagatggaggccacagataccgcgggaccacgaggaccgggggaagttctcgcacacagacacaaatcgtgtgtcaggaatagcccggagaagaaggagataacaacgaacacacacaaggagaatagaggaagcgaaacagaagcgcaggagccagacagagaagaaactagacgtcaacaagagata

SEQ ID NO: 589913 - DNA, 728 bp, Homo sapiens
  misc_feature (504)..(504): n is a, c, g, or t
  misc_feature (580)..(580): n is a, c, g, or t
  misc_feature (582)..(582): n is a, c, g, or t
  misc_feature (601)..(601): n is a, c, g, or t
  misc_feature (624)..(624): n is a, c, g, or t
  misc_feature (652)..(652): n is a, c, g, or t
tcttgttattgatattacctatttacatcaaaaagcttttagaaaatggtatgatgtaagcaattcttgtcctggtgaaatctgatggtgtaacccgttttactattggcgctgcttcataacaaaaatgaaaagctatatacatctacagccagaatggattgtttatgtcatataatttcctttactaagttcacttacattacttacagagttttattcattgccataatagagccatgtaggaaatgcactgactgcatgttattgtggcaagaatatcctaaatgtcattaaaatcctccaacatgatggatctacttatggtcttgtttgttgacatgccaaattaacatagttccatctggaaatgagcatttgaaatgataatccggctgggcacagtggctcacccctgtaattttagcactttgggaggccgaaggggggcagatcacctgaggtaaggagttccagaccagcctggctaacatggcgaaaccntgtctctactacacaaacgcgcgtgcgcgcgcgcacacacacacacacacacacacacacacacacacacacacananttagccaggcatggtggtncatgcctgtaatcccagctactncagattctgaggcaggagaatcacttgncccagaggcagagtttgcagtgagccgagatgcgctactgcactctagcctaggcgacagagcaagactccatctc

SEQ ID NO: 589914 - DNA, 665 bp, Homo sapiens
gataagccaggcatgtgattccttggcttcaagtgccttctgtcttccccgaaggtccactgagatctacaatcccccctttcctctgatctcttgccatgtaagtaatttttcacaaagatcagtacaacgagctatattttttcctaagaaaaacatttccaccaggaatggggagtagccccgtattggggctgatctggtccagaacttgggcagtgaggacacaaatcccattctcatctactttccacatttttccctctgtgtcggagcgtcctgtttccaacccttacattctctgaaactgtctctagagcaacttgtgtctctccctcatagtccataactataccccttacagccctcaccacttacgaaacttcacactcaatctggttctaactaaactttttacctacgacctggtaaaaggccctccctttacaacacgacttaaccgcgcaccttacggcgcgaaccgtccccaactcctacttgttacttccccaccccaagaaaagggttaccacgggcgcacttccacctacccccacggccggtcctccttaggcactggcaacacttcaccttagacgctgcgacaactacacttcaccccaattatatctccctggtcctcccactttccccaagcggacggg

SEQ ID NO: 589915 - DNA, 156 bp, Homo sapiens
ctcaatgaaatgtcggggatcattgcggacaggtccacttgagcttgttcaccaggagcagctccatttgcagcagctcctcgggccgtgatggatgttgtctggtgtaagatgcaccagcttctcgcgccgtcaggggtgatggagcacccatgt

SEQ ID NO: 589916 - DNA, 291 bp, Homo sapiens
actttaaagtattcacttctgtgagaaaggcatctgagtagctgatggggatggcattgaatctgtaaattaccttgggcagtatggccattttcatgatattgattcttcctacccatgagcatggaatgttcttccatttgtttgtatcctcttttatttccttgagcagcggtttgtagttctccttgaagaggtccttcacatcccttgtaagttggattcctaggtattttattctctttgaagcaattgtgaatgggagttcactcatgatttggctctctgttt

SEQ ID NO: 589917 - DNA, 927 bp, Homo sapiens
aggctgaggcaggagaattgcttgaatccgggaggcggaggttgcagtgagccgagatcgtgccactgaactccaacctgccaatagagcgagactccgtctcaaaaaaaaaaaaaaaaaaagaaagaaatagctttgaaaaaaataccgacttcaaaggaaagcttattttcggcagggggttttttcaaagataaaattttggaagcatgtttcctaacgcgatgggtggtgaatggaggggtggacgctgggctggaggcatccgcccaacccggggggggtgggtggtgtaagaacgcaccgtgggagccacaagagggcacctcctatagtcacgctaaggggctcccctttctggcgcccagctttgggcgtgaaggggtggatttctactagacacattctggtgcttcagtcatagatgttactacgagggacgcagtttccctggctggcagatccctggaatagagttggctggacaaggagtctacttccgtgggactcgggacagttgaagggccagtctggtgtacgaacagggtgggggcacccgggggaaaagacctggacagttagttacataccgctctggacttagtactcccatgagtggcttcccagttgacccttgtgcctgatagaattctaaaccctctggaatttccctgctggcgacttctatggccgtggctgtccgggtacctgattgccagatgctaggggctgatgagaactaagctgtgcggctggggcaccgtggggcccaaaaacgggctccggcggcattctgaaaccccggtagcacggggatgcccgactggctgaccaagtccggcgacctgccgcaccacgctatccagcacggcccaccggcagtcggaggcaaggcccaaaccccgagggggcacgcacacgtcaccc

SEQ ID NO: 589918 - DNA, 290 bp, Homo sapiens
  misc_feature (117)..(117): n is a, c, g, or t
  misc_feature (120)..(120): n is a, c, g, or t
agacaatcatgtggttgtggagcagagcatccctgagagcaccagcacttctgacctagcgggtgagcccagtgctgaaggggcttattggacaagcaggaaatcatcaattacccnaanctccaattcttgaggttaattgaagggcaaacttgaggccaaaaaaatttctaatcacatcagagggatatgtccctagccaagcctgtgggtgagaccttcccacagctgtcgcctggagaaatagaggtgagagaagggcccataccttcatctatgggcgcagtccc

SEQ ID NO: 589919 - DNA, 116 bp, Homo sapiens
acctaggcccacctggcaagcagcagagccaggctggtagccttggtgaagtcattcatctctttctagttctggagagctgagatagtaatgccagctctccagaactagaaaga

SEQ ID NO: 589920 - DNA, 285 bp, Homo sapiens
gccttgacccaagattcaaacatttcattaggtgggataaggagggtgaggtaaagtttatgcgaactagcagctgttagggtactttgtgcatttccatagcagatcacagcaggtgagggtttaatgcagattgccagtgcagacaaggacaaggcaggaacattggtgcctgccataagggaaaaatgcgaactggagagtgttcggaatgggaacaccccgtgcgactttagactaaagaatatattggggtgcccggctgatttttgtgtttttggtggg

SEQ ID NO: 589921 - DNA, 782 bp, Homo sapiens
tctctacaatgagagctacaaaacactgctcaaagaaatcagagatgacacagacaaatgggaaaacattccatgctaagggatgggaagaatcaatattattaaaatggcaatactatccaaagcaatttacagattcaatgctattcctatcaaactaacaatgatgtttttcacagaagtacaaaaaataattttaaaattcatatggaaccaaaaaagagtccaaatagccaagacaatcctaagcaaaagtacaaagctggaggcatcatgttaactgacttcaagctatacaacagagctacagtaatcaaaacagcatggtactggtacaaaaacaggcacatgaaccaatgaaacagaatagagagctcagaaataaggctatatacctaaaaccatctgatcttcaaacaaagctgacaaaaacaagcaatggtgaaaagactccccagttattcaataaacggtgctgagataactggctagccacatccaggaagattgaaactggacccctcgcttatacatatacaaaaaatcagtcaagatgcattaagtgacttaaatgtacaacttgaaggtataaaaactggaaaataaccaggcaatacatctggagtgggaaaggcaattattttcatgacaaagatgccaaaagcatgggacaagcaaaattgaaaaggttttattaattaagagttgaagaaagaatatagagaaagaggtcagatgggaaattgcatatttgaagtattcggttgggtaaagtggaaagt

SEQ ID NO: 589922 - DNA, 305 bp, Homo sapiens
  misc_feature (21)..(21): n is a, c, g, or t
  misc_feature (196)..(196): n is a, c, g, or t
ttacgctggccaatggcaggnttggggacatgtagacagggtggggttggtcccttcttgccacggtgagaagtcgtcgtcagcatcatcttccgcctggagagcagagaagccaaatgcccgtgggcttgcctcgggcacggaggtagagagctccggccaccaagccaagcagtgctccagcggcaagcacagnccccatgcctgctggcacaggtggggcttcaggcgccagaactgcctggggctgtgggggtgcacggagggggctggcaagagcatggatgatgccatggggccagcgg

SEQ ID NO: 589923 - DNA, 894 bp, Homo sapiens
ggggccccgggaagtgaaaaagcgggagctggtcttcctccagttccgcctgaacaagagtagtgaggacttcagcgccattgattacctcctcttctcttctttccaggagttcctgcaaagcccaaacagggtagggcttcatgcaggcctgtgagagtgcctattccagtctggaaagttctctgggggcttccgcacctgggtcaagatgtcactggtaaagaccaacggaggaggatgggcgtggaagcagtcggtagttccgtgcaggtagacaagtgtggttaatctacattgtaccagaggtcagttgccaaaaaaagtgctcaactgtttgtgtggtcttgaatggaaagatcctttcatccagaaaggtccaagatatagtcactgccattcctgtggaacacaatcgctcttctctgtggcgccttctgggctttattttaaagcagccggagttgtgccaacactgagtactacctatggctgactcaatgtcagaaagagattccttaacaagaagaggtcaggcaacgagccaataaagctgaagtcacctcgcgtgttagagactgtccacgatcaatggggaggtgtcatcacttccacttgtgtaagcgggcttatgcagaatcctgtactcagttgagaaaaggggctgctaggagggaagggatgtagactgatctacccgccaagagggggtaagccaatgagaggtaggaaacgtcagttttacttctattcttatcacttttagagcaaagaaaacaaaacaattggcggccgcacatattacaccaagtgggcggccataaaagatagcagacggggaggggggccaaggggccgcgcacgggttgcaccccacggacagaataaatacca

SEQ ID NO: 589924 - DNA, 143 bp, Homo sapiens
gataaagtgatccttaaaaaataaaaaactttagaaggtttagaatatatgtagggagagaaggaggaaaaaatacatttgtattcagagttaaatcttaaaaaaaaaagtgttttttaatatatgttcggggtttacgtgtc

SEQ ID NO: 589925 - DNA, 384 bp, Homo sapiens
  misc_feature (19)..(19): n is a, c, g, or t
  misc_feature (40)..(40): n is a, c, g, or t
  misc_feature (71)..(71): n is a, c, g, or t
  misc_feature (97)..(97): n is a, c, g, or t
tgttgttatgccccccaancccaacaccaaccaaccttcncccctggtgccagaggaagccccctgacccnaagctgccccattcacgtccctcccntgggagatgtgaagttgaggcctgtggaatgagagtgccccatcggagctggctgcttgagctggggaggaatagggagtgtgggctggctgggtacatagttaagcagagagcaagagggggaggaggcagatgcacagagaaaagcagagatgggaacctgggaatcagaaaacaaaagacaaaggacagacagatcgacacagacagaggctgcctccttcttgctggctttccagtccctaatgtccctaggtccaggcctcatgagagtttcctgtttctca

SEQ ID NO: 589926 - DNA, 792 bp, Homo sapiens
gacttccggtcgtcgtgagcgtaaggtgtgcgtgtcgtatctcaggtaaaacatggctaaaagcttacgggagctaggctggccggcacgaaagattgcgtgctgacaatgagatatgaagattgtcccccaaaggagtgccgagcagggcttgagaagtattctcaaaaactagacggtgatgtgtatagtgaaagaatgttccaagagatagcaaacttgtggtggtacccaaaaacctcaaaaaggtttgtccaaggagcaaaacatgcgtgtgtgaggtttaccctgtatgaaaataagtatgagctttgactgttgtgagaggtgtagtagtaacgatgaaacaagagaatgacgtcgttctacgaacccaagcatgtgtacgagtggctagatagtggatgaacccaaagggctggagaaaaagggctgatggggcaaaagtggagatggaaaaagaatggggtgaaataggcatcggcaaaaagtcagtagaaaacgttggcaagaggggtacagcggctggaatagagtctttcagaaaccctttgggaaaaattgccatccattgggatacgatgacgcggttaggacttgtttcctgatgtatacttttgagtttaatttggcgaccaatgtgaaatgccatttgttgctctatttcaacttggtccttatttgctgaatttcaaactcaggattagatcttgaaggattaggggtgggaacttgagtaaacatattggttggatacatccaaggtctactgatagatttaggtggatgtac

SEQ ID NO: 589927 - DNA, 101 bp, Homo sapiens
ttatctcccttggaaaaattcctctcactggaaatgtacatttcaatcatcctttaattgtacatttccagtgagaggatgattgaaatgtttaaaaaaaa

SEQ ID NO: 589928 - DNA, 187 bp, Homo sapiens
gggggggcccggggggaaaaagggggccccccaaaaatttttttgggtttttccccccccccccccccccgggggggtttgggggggggggtcccgggggggggggtttttttccccccccgggggggggggccttttttccgggcccccttaacccccccttttttttttttttttttttttcgga

SEQ ID NO: 589929 - DNA, 726 bp, Homo sapiens
aaactacggtaggtacgaggctgggtttcggatacaagagcaggtggaaaagtctgcttatgagtttgctgagactgaatctatgcttaaaatagcagaactatctgtgcaggaccgtatgtatcgggacatgtatgacctattgttcctgccaccatccttcccttatggtggcatggagaatccttgccttactttgtgtaactccgtactctactggcaggcgactagagtcaactcttccaatgtcgattgcaacatgatcatatctcatatcctggacaggcaatctcacgtgaccaactaaagacttgagtgcatcaccttttgagattaataatgagggacatacatgtgtactttggtaactgccacagtttgcgcgacgatgtgtttgagtgaaaacgtatctgacattatctaactcgcgtctgggcacgagagtagcggagagaacatacaggaattacggtaaatgacatttggtgagactcatcctttcagcaatacttgctgggttgattcatgacatgagtatacacccctggatggttgcttcacttcgttcatgttccctgatgaggaagggctcttgctttacgtttttcacccttgcaacagagcgtgctcgcgaggaccggcgatttcctagggttcttttgacgcctattgtttgcgccgtcttcctattagagcttactagtggtgactgggagatttcctgtt

SEQ ID NO: 589930 - DNA, 503 bp, Homo sapiens
  misc_feature (286)..(286): n is a, c, g, or t
cccaaatcggattgcgaagataggattacggatttgcaacattttggaggactaattaaaggctaggccaaacacatttacatagacttagcacgcttctgctcaaatttcgagtctatttcttttgaactacttttccaaaatggcaaaaccaaaaatataaaatttgcagggcagcccggagcttacgtttacaccaaatgctgctctttaattgcagctacctctccccacagaaccccttcccgccagctcagcgatccgagcaagacgcggctctcttttncgagcaactcttgagtccaaggcctgggcgaagctggcggagacaatcgcccaagtttgaaggggccgcgaagcttggcgggggaggtcggtgttggcgcctaggcccgtgtccccctccgcccccgtcctcccgcccggcccctgctgcccctcgcccgccgcggatcccgctcacttaccacgtacgaggagaaggcggcggcggcggcggccgc

SEQ ID NO: 589931 - DNA, 1013 bp, Homo sapiens
  misc_feature (562)..(562): n is a, c, g, or t
  misc_feature (644)..(644): n is a, c, g, or t
  misc_feature (653)..(654): n is a, c, g, or t
  misc_feature (660)..(660): n is a, c, g, or t
agcgggaagtgtcccctcctacttcttgctgcctcacggttgctgttgcagaccaggagtctctgaaggcttccgcggctttggggccggttgtgagatgccaggcagaggccgctgcccggactgcggctccacggagctggtggaagactcgcactattcgcagagccagctggcctggttacgagttctgagacttgacaaacggtctgtggtgaagcacatcggtgaccttctccagcaccgccagtcactggtccgctctgcctttcgggatgggacagcagaagtggagacccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgtnggttgggtgctgcgtcttaatcacctgccgacagcataactggcccctaacaatgggggccatctgcacgctgttgtatgcngatttgganngtgttntctagcacttacatgcagatagtgaagctcctgggactggatgtgccatctctgtgcttggcagaactggtgaagacctattgcagcagacttcaaactgtaccaagcattcagcttcttgtgccagccaaatacgtggaagaccaaagagaagattggtgtctcgaacaaatgcaggatggtggaggctggcacactgagaacgtagctaggttgacctgggatgccaatccacttgcccgtcattactgctagcgaaatttcctggccttgcgaagccgtacgcagcctgacacactcgccgatacatcttcgcgttccccgattttgtaactcatgcacagtgtgacctg

SEQ ID NO: 589932 - DNA, 432 bp, Homo sapiens
gtcggcttcctgcctcggaagcgcagcagcagaatgcatcggatgggaaggtgaagagcttccctaaggatgacccgattcaagccggtccacctcacagacttcctgggatacaaggctgtgcatgactcacatcgtgacgggaagtcgaaagggcgagagatccaagagtgaacaagtaaggtagcgtgtgtgtgaggacattgtgaaccacttgtcacgaagacagctcacctcactggatgagcttggtgagtgcatgtgctgtgcgccttaaccgactagggacacacaccccttcgacagagagacgtcacagaggaaggctatccacagaagcgtagattctataggcatagtaagacacacatcagacggcaggtgacactgtcgatcagaaagagaccgatcgacacgatactagacgtaaaa

SEQ ID NO: 589933 - DNA, 103 bp, Homo sapiens
ggggtggtctagaggatcccatgccaataacctcccaaaacctagacacagtatcactgtggaaacagagtaatagttctgggaatcgattgaggattaggtt

SEQ ID NO: 589934 - DNA, 429 bp, Homo sapiens
  misc_feature (55)..(55): n is a, c, g, or t
cgccccagggcaaaagggggttttctgagcagctgggtagtggttattcttgggncctgacctctggcctcaatcgggttccttaggaagacacaccgggaaatttgtcattgccccttcacccaaaatggatatcagcaaggggaaaatccccaaacttctttttgatgctttcttcaagaagaagaagctggggaagccccgcccccaggaaggggggtttttcgccccagaaaaaaagaaatttgggatttcggggcagggcaagattggtcagaaagctgggggctcccaaattttcccaaaaatcaaagctattccccagctccaggggtccctgcgatttgggtttgctctgaggaatgggatttatccccccaaatgggggttttaaatgttttaagaccctaattaaaaagctggccccca

SEQ ID NO: 589935 - DNA, 890 bp, Homo sapiens
  misc_feature (439)..(439): n is a, c, g, or t
  misc_feature (521)..(521): n is a, c, g, or t
  misc_feature (530)..(531): n is a, c, g, or t
  misc_feature (537)..(537): n is a, c, g, or t
agcgggaagtgtcccctcctacttcttgctgcctcacggttgctgttgcagaccaggagtctctgaaggcttccgcggctttggggccggttgtgagatgccaggcagaggccgctgcccggactgcggctccacggagctggtggaagactcgcactattcgcagagccagctgggactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgtnggttgggtgctgcgtcttaatcacctgccgacagcataactggcccctaacaatgggggccatctgcacgctgttgtatgcngatttgganngtgttntctagcacttacatgcagatagtgaagctcctgggactggatgtgccatctctgtgcttggcagaactggtgaagacctattgcagcagacttcaaactgtaccaagcattcagcttcttgtgccagccaaatacgtggaagaccaaagagaagattggtgtctcgaacaaatgcaggatggtggaggctggcacactgagaacgtagctaggttgacctgggatgccaatccacttgcccgtcattactgctagcgaaatttcctggccttgcgaagccgtacgcagcctgacacactcgccgatacatcttcgcgttccccgattttgtaactcatgcacagtgtgacctg

SEQ ID NO: 589936 - DNA, 412 bp, Homo sapiens
aaatatatgcaagagttcatgtttacattctgatttgatatcacaatcaataaaatctttgaagaagtttgtaagttctgggttgttgctatagatccagatagggaaaaaagtcctttacctttcctcaaaaggtaccttcccttgacaagtaagttaggtttctgcttttataatttaggttatgtactcagtttaccatggctttcttctacttaccagtgacttgataaaccaatgtttaaaaaacccaattacacatttttacacaatttgggttctatttaaaaaaaaaccgtggctctactctttaaatatggagcctaaccttgattcataaataccgtccctcttgaaaatggtcctcagctcaggcttctcatacctctgtgaacctagaattagcacgagt

SEQ ID NO: 589937 - DNA, 388 bp, Homo sapiens
  misc_feature (147)..(147): n is a, c, g, or t
tttaggccgagcatctcctacctaagaggctctgagaggggaccctgtgctgtcccatagcgctcagtcgactcagcaggcacctctttgcttccccactggccaggctgatcccctcagagaaatgatggaaacggaggagtacanggatcaagttcctttttttggtggtggatctaggactatgtaaaaaacactttggtagattttcagaggatcctggtaagtttagagatgaatttgttaaaactaaatcttgccttttcattgacgtggcaggatgtaatggtcactttgcagtactgatgaaaagcaacacatatctggaaaggctaaggaatatgccgagtagccaggtggtcactaaagaccaatatgcagtcatctg

SEQ ID NO: 589938 - DNA, 208 bp, Homo sapiens
gacagcctctgggagctcgaggttgaacgtgtacagcagggatgatgtgagggtaatgagccccggaaagtcggtgtccgggaaagcgagggcctccacgtaaaagtccatgttgtgctttctaacgggcaccatcaggtagtgcgagggccacttgggaccacaatagtacgctgcacttagaggattagtttgccccgatgtggcc

SEQ ID NO: 589939 - DNA, 633 bp, Homo sapiens
gcagtactctcccgggtatggtagcgaggctgggtggcgccatcatcagcccctaccctgcctgctctaagggtagaaaactccagggtcccctgccaccgactgcccagccactccaagccccctggcagctgccctcctggagcagaaagtgcctttatctcagccatccgcagactgctcggcagatgcggggacaggctggaatgagggaggcgtcttcatctccctgccatccccctctcacgccacccccgccccaccggactgcatgtgctgctgatgcgctgggatctgattgaggataaaaaggaaggagagatgacccctacccctcatcccccagttttgaaaaggtctaagcaagtgagtctggtggaggagctgagggagggagccatggtaaggtgccagaaggaaggttggcgggggcacgtgtggagccgatgagcgttgtggctggtcagcagtggcgtgagctgcctggcgccgtgctcctgccgcaagtgacgaggcaagtgtgttgtgtgctacatgtgtatgcgtgtccagactgtctgtcgtagtgtctgggtttggccaagactgggctgaagttaccattaatgcccaggcagcaccctgccatcaacc

SEQ ID NO: 589940 - DNA, 5690 bp, Homo sapiens
tctcccgggagccactcccctgggcgcctctccagcccctgggctggaagcaccagcaaccctggggatggggcagaccctcacagcccggggtctggagccggtgtcggagctcacatgggcccatgacctctccagacatttggcaaaatcaaggcccttagaccagggacagacccaagcccaggccctcccagaggtcataggacgcaaccctttgtgcccttgggctatggaagaggtttgggaacggctttggggtggaagatggccaaaggagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctgtcggcaggcgcccgggtgccgcgggggggagggggaacaaagggctcattctccccgtgcgcagccggtggcatcgccggggcgttggcggaagcccccggggcccgggagggggccggcccaggcgcggccgccgaatcacgggctcctgtttcccgcagggtgctggaggaggaaaccggcggagcagcttccccactctcagttgcgcgtctggcgatggcgatcagaggtcgtgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtggggatcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggaccctttcccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttaatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgc

SEQ ID NO: 589941 - DNA, 950 bp, Homo sapiens
tggactggccaatttcatttcaatgacctgggtggggatgttggtttaatccaggagagtagtttatccagacaagaccataggaagaaagaaaagaaaaaaagaaaatcatttatcccacgtgaaagcttttaaaaccattttgccagttcatgtcactatttaatatcggattgtgacccaaagagtctttctacatatctctggtatggctactgaatacagccagatttatatttggaagagtgctgggttggttttaggtttgggctttaaaaacaatgcaaaaaaaaaagcgcttaaaacaaaccaaaacaaaaaagcgcgatgtgggatagtgctcttcaattaacacttcccctttaaaactgtagtttgcgaaagtgggcagtaggaggggtaagcctccttcgtgccctccttgttgctccccgttgtgggcccacccaatcccttctcagagccaacacaggtggctgtggttggtcacgaacacggtgtgctaataccgggcctcccattgtgcacgttgaacctcgtgggcttcatttttggcaaaatccatttccaaaaagtctccaggtatgcccgtgtaaagttgtccccacgagtggcctcattaccttggtttccacccgtgaggtgagtgacgctggacacaggccccattttttagccagcggtctcaccgggggcgatggaaaacaaagaagccaagtgtccttgccagctgcccaggattagaaaggccctgtgtgaaaatcttacagtttggggttcgcaccaataaacccgtgcaaggggggggtccaacccatgtcctggaatggctctgaagagagaattgtaaccccccaggtgttgaaaagaatttctcctcaaggcccagaagatattcctaggaaaacacgtggaaatggttatcccctcctattgggcccacataaaac

SEQ ID NO: 589942 - DNA, 338 bp, Homo sapiens
cacagcagctcacatgggactcagtgacaatgtcagcaacacaccatggaaggagaacaaacccgaaaaaaactatatattaccatactaatcctactacaactattcctaattatccccttcaccgccagcgaactaatcctattctatatcctattcgaagcaacactagtacccacactaattatcatcacacgctgaggaaaccaaacagaacgactcaatgcaggactttatttcctattctacaccctagcaggatccctaccactgctagtagcactagtttatatcctaaataccacaggctcactaaacttccctgttcggtttatact

SEQ ID NO: 589943 - DNA, 5244 bp, Homo sapiens
tctcccgggagccactcccctgggcgcctctccagcccctgggctggaagcaccagcaaccctggggatggggcagaccctcacagcccggggtctggagccggtgtcggagctcacatgggcccatgacctctccagacatttggcaaaatcaaggcccttagaccagggacagacccaagcccaggccctcccagaggtcataggacgcaaccctttgtgcccttgggctatggaagaggtttgggaacggctttggggtggaagatggccaaaggagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctgtcggcaggcgcccgggtgccgcgggggggagggggaacaaagggctcattctccccgtgcgcagccggtggcatcgccggggcgttggcggaagcccccggggcccgggagggggccggcccaggcgcggccgccgaatcacgggctcctgtttcccgcagggtgctggaggaggaaaccggcggagcagcttccccactctcagttgcgcgtctggcgatggcgatcagaggtcgtgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtggggatcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggaccctttcccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttaatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgc

SEQ ID NO: 589944 - DNA, 404 bp, Homo sapiens
ggcacgcgaggagagagagcgcgagatagacactgccgccttctgtgtcgtggggcatactctctgttgtcagacctcgtgctgcctcgtgccctgtgtccctgtgtgtggatccccaaggagaggctgtccacaagacagatacactccacacatgatcaggatcacaccaacctctaacaagagcacccccaacctggctgagttcggctctaggctataccggcaggtggcacacacagtccaacacggccaatatctctttctccccagagagcattggttcaggctttgcaatgctctccctggggaccaagggtgacactcacaaagaaatcccggagggcccgaatttcaacctcacggagattcccgaggctctacacgaaggctctcagctccct

SEQ ID NO: 589945 - DNA, 6791 bp, Homo sapiens
tctcccgggagccactcccctgggcgcctctccagcccctgggctggaagcaccagcaaccctggggatggggcagaccctcacagcccggggtctggagccggtgtcggagctcacatgggcccatgacctctccagacatttggcaaaatcaaggcccttagaccagggacagacccaagcccaggccctcccagaggtcataggacgcaaccctttgtgcccttgggctatggaagaggtttgggaacggctttggggtggaagatggccaaaggagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctgtcggcaggcgcccgggtgccgcgggggggagggggaacaaagggctcattctccccgtgcgcagccggtggcatcgccggggcgttggcggaagcccccggggcccgggagggggccggcccaggcgcggccgccgaatcacgggctcctgtttcccgcagggtgctggaggaggaaaccggcggagcagcttccccactctcagttgcgcgtctggcgatggcgatcagaggtcgtgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtggggatcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggaccctttcccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttaatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaaaaaaaaaaaaaaaaaaaaaaaaaaaaaaaaaaaaaaaaaaaaaaaaaaaaaaaaaaaaaaaaaaaaaaaagggggcgggcgcgcccaaaaaaatcacatcgccgcgggcgggggcaccacatgaagcccacccccccctcatctttcgtgtaaggagggggccaccacataaggagtacgctaaataaaacgcacagaacaggcgggcgccgcggtacaaaccagacccggcggcggagggaacaacagcccacaccgcggcgccatcttgggaggagagacaaccccattcgcccgcgggggggaacgtcacggggcacccaccccccagcgaaaaaaggccgccacagggaaacaacacatctcgggggctcagggtgacccccaccgtctattcgcccgcgacaatagctccacgcaccataactcagaaatctgcgacggcgtataaaacgc

SEQ ID NO: 589946 - DNA, 175 bp, Homo sapiens
aaaagaagagagcgagtgctgtctattctcctccacctctgatgaatattgctgtagtggttggatatttagagaacgttatcatggagtacgagttccagattcttacagagaaatttcatggacaagtgctacctggagtttgaagacacggaagagaataaactcacctaca

SEQ ID NO: 589947 - DNA, 6726 bp, Homo sapiens
tctcccgggagccactcccctgggcgcctctccagcccctgggctggaagcaccagcaaccctggggatggggcagaccctcacagcccggggtctggagccggtgtcggagctcacatgggcccatgacctctccagacatttggcaaaatcaaggcccttagaccagggacagacccaagcccaggccctcccagaggtcataggacgcaaccctttgtgcccttgggctatggaagaggtttgggaacggctttggggtggaagatggccaaaggagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctgtcggcaggcgcccgggtgccgcgggggggagggggaacaaagggctcattctccccgtgcgcagccggtggcatcgccggggcgttggcggaagcccccggggcccgggagggggccggcccaggcgcggccgccgaatcacgggctcctgtttcccgcagggtgctggaggaggaaaccggcggagcagcttccccactctcagttgcgcgtctggcgatggcgatcagaggtcgtgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtggggatcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggaccctttcccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttaatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaaaaaaaaaaaaaaaaaaaaaaaaaaaaaaaaaaaaaaaaaaaaaaaaaaaaaaaaaaaaaaaaaaaaaaaagggggcgggcgcgcccaaaaaaatcacatcgccgcgggcgggggcaccacatgaagcccacccccccctcatctttcgtgtaaggagggggccaccacataaggagtacgctaaataaaacgcacagaacaggcgggcgccgcggtacaaaccagacccggcggcggagggaacaacagcccacaccgcggcgccatcttgggaggagagacaaccccattcgcccgcgggggggaacgtcacggggcacccaccccccagcgaaaaaaggccgccacagggaaacaacacatctcgggggctcagggtgacccccaccgtctattcgcccgcgacaatagctccacgcaccataactcagaaatctgcgacggcgtataaaacgc

SEQ ID NO: 589948 - DNA, 852 bp, Homo sapiens
ggaactcggtggtggtcacttgcgcagaccagactgtcgctcgtacgtcgtgcgcctcgctgtaggattttcctccgacgaacatgtcgtgaacaggaccgcgaataatggcgtgaggatcgagagaacttcgataaaggttcgaaactgatacgaaagacagagcacgacgacagaagaggaatatccatctggccattccagaagtaataccgagtatgaacggaggagaaaggttaaagacagcggcgaaactcgatacactgtagggccgtctgacgcccgttcaaattatgcaactgctacatttcccagcatatgccatcgccccgttcgtctattttttctacctgtcttctattcagactgcctgttacaccgttttgttcaatgattgcacaccaggagccgtatggacgtcaaacagttttacagagatgatcatggttgccttcggcaccggtatttcagcatttccagagagtggaaaccttaaatctgacaaatcgggaatgcggtccagactgcctcgtggccctttggtccgcatatccttggtgcctactctaattgcatccgggctatgaggcacagggggacatgggaacgtacggaatcacttgggcgagtgggttgggtgtggaaaaggggaaaggggacaggtcgagggggatgggcacatggaataggtagagagagtagagggaagctgtaagcaggttggaaaaattcttaagcaggcttaggagcacccgtaggggttggggaccgcaaaagaggtttggttcccttggccagggggccgtggttgaaaatggctaggtttctattttccatggaggctggccaatg

SEQ ID NO: 589949 - DNA, 5574 bp, Homo sapiens
tctcccgggagccactcccctgggcgcctctccagcccctgggctggaagcaccagcaaccctggggatggggcagaccctcacagcccggggtctggagccggtgtcggagctcacatgggcccatgacctctccagacatttggcaaaatcaaggcccttagaccagggacagacccaagcccaggccctcccagaggtcataggacgcaaccctttgtgcccttgggctatggaagaggtttgggaacggctttggggtggaagatggccaaaggagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctgtcggcaggcgcccgggtgccgcgggggggagggggaacaaagggctcattctccccgtgcgcagccggtggcatcgccggggcgttggcggaagcccccggggcccgggagggggccggcccaggcgcggccgccgaatcacgggctcctgtttcccgcagggtgctggaggaggaaaccggcggagcagcttccccactctcagttgcgcgtctggcgatggcgatcagaggtcgtgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtggggatcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggaccctttcccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttaatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgc

SEQ ID NO: 589950 - DNA, 6621 bp, Homo sapiens
tctcccgggagccactcccctgggcgcctctccagcccctgggctggaagcaccagcaaccctggggatggggcagaccctcacagcccggggtctggagccggtgtcggagctcacatgggcccatgacctctccagacatttggcaaaatcaaggcccttagaccagggacagacccaagcccaggccctcccagaggtcataggacgcaaccctttgtgcccttgggctatggaagaggtttgggaacggctttggggtggaagatggccaaaggagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctgtcggcaggcgcccgggtgccgcgggggggagggggaacaaagggctcattctccccgtgcgcagccggtggcatcgccggggcgttggcggaagcccccggggcccgggagggggccggcccaggcgcggccgccgaatcacgggctcctgtttcccgcagggtgctggaggaggaaaccggcggagcagcttccccactctcagttgcgcgtctggcgatggcgatcagaggtcgtgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtggggatcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggaccctttcccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaaaaaaaaaaaaaaaaaaaaaaaaaaaaaaaaaaaaaaaaaaaaaaaaaaaaaaaaaaaaaaaaaaaaaaaagggggcgggcgcgcccaaaaaaatcacatcgccgcgggcgggggcaccacatgaagcccacccccccctcatctttcgtgtaaggagggggccaccacataaggagtacgctaaataaaacgcacagaacaggcgggcgccgcggtacaaaccagacccggcggcggagggaacaacagcccacaccgcggcgccatcttgggaggagagacaaccccattcgcccgcgggggggaacgtcacggggcacccaccccccagcgaaaaaaggccgccacagggaaacaacacatctcgggggctcagggtgacccccaccgtctattcgcccgcgacaatagctccacgcaccataactcagaaatctgcgacggcgtataaaacgc

SEQ ID NO: 589951 - DNA, 854 bp, Homo sapiens
ctcaaatgatccacctaccttggcctcccaaagtgctgggattacaggtgtgagccaccgcatctggccagagtattccttttaagtagggtgggggacagcgggtgggcccaggaatgtagttgaaaatgctttgtcctctctctttttcctagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttaatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgc

SEQ ID NO: 589952 - DNA, 1550 bp, Homo sapiens
ttcaggtatagctctacatctttgatatcctgacagacccggattctcccactaagaaacgatccacaagatacagagaatggcatctattatccatgagtgtgatctactccattgaacgcgcgtccaaatgaccactagatccacgtgttacgacgatacttcttcgcgaacttatggtcgcgagcatctatggccttccgcaaggggtcacaagagccatccgagccggcgtagtgatcctggtcatgtgatatcaccgaagccatggacaagagcctgattagaagttagtagacagaggcccattaccatctaaagaaccgagatctaggtagatacaaccgtagatcaagattcaaacggttgtgctgatccatttcccgtaatagaacgttatagatgtctcaagagagaccccaggttgagcttgtggaactgtagtttaccaagcgacccgaagtaggcgcattagatctacttgttgcctcaatacctcgtcatcagatgactatgctggtactcgggagaaaatgctaagcgagagcgatatcacgtcatttgtggaggcatcgctttgcacacctagatcccttagggaagggtcccccgcaagaagccccattagatttaccacccccagcttttccacgttagatttagcctaataggtaattaacattgaagcaatattcatcccctgctttaccagtagtacaccactcgcctccgtttggtgcgccaagttggggggcgttgaaacagtaaaacttttggtaaacgcctaaggattcgacacaagttgaggtctaagcggtacggaaggaggatagtaacgttataataatctacgttggcccatattgtacgccagtagaaggtcgctttctctcagtttaaacatattatttacagcgctcgaacaataccaaggtattccttggcaattttcaactggtactctgatggcaaattcacaagacattgttgttttcgacaagcagttttcccaggaattaaattggagcaggcggatgtgctagactaatacaatcgcgagcgttaaaccccttttggattggaccttccgcagaggggttctcaaggtcccaataaaaattcacaaggttgtaacaacattccgtttggtagacgaacaggtaaaagggccaaaggccccgcaaaacggaaaacagctgcgctacacagtacacaatgtacaacggatacacacaccttgggatgcgggtggtgcggaccacaagactgcaggcgaaagccaaaggcggatagaataccaaggggaggaaacgctcagggaaaggcccacacaccgtgcaaacttcccaaatcacggacgaagtccgatttttatacgacggggggcgacggggcgctctaataacagcgagcccagctgtgagggagacgcacgcaagcacgatagcaacaacacggtgggccgtcaagcgctgaacactacgccgagcacagcagcgaccaagaatatctggccgcccagaaaagagagagagggcgcccacctcaca

SEQ ID NO: 589953 - DNA, 187 bp, Homo sapiens
agatttgaataaagtgatgaagttgcattacccccctcacgcaaagattctttacttagcttgtttttagattttcttctataatatattttatttatatcccatctagaattcagctaggtgctgctgctgctctgtttcctttgatgacgctttgaaataaaggcaggagtacaagcaaaaaaaa

SEQ ID NO: 589954 - DNA, 242 bp, Homo sapiens
gactctagagatcccgggaggaagagcgaccctcacagtaacatgattacttagcaccatgttacagcttccctacagatattcagtacaggtaagtgtgctcgtacagtgtttgcaggcccgggagcaataagctataccatcatctaggattgtccaagctacaacttcaagcagaagagagaggagttgtgtctatcaaagtgagtgtgtgctaccccgttacctggctataaaggaag

SEQ ID NO: 589955 - DNA, 3053 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttgggtttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgatcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctcctgcctcagcctcccaagtagctgggattacaggcacctaccaccagggccagctaatttttgtatgtttagtagtaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589956 - DNA, 3218 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctctgttggtgtcagggcaaggacaaagacccgggacacctcaagtctgagtcctggtgattgccaggccctggggaatgggggaagatgtggtcagaggctcttcttgtgaccggggcagtgatgtgtcttctgctggaccggcaccttttgtttgtcccattggtagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttgggtttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgatcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctcctgcctcagcctcccaagtagctgggattacaggcacctaccaccagggccagctaatttttgtatgtttagtagtaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589957 - DNA, 133 bp, Homo sapiens
agacggtggtacctctgtaattcagcactttgggaggcgagcaggcggtcatgaggtcagcatcgagacatctggccacatgtgaaactcatctctattaaaatacaaaattagtgagtgtggtagccgtgcg

SEQ ID NO: 589958 - DNA, 123 bp, Homo sapiens
gtcgtacttgacctccttagtactgggatacaggtgcatgcaacatgtcagactaatttttaagttttccctagagatggggtcttgctgtgttgcccaggctggtcttcagggcccgagagt

SEQ ID NO: 589959 - DNA, 230 bp, Homo sapiens
ccggacgtgtacaatggggtagggatcctcacctcgatctatctgagccagcagatgagggtttaacgttggacttgatgaccaccttgaactccagtttggtgcgtcccacttctcgcactagacgggatcacccggaagggcagcatgctgtccttggttgtgcgatacctcataagctcaaactctccatctggcgggatacaagctgatgccaagttagcgtgtga

SEQ ID NO: 589960 - DNA, 3137 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctggttttgccatgtttcccaggatagtctcacactcctgggctcaagctgtcctcctgccttggtctcctaaagtgctgggattaagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttgggtttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgatcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctcctgcctcagcctcccaagtagctgggattacaggcacctaccaccagggccagctaatttttgtatgtttagtagtaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589961 - DNA, 3176 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacatagatggagtcttgctctgtggcccaggctaaagtgcagtggcaggatcatggctcactgaagcctgaactcctggcctcaagcgatcctcctgcctcagcctcctgagtcgctgggactacagaatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttgggtttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgatcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctcctgcctcagcctcccaagtagctgggattacaggcacctaccaccagggccagctaatttttgtatgtttagtagtaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589962 - DNA, 774 bp, Homo sapiens
tgtatacgtagataccgccacaacacacgaaagagacaaaagacgagaaaaaaaaaaacctagaaatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589963 - DNA, 949 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgtgagtggcaaggactttggagagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtgcaggtggcgtgaatcttgggttcaacggaatctctgccgtccctgaccctctggcttcccaggcttaagggaatttctctggctcagctccggaatgggtgggattaccgggtggagattccgaatccaaacagtctggggtatctggaaaaccgtgaaacg

SEQ ID NO: 589964 - DNA, 348 bp, Homo sapiens
ggtaagagaagggagagtgtgctgaagaagcccttcttttgatgtgtgctgaccagaacgctcttgagcccaggcatatgttgagcattaacactctgtgacagagctgcagacccctggcttgaggctcatctcagcaatgctggcacacctcttgtctttcagagatggtaggttacttcattctttgtgacacgagtcaagtgggtcagtgtccctctggccccttgcattcccaaccacatttgactgtggcattggatatgtgagctgttggcaattataggaaccttcaaggattctcgctgcatatcttgacatatcttgagagattgcatgtgttgtggg

SEQ ID NO: 589965 - DNA, 1817 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589966 - DNA, 3099 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggcttgatgtgtcttctgctggaccggcaccttttgtttgtcccattggtagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttgggtttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgatcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctcctgcctcagcctcccaagtagctgggattacaggcacctaccaccagggccagctaatttttgtatgtttagtagtaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589967 - DNA, 672 bp, Homo sapiens
gaaatatccagtagatggtgtctagggtattaacataccgtcagcttcccgtgtatcctcggtgtgttacatcgacattattccgttagtggacgtatccctagctgtacactatctgaaccgattgatcctatttttagagctcaggaggaatccactataagacactcagaatgggtaatttctctttcaccttcgtcccatatgtgtctcgtgactgggacaacacaaattttttttcttgtgatgcagtctcactctgtcgcccaggctggagtgcagcggcgcaatctccattcactgcaaactctgcctccctggttcaagtgattctcctgcctcagcctcccgagtagctgggattacaggtgcgcgccaccacgcctggctaatttttttgtatttttagtagagacggggtttcaccatgttggtgcgtgagccactgtgcccggccaggagtaggattctcgggctcccagatgactcctttttgtcagaggtggtgtttccaggaggcccttggtcttgaacctggagactgttgggtcagccgtgctctgcaagagcaggcccgttctacagtgctagtgtcttgggcggttcccaggcacaggcggttctgttctttcatcttgccatgccgatacttctgtgcgtccacacctttcc

SEQ ID NO: 589968 - DNA, 3075 bp, Homo sapiens
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgtgagtggcaaggactttggagagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttgggtttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgatcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctcctgcctcagcctcccaagtagctgggattacaggcacctaccaccagggccagctaatttttgtatgtttagtagtaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589969 - DNA, 1333 bp, Homo sapiens
  misc_feature (1333)..(1333): n is a, c, g, or t
gcgtgatgtctcacagaaagttctccgtctcccagatatggtggtccctcgggcttcctgtcctcggaagcgcagcagcaggcatcgtgggaaggtgaagagcttccctaaggatgacccgtccaagaccggtccaccttacaggcttcctgggatacaagggtgtccatgagtcacatcgtgcggtgaagtctgatcacggcctggagtatccagtggtgaacaacgaaggaggtggtggcgaggctgtgaccattgtagaaacaacaaccatggtggtagtgggcacattgtgaggctaccgtggcataacccctcggtaggcctcctggaaccttccatagcacttgtctgttgcctgcagccaccatcaagttgcatagaattgctcagcaaggctggtttccttatagcagccaatctcggcgatcaaggtcttacacgaagaaagggcccttctacgccagacgttgactttgcaaacggtaacttgggccaggcgagtccacgggactgggcccaagcaaaggcaacgctagcggaggaaatgtgaagctatgcatgcgaggccaatgtacacggacaggattagctggccccaaaagctgcgataccccggtggttacaattgtgtcccaacagtacgctcctagtaattgctgtcgctgtcactctcacgatcattgtcaggcctgagtcagcagcaccagtgctcgctgagcgcttgccatttgtgcacgcaagtcctagagcttgtacacggcggcaggggcaaccatggatgcgtccccggaagcaaaagaccttcggggaacttgggaggcgcccagccggttagagagggcccttatggaggcctcgcacccaatgggttagccaccttggcttgaaaaagccccaacagaattggatttctcgcgtggcgccaaggggcactctgtcacggaccttggaattccgcacccgttttctattctgcgctggggtttggacccccaaagcgggggccacaataacgtggcctaacccaaaaaggtgcggggttccaccccgaaaaaggtccatggttgttggggacaactaaccatataaggaaaaggactttggcacccgcccctggcaggagaggaatccgcaaaaggccgggagaggaggccaccttggactggccgaaacggggttgggaggcccgctaggatacttatgggggggggcaaatttgggggaaattgctcgtggggcctaccaggattggtttagcgacccatttacccgtcgagttggatggcgcgcacaccggagcacacgacattggcggtcagcacgcagtagn

SEQ ID NO: 589970 - DNA, 237 bp, Homo sapiens
atactccaacatcgaacggactgatcgtggagtgtctatacttaaaagatggtttatgtgtgtcgagactgttataaacccattcgctgcagaatcaagcccacttttaggcttaggaccaggttctaactatctaaaaatattgactgataacaaaaagtgttctaaatgtggctattctgatccatagttgttttttaaagaaaaaaaatgtatggatcagtccgttcgcatgtt

SEQ ID NO: 589971 - DNA, 2610 bp, Homo sapiens
gggtaacaaagtgagacctcatctctaaaaacatttaaaaagtgagccaggtgtggtagtgcgtccctgtggtcttagccacttggaagtctgaggcaggaggattccctgagcccaggaggttaaggctgtagtaagctgtgttcgtgccactgtactccagcctggaggacagagcaagaccctgtcaaaaagatgaagcagtatgaccctcatattctgccctgcttggcacctgggctgggcaggacacagacccagaggcccctggcctgccctgtggacttgggggtcttctcgttttccttgcaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttgggtttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgatcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctcctgcctcagcctcccaagtagctgggattacaggcacctaccaccagggccagctaatttttgtatgtttagtagtaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataaaaaaatggccttcttgggcctcaac

SEQ ID NO: 589972 - DNA, 199 bp, Homo sapiens
cctgtctaaaactcaggtgaaagacactatagattgttctggacaatacattccaagaatactgggcttatgggtgggttggtgttttgtttcgttttgtttagttttcaagtcatgtctttatccccatattatggagaatgtgccacttggctaataatgtgttctcaaaactacaagttcagtgatgggtaccgag

SEQ ID NO: 589973 - DNA, 462 bp, Homo sapiens
agtaagtgagtcagaggcaagcggggtgggaaatggggaggaaagggagactggcggggtgagggcagaagcagagtgggtatccggaaagaaggcattaggggaaaaatgatggtgagagagttttcatccactttggcggttccctccagtgtgggttgagcttgccaggggggggtacacggtagattgtgcttcctcttggcgtgtggtcaccaggctctccttaatcggtagatacccccaactttctcccagctggtggccacttgatatttccaaagccagttctttacttctcacattataagtgggcaaggcagtggccttagagcggtgacggtccttttcctttaaggaacttccgggtgacttggcaggttccattaggagtcttgggcctctggaggaaggggttaggtgtggtttggtacccagaattatcacggggggatcctctag

SEQ ID NO: 589974 - DNA, 100 bp, Homo sapiens
  misc_feature (3)..(3): n is a, c, g, or t
aantatacatcagtgtgtatatcttaaatatacatagtacatttatttaaattaaattttgcttactatgtacaagacatggtaaagtactcaagaaaaa

SEQ ID NO: 589975 - DNA, 397 bp, Homo sapiens
ttgtctgcctctgaggcaataacaatcaacgcgagaggcacacgagaaggagcaggctgaccctgtgcccagagtgttctttagagcgcgctaaaaacctcaacatatacaatctgcagagtctcactttaaatggaggcacaagcctggtataaaggatccacgcagggggccaggctggctgtagtgctggcctagaacttgaacctatgagccagacaactcttgttagaggatttggtagggtggagaggggaagccttcaggaaacctgggcttgaaacttaaacagcaagcaagcaagttgaaagcagtggtgttaggaatgggccatgtgcctgtatgtcttgcatgggggggaaggaagactggacatagtaataacacatgagcaact

SEQ ID NO: 589976 - DNA, 244 bp, Homo sapiens
tgggaggccggggcaggcagatcgaagaggtcaacagatcacgatcatctggccaacatggtgaacacccatctccaccaaaacattacacacaaatgagcttggcgtggtggcatgtgccctgcagtcgctagctaactcaggaggctgcggcaggaagcatggcttgagaccaggaggtggcaggttgcagtgaactcaagatcgagccgactgcgacctccaatttgatgcagagagcgag

SEQ ID NO: 589977 - DNA, 603 bp, Homo sapiens
gctatgtctcgagcgttagagaaagtcctaagatattttataaaatcgattacaaatgcttcgtaaagttcagtcttcaggcatctgaaaaagggttaagtataccatctaaataatccccactactaaataatctccaaggcaggatctaggtactgcaaagaccaagttcacagatcaccgaaaggaacccttaactcacaaacagtccctaaacctgtggtgtaaaacagtggttccaaaattcagctgcatttcagtatggtctgagaagcttctaaaaaatagattctcgtggccgggcatggtagctcacacctgtaatcccagcacttggggaggccgaggctggcggatcacttaaggtcaggagttcgagaccaggccaacatgtgaaaccttgtctctattaaaaatacaaaaattagtcggtcatggtggcgtgtgactgtaatcccagttatttgggaggctgaggcaggagaatcgcttaaacctgggaggcggaggttgcagtgagccaagtccagcctaggagacagagcgagactcagtctcagaaaaaaaagggctttttcacgaaccatgatggatgattaacct

SEQ ID NO: 589978 - DNA, 870 bp, Homo sapiens
gctatgtctcgagcgttagagaaagtcctaagatattttataaaatcgattacaaatgcttcgtaaagttcagtcttcaggcatctgaaaaagggttaagtataccatctaaataatccccactactaaataatctccaaggcaggatctaggtactgcaaagaccaagttcacagatcaccgaaaggaacccttaactcacaaacagtccctaaacctgtggtgtaaaacagtggttccaaaattcagctgcatttcagtatggtctgagaagcttctaaaaaatagattctcgtggccgggcatggtagctcacacctgtaatcccagcacttggggaggccgaggctggcggatcacttaaggtcaggagttcgagaccaggccaacatgtgaaaccttgtctctattaaaaattataataatttgggccgggcatggtggctcacacctgtaatcccagcactttgggaggtcgaggtcggtggatcacttgaggtcaagagttcaagaccagcctgacccacatggagaaactccgtctctccttaagataccaaatcagccgggcgtggtggtgcatgcctgttatccccgctatgcaggaggctgaggcaggagaatcacttgaatcccggagccagaggttgcggtgagcccagatcgtgcccttgcactccagcctgggtgacagagggagactctgtctccaaaaaaaaagtgtaactccagcttttgtcagccagcctgtaatacccatagtttcccttgcccagaaaacattgctacctaatacagaggatatcaccccatgcgcttccactgaaggagcacaggtaggggacgatggaccataacgatcgacacata

SEQ ID NO: 589979 - DNA, 808 bp, Homo sapiens
tttctttgcactaaccttcaggaaccacgctcactgactctcaggactgctactggacaaaactaactctttgctattactacttgctcagatacgcacaaacgggacacatatgcagccacctccctagcagcctccatgacacgcttcccagcaacattctctggtttaacaaactggccttaccccctatcaacaaacacaaagaacacccgcgcgcaccaacacgggctacacccattgccccaattcacttctctctctgcacactcacgcagaattaaccacttcactctatctctcatctggcgcgctgcactggccctggattgctttactctgggcaaccggatatccatccttctaactttccctttaactggctaatttcgccccgcacctgacttaacagacaacatgccccatctcttgaactggttacaaaccccattcttcgcccctatcaacctttgtaacacatggcaacgtttgcccatgttaatacgtttcctgctttcgacaaaactaacgaagacaactccccacggatgcaccaccacgccttgcactccaactgggagaatactacctggtttacaacccccgaaatcacccccacccactggtttgtgcaccccatggtaatccgaccacaacaaggctaaaggaaccacttcaaaagaaagcgttctccaggcttcaacacgttttgcaaacacaccactttgacgccaagtgttatgggcaccttggactcagcacccttcaccacactacaatctcaattatttacccctgcgcccttgag

SEQ ID NO: 589980 - DNA, 860 bp, Homo sapiens
ctgaaagaagcactaaatacggaaagaaaaaactggtaccagccactgcaaaaacacaccaaaatataaagaccaatgacactatgaagaaactgcatcaactaatgggcaaaataacaaaatagcatcacgacaacaggatcaaattcacacataataataataaccttaaatgtaaatgggctaaaagccccaattaaaagacttggactggcaaatggataacgagtcaagactcatcagtgtgctgtattcaggagacctatcttatgtgcaaagacacacataggttcaatataaagggatgaaggaatatttaccaagcaaatgtaaagcaaaaaaaaggcagggattgcaatcctagtctctgacaaaacagacttgaaaccaacaaagatcaaaaaagacaaaaaagggcactgcataatggtaaagggaactattcaacaggaagagctaactattctaaatatatatgcacccaatacaggagcacccagatgcataaaacaagttcttacagacctacaaagggaattacactcccggtgtaaataaccagtatggagattttaacacccccatgtcagtattagatcactgaagacagaaaattagcaggtatccaggactgaactttggtctggatcaaggactagtagatggctaaaggaatctttacaaattaatagaatatccttctctcagtgcacatggctttttcaatcacactatggaggcacccttcttgcatgcactgacgacaaagtttggccgggaataaatgggaaaacccagccgttggaaaacgccgaggggaaaaaaaggaagctgcgagacagcatggcaagaacttgcaa

SEQ ID NO: 589981 - DNA, 838 bp, Homo sapiens
gagaaggaagaagaagagggggaggagaaagagatagaagaagagtcccacgaactggctgggtatacagaaatgtccagaggccggagagcgtttcagatcacatgtaccggatggaagttatgggtatggtgatcaagagatgaacgtcgttaacaagagaccgatgtgtacgacctatgcaccgtggttcgatgatatgggagaatggatctgtgtgtgggagatatagaaagaagataatatcttcaaagagagaagaaataggtgagaagaagaaagagagaagggatgagataatgaaatcgatttggatctgtgacatcctgtagacttaacgggctcagtagccagcaaggattttgcgccttcaataggaggctagtgaagcagatatacccagctcctaccagaggacctcagaaaggagctctatgaagcttgggggaagagtacgagacccaagtctagtgcagaagccaaattgtgaagcagctagaacaatgtgaagagtgattcttcaagcatctgaatatgaagaccttgaactacaaacctgggagactgcaagacttctatgattccggcaggaggaaaattcaagtcaccctgagataaggtccagcttgtttctgaactgtgaggagaaagaagcatagcatagctgcaagtggcagtgagcaaatcctgagaaatctttaaattgtgggtctgttacaaacgttttttccatttcatgggtgggtttggcatgggggctgtggattccctaaggagtggttggtcatgttgattagagaagggagatggggtcaaaagcagaaagagggtaagggga

SEQ ID NO: 589982 - DNA, 804 bp, Homo sapiens
taagagtaacccctcttttctccaaaggagtgcttgtggagatcggatctttctccagcaatggggggaaagaaggctttttctctgaattcgcttagtgtaagccagcggcgtatattttttaggcgccttcttcgacaacctagtagttactatctcattcgtataaatcttatattatactttaagctcacactgcttaagaataccttaattccttaaagtgaaatacttccattgcaaacggggtttcctcgattcggagctatattttccacttccaccgtcatttctaactcttaaaaccaactcaggttccatacatggtgatgttcaagaagatcaagatattttgaggtggatctatttaacgacgcctgaaaaggtgtaaggcagaagagagagaaggtgagctggacagggtgatagtggaggtgtgtgaagtatatcgatgtaaaagaggataaggatcactgggttgcggagatggctaaaagatgcttaggatgcacgggatccacagcagtgacaaaaacgacctatccgggagttacctgcgcctatgaacagaccagccaccttactgaaaagaacagccaaacaggttgaccaactgagcatggtgcctcgtgaagacctgtgaacacaaatatgacatacaaggttggagtttagacacctcctccacgggcctctggggcaacatattacaccggacaacatcgcgcggagaagactcaccggagtcgcagagatatcatcgaccgcacagaagcaacacaagataaaaaaaaacaaacaaaa

SEQ ID NO: 589983 - DNA, 740 bp, Homo sapiens
  misc_feature (36)..(36): n is a, c, g, or t
  misc_feature (78)..(79): n is a, c, g, or t
  misc_feature (87)..(87): n is a, c, g, or t
  misc_feature (96)..(96): n is a, c, g, or t
  misc_feature (111)..(111): n is a, c, g, or t
  misc_feature (119)..(119): n is a, c, g, or t
  misc_feature (135)..(135): n is a, c, g, or t
  misc_feature (158)..(158): n is a, c, g, or t
  misc_feature (192)..(192): n is a, c, g, or t
  misc_feature (202)..(204): n is a, c, g, or t
  misc_feature (227)..(227): n is a, c, g, or t
  misc_feature (234)..(235): n is a, c, g, or t
  misc_feature (251)..(251): n is a, c, g, or t
  misc_feature (255)..(255): n is a, c, g, or t
  misc_feature (286)..(286): n is a, c, g, or t
  misc_feature (304)..(304): n is a, c, g, or t
  misc_feature (314)..(314): n is a, c, g, or t
  misc_feature (364)..(364): n is a, c, g, or t
  misc_feature (371)..(371): n is a, c, g, or t
  misc_feature (472)..(472): n is a, c, g, or t
  misc_feature (480)..(480): n is a, c, g, or t
  misc_feature (543)..(543): n is a, c, g, or t
  misc_feature (545)..(546): n is a, c, g, or t
  misc_feature (729)..(729): n is a, c, g, or t
gtaatcttttaaagttctcttaactctaggaattanagttggacagcatgttatcttgaccagaaacttctaaaaatnngctttgantgtcttaantaggcaatgtcactnttccaaancagcatgaatcctggnctccagtccacacctctgccggncagacgtccatcccagtcataccatgactggcangccaccactnnncccatgtcctcagtcttcctcangtcttcnntgtgtgtttgttactnattngtcctctgttacatctcgtcttccttcaggncttcagtgtgtgtttgtnactgagtggncctctgtgacatctcgtcttcctcaggccttcagtgtgtgtttgtcactnagtgganctctgtgacatctcgtcttcctcaggccttcagtgtgtgtttgtcactgagtggacctctgtgacatctcgtcttcctcaggccttcagtgtgtgtttgtnactgagtngtacctctgtgacacctaggcttctgtgacacttaggttaagcttattagaagttgaaaaagntnnatgaagttttttagcccagaaaatagatgacttcattgagagttaactcactgtgtaataggacacattttaataaacaaatgatcagcattttacacaatccattttcttcagaaaatctagagcaagggataacttcattatttgcataacatttcagcattgcagtttgaaaacagctgnactttcagatg

SEQ ID NO: 589984 - DNA, 857 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggtatgtaattcccatttctggaatgtggctggacacccactattaccttgtaagaattttgtaattgggccgggtgtggtggctcacgcctgtaatcctagctcccagcactttgggaagccaaggcaggcggatcacgcttcaggtatgga

SEQ ID NO: 589985 - DNA, 1454 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtaagtgaaatgcttgttggataaaagctttctgcaaagggtaatcttagaagacattatgtaacttttactctatgttaaaaaattatgagattatataagtggtggtagggatttttgggtgaatttaaacaccttgtaattaatagtttttcctggctaatgcattattttgaaagaaactggttacttattttcctgactctaaataacttgtagattttgcagaacaaatttaccggaaatctgcattaatagtttttgtaattaattaattacaaaactagtaattaatagtttttcctgcctaatgcattattttgaaagaaactggttactcattttcctgactctaaataacttgtagattttgcagaacaaatttactggaaatctgcattaatgttcaatttaattttatttatttttgtggcatttgataactattcaaaaacaatagaagatggaatcctttgtaagggtaaacatttgacctatgataaaacgtgactaagatgagggagagaggaaatacattaagagagtttcgatctttcaaaatgccatacagttttctgcttttctctctgatattaggtatgaggttaatttccaaaatggaatagaatgtggtggtgcctatgtgaaactgctttctaaaacaccagaactcaacctggtatgtaattcccatttctggaatgtggctggacacccactattaccttgtaagaattttgtaattgggccgggtgtggtggctcacgcctgtaatcctagctcccagcactttgggaagccaaggcaggcggatcacgcttcaggtatgga

SEQ ID NO: 589986 - DNA, 170 bp, Homo sapiens
tctccatgtacctaacaggtagcttccacattactgtaccaagaacagattagaaaaagcaagatggttatcccgatttagtagcctccctttggttcctcacctcatcagacaacaaacagaatgttaacagtctttcctgtgatgtatttccttctttcacctcactt

SEQ ID NO: 589987 - DNA, 288 bp, Homo sapiens
  misc_feature (93)..(93): n is a, c, g, or t
  misc_feature (164)..(164): n is a, c, g, or t
  misc_feature (200)..(200): n is a, c, g, or t
  misc_feature (230)..(230): n is a, c, g, or t
  misc_feature (262)..(262): n is a, c, g, or t
  misc_feature (264)..(264): n is a, c, g, or t
  misc_feature (287)..(287): n is a, c, g, or t
cttgactataggcgcaaacgggaaagtttgaatactcccttcgctcgttctgttatcctttctgttaagtcaatgcccgatgtttccacgggnttgaatcataacgttctcgtctttagtaacctaactcctttggaattctccctagtcctactcgcagcatnccccataaaattgtggttggtagagatacatcattncttgttccagttaatccatagcaaccgttntcgcgactccgccgactgggaccgtgccagtntngacgacgggtacctctagtagtnt

SEQ ID NO: 589988 - DNA, 179 bp, Homo sapiens
ttatcccgtgctgtagtcgctatgccgatcgagtgtcgcactaagttctggcatcatatggtgactcccgggagcgggggaccacaggttgcctaaggaggggtgaacctggcccaggtcggaaacagagatgatcataactcccgtgctgatcaataatgggacacgaatgtacagga

SEQ ID NO: 589989 - DNA, 1181 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctactggttcggagactggtggtccatgaacctctgacatttcttttgacaactttatcatttgtgctgaatcgaaagaataatcgatgatgggccaatgatggattggggcctgagcaaagttcttgattcggctgctgatccaaggcgtgt

SEQ ID NO: 589990 - DNA, 722 bp, Homo sapiens
agcgggggtcctcgctggcaaaagctgcggagggcgggaccaaccaggacaggacggtgactgtcgtggaatcaccaagaagcagggcaagagtggaaataacagcttccagatacgaaggacgaagactagtagaatcaggagcaaaatttccgtcaggaatacatacagccttgtggctgtcccgtctacagtatctgctagaatacaagtacctagtctctcagcccatagtgaagaaagacgaactggctaaagattcttcagggtttagcgcaagcgatacatagcagaacttcaaaaaggctaccgatccttaaagagatgttcctcctgctgatcaagagaagcttctggtatccagaagtgacgtcagtgttgcgtcctcgttcgacttagtcactgatccaggtaagtgacctaaagctggacaggaagtaaaacgagctgctttaaagttgacaatggtacgactatagtcacccataatcggacatgtgatcaccgagcctatttaacccagaagtagtccatatgtatgcagttaacatgtttctgaacattaccagcttccgtccaatcctacgggagcggaattatgacccggaggaccgatgaaccgacgtgagaagcaggtcaggtctcatctacatgattgattatgaatctcttgcttgaagattgtaagagtgtccagacttccaacctaatatagcgaagaa

SEQ ID NO: 589991 - DNA, 187 bp, Homo sapiens
gagtgtcttcaagaaggagatgttatttcacttgtgacttcctgccaagtgaatgagtatacaattataagcaaactaacacagttcagttgattaagttagaatctgtgaccacctaatgtagctcagggtatggtggatactagatataaacaagagtagggaagtcttcggcacgcatcaggga

SEQ ID NO: 589992 - DNA, 470 bp, Homo sapiens
ggggggctgagactggacctgggtctgcctgacctcagaggtggctctcaggatgggtgacggggggcttgtgtctgtaaatagccatgatactaactttcttcccatctgtgcaacggggccccccaggcactaggaggtcctcccctctcctctccacacccgtgctgccccctcggtgggtgggggggtggagtggacgtactgggagccggcccggggaaagcaccccatgcccatccaagaagatagcggatgacgtgttcagacagccatagaggagtcgggggtcgacacggcccagcaatcgtcaccagaaaggcaaagacaaaagacagacacacacaaaacgcaaacgtaaaccaagaacaaaacaaaccgaacaacaagcaaagacaccaggaacaccacagaacgcaaaagaacaaacgaacaagagaccaaaccaacaaaagaaagaaacaatcagc

SEQ ID NO: 589993 - DNA, 1115 bp, Homo sapiens
cgggatggaccagcgactgagagagccagaggcagagaggtgagggtgaccatatcctggactgtgagaggaatgggactctgggcctgtagctgccaagcaggtggcaggtgctccagtgctgtgatcttgcaccctctgacccctgacattgacctcctaccctgacccctgcctgacctaagccatgtctgaacaggaggctcaagccccaggtggcctgggggctgtcccctggacatgctggcagagcaggtggagctgtggtggtcccagcagtccgcggctgctcggcggctctgcttcgtcgtggcctgtgggcctcgtggcagtgcttgtggcgctgggcggcgtggcacttgcttgtctaaccaccttgcagccgctcaggtgaatggccggctagcacacgtggcaactgtgctctgtttgctggctctgctggttctggtgaaccaggcttgatgagctcgggctgtgccagggaccttgaactggcatccggccagggcccatccattgttggcccttgctttgcgcacgtgctcgcctcggtgccgtatgggccccgttcgattggctgcctgcctcacgttgtgctcctcggttgcctcgcttgggctcaccctggggccttgaatcccttggccccgagggctttgagctctcgtgcgtggttcccccttttgacgccgcttgggctcacagggcagcccacgcacatctgcgcgcacaagcccaaattaggcacttagatccctacggctagaggtgccaatttctgggctctccataggggacttatgccccattatgagacggagccattccccggcacagttagtatagggccgtttggcccccttacgtgttcagtggctcccctattcggcttcttgggggtcgttagacgtactgctctcagagatgggtattgagagggggagctacggattagagaacgcccgggtgcaaccacaactcgttttctggggcctccggccgagttctgccagcattcacctctcgaggctaccgttcggagcgcccccgcacagcctccccgccgctttacccgctgcgcgacctgagccacgggtcgtctggggtcctcc

SEQ ID NO: 589994 - DNA, 422 bp, Homo sapiens
cgcaatcaccacgagatcttcatcttcaaccaccagcagagcgcctgatgggaatgctgtataaggtagtttactgaatgtgcgctaaacacatgcaccactggcctgcaggccctcactgcacttccatttgtatgcatcgctgttttattcgtcattttaggatggcgttaatcaaatctccacctttatgtttgtcttctgtaatgcgtcaaagctagaatgaaatcaaactcttgttatgcttttaaaaaggaaaccgttcaagatcgtgaactactgtgctgtccaagattgtatgtcttatttcgatgtttagtttcgtttttcactttaaaaagcgcctacgcctttcgtttgtgttcaggaattagaatgatgtaagatcaagcgctatacaatcctcctaataggactatatt

SEQ ID NO: 589995 - DNA, 901 bp, Homo sapiens
ctttcaaaacaacgcggggaaatataaaaccgaaccgtgttagttatcccccaaatccatttccaagttcattatccgcgcttgtgaattacaaaccttagctgtggtttctctttttaccgtgtgtaacaagattgccttgggttaaaatcggacgcgggaccaatctcggacgtgaatgtcaatcggaaatggcaacttcaggaggaaccgtttccctttgttggtgctataaattggtttcatccgctcaaggtgacatggggcttccttttaggaaaaccttccaccgtgagggccttgcaaaggtgtgaatttcccttcactctactcgtgtagggcctctttcacccacaaaaggtgcgctaacacgagtctattatgcccaattgagatgctacccccactttctctgagccttaattgttggctgatgatttgtctgtctctataatcgtgttacctacccttcactcctgagctgcactgcctacccttccctcataggcatgcttcttcagtaatcatatttcatatttgccatgtctattggcatgcatgtagattcttgaaaatatatagaattgattttgtgtgcattttgttattgttacacactgttcactgctgttctagtagaacaatctgcaattaaactgtaacttgtgcattatcaatcttgcactctcttctttatgttatctggtaatcattttgtgagagaagtctaactttcactaaggcaggttacttgatagacaagcaaactctgccctgtcttccttcacctgctgagagggatcaagcaaacccccaaatcatgatatgcttccacgtacaattcatttcaatattcctttacttcatatacattacgcctgaggacttccatttctaaacg

SEQ ID NO: 589996 - DNA, 469 bp, Homo sapiens
gctatttatctgccaacacagcactatattgggtattattaatgttgatgtatggttaaatcttatctcttttttatacacaatacttcatgtacctatgaaataaaacaggtaagggcatatgtcccagtgcaaacacgagtgagtcacacctgttcaattagaacagcaccatcccactgattgtcgctgcagtccacggcgttactaagcctgcggcaaccacgtagtgccccaggaggcgctaccaggctcttcgggccacaggcctctcctccactgcattgttggcggcagggcggggtaaggtcgcagggctcccatagattggttggggcaagcttcaagggcacattggggcagaggccctccgaaggtcccctccttcagtaggggatgtcattcttgatagtacctggactcatgttgtaaggtcccggctccctggttgcttgaatgaaggcaggct

SEQ ID NO: 589997 - DNA, 529 bp, Homo sapiens
  misc_feature (54)..(54): n is a, c, g, or t
  misc_feature (81)..(81): n is a, c, g, or t
  misc_feature (92)..(92): n is a, c, g, or t
  misc_feature (116)..(116): n is a, c, g, or t
  misc_feature (118)..(118): n is a, c, g, or t
  misc_feature (137)..(137): n is a, c, g, or t
  misc_feature (139)..(139): n is a, c, g, or t
  misc_feature (158)..(158): n is a, c, g, or t
  misc_feature (172)..(173): n is a, c, g, or t
  misc_feature (230)..(230): n is a, c, g, or t
gacggggctgagttccgtggccagatgcccattacgcctggtgaccgagcggcnccttctcaaaattaaattaaaatactngactaactgcncaaaaaaaaagtcattaaaattcntnttttggagccgggcacgtntntcacgcctgtatcccgcantttgggaggcccanntaggtggatcatgaggtcaagagatcgagacctcctggccaactggtgaaacctgtntcactaaaaacacaaaaacattagctgggcgtggcagcgcatgctggtaatcccgcatttgggaggccgaggcggcagatcacttgaggtcaggagttcaagaccagcctggccaacatggcgaaaccctatctctactaaaattaaaaaatcagctgggcatggtggcacatgcctgtaatcccagctactcgggaggctaaggcacaagaattgcttgaacctgggaggcagaggtgacagcgagccaagatcgtgccactgcactatagcctgggtaacagagcgagactctgtct

SEQ ID NO: 589998 - DNA, 685 bp, Homo sapiens
tggagagaagggtgtggtgtcccccggcgggtcgggatttccccctctcgtggtagagcatttctctcacacacacggaggggccccttctcggttaatttcccctcgctgcgcgatctagcctggggagagaaccaccccaatgatattctctctctctaacgacaggtcgcacagagtgttgatgtagttctgagggaatatgttccccgacacacccccccagtcagagaggccagccgtcgcacgacactcgggaacacacacagggggcgcgcagcacactgcggatcggtgggagaatacacgcatagagagagatatctctccaatttgtgtgctcacaacgacacatagtggggaagaccccgcctgtgggggcccccccacaaagagacggagaatattatgaggggcgtacgaaattgtgcgtctatgtataagaacagaagacagaggcttcccacgaagcaactgtggcgcgcacacgacaataaagaacgagcggcgtgtaccccggtaaacaacacgcgcttggtttgccgcacgcctcctgtggacacacccgggggcccggtccgccgccggcgagggacccccgcgcggaaataaccccccacgaagtgacaccttgttgaccgcaccacaaaacaaagcagtctccccccgcccaaacaaagaacag

SEQ ID NO: 589999 - DNA, 766 bp, Homo sapiens
ggctcactagtaccagggtgcaatcttgggtcatgcagcctccacctcccaggtacaagtgattctcgcacctcaggctcctgagtagctgggattacaggtgtgcgccgactacacccagctaatttgtgtattttgtactagagacacaggttgtcatcgatggttaggccagggcgtggtctcaaactcggctggacctcaagcgatgccagtccgaccttggccgtgcccaaaggtacgtgggtattacagagcatgagccactggtgcccgagcctgtaagcagatcacacttgttagaaagttgatgatgtcagacgtcatctatcactcatgacaacatccgttattctgtatttgttgtgttgggaagacacgccttctgtgctgctcgtgtgagcccctggggcgtggcagtgtgcaagggggggccaaactctgtgggtccctgcagggaaacctctcacgcatctctccacgggttaccaaacgggatactcttctggctctcaagaccaacaggtagtaagcatgagggactaacaggggcggccacagccctcacgcgctcctacgtttgaatttaggcggttttcctgcgtgaggaagacgggggtgtggccgctgctttctggtgccaggggccgggtcttccgaagtgcctggaccttggtgagtccggcggtcatacgggctccccaagtgggcggggctcttcccgggtgggtgtccccggtgcgcccggggccaatttattccttga

SEQ ID NO: 590000 - DNA, 113 bp, Homo sapiens
caaccctggctggggaggaggagagatgtcccagcagctcatcccccctggctgcccagtgcaaagcatttctccatgctgcaaaggagaagcacagctccttgccagggatt

SEQ ID NO: 590001 - DNA, 310 bp, Homo sapiens
  misc_feature (13)..(13): n is a, c, g, or t
  misc_feature (18)..(18): n is a, c, g, or t
  misc_feature (166)..(166): n is a, c, g, or t
  misc_feature (260)..(260): n is a, c, g, or t
  misc_feature (266)..(266): n is a, c, g, or t
  misc_feature (276)..(276): n is a, c, g, or t
atcttaaagaacnttttnaattgaaatttgaaggcatccgcgaagccttcaatcccccttgctcggccccttccccctatctggctgggcgggaacactggtaaggattgcggtggagccaacaagtcctgcggtcccggtatccagtctgggcaggaaagccaantggccgtgagccagctctcccagggggctgacggacatcttcctggggaccagcatctccttcagctccagctgggcccccttgcgagggagangaggcncctacctggncggccggcgatgtgctgtaaaggggcccgcagac

SEQ ID NO: 590002 - DNA, 225 bp, Homo sapiens
ttaaggagagctcagtggggcttagtctccaggaggtgtcgaacatcattaggccatacgcgtctaaatagagtctaatttcattttggcaacaggggtcagaattacggtggtcttaactagaaattttattttgttctttttctcttttgagacagggtctcgctctgttgcccaggctggagtacagtggcatgatcgtatctcactgcagccttgacttcc

SEQ ID NO: 590003 - DNA, 534 bp, Homo sapiens
taatggtctggagtaatgcagtgtccagtctcctgagttcctgggactctgccagattgggctgagcgtgagttccacattccaaccccagcagcccaagcctgggcatggcgtctgagctggcccggctgtggtggggatggggtccgagggcctaggcgcaccaggctcctgctgtcagctgtccaagtagacaaagaggatgtcctcatctgtgccatagctggttctgggctcctcaaagttactgatgctggtgctgcagattcggtcggcatgggctgggttgttgtagaagatgcagccagtggcccggttgtagccaggcagcatgatgaagtgggcctggtagtcaaggagtgcggcagaagcagtggtggccactgagggtgaagcagcagtacttgacaggggctggagcacaggtcacagtgcagcaaccccgagttcaacagcacgatggccaaatggccctgagccaggtgcgccctgggatgtccttcacactcactgtgcatttctccaccaagcact

SEQ ID NO: 590004 - DNA, 182 bp, Homo sapiens
tttggttttgtagcaaagaaatatttgaaataaatccatatttcaacactgaaattgttgaaaagcgtctcataacaaaaggaaaaaacatggaagttttgttttagtggtcagtataggggaatgaaagcgtctgtagttagccacgtaactatgttgataagtattagaggttaagctta

SEQ ID NO: 590005 - DNA, 399 bp, Homo sapiens
  misc_feature (11)..(11): n is a, c, g, or t
  misc_feature (17)..(17): n is a, c, g, or t
  misc_feature (76)..(76): n is a, c, g, or t
tttgggttgancaaaancgactaaagaaccttcgtggaaaggagaacccaaggaaaggagaagggaaaagagcagnaaaaaggaaatagtgttggtccctcaagagggagactttcttcctcagtggcggagagaagaaagtctccctcttgagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctaactgtgcaaaattatcttgccttggccgtgtaatgtgaggtttacctgattctctaatgaaataaatacctaagttata

SEQ ID NO: 590006 - DNA, 388 bp, Homo sapiens
  misc_feature (64)..(64): n is a, c, g, or t
  misc_feature (125)..(126): n is a, c, g, or t
  misc_feature (140)..(140): n is a, c, g, or t
  misc_feature (159)..(159): n is a, c, g, or t
  misc_feature (177)..(177): n is a, c, g, or t
  misc_feature (179)..(179): n is a, c, g, or t
  misc_feature (198)..(198): n is a, c, g, or t
  misc_feature (205)..(205): n is a, c, g, or t
  misc_feature (275)..(275): n is a, c, g, or t
  misc_feature (355)..(355): n is a, c, g, or t
agtccagccgctgcaaagggcatcccccaacgtgatgccgctgggccacggacagcctcccacncgaccaaggacatgttccccgggccctatcctaggaccccagaagaacgggccgccgccgnnaagaagtataatanccgtgtggaagactacganccttacccggatgatggnanggggtatggcgactacccnaagctcnctgaccgctcacagcatgagagagatccatggtatagctgggaccagccgggcctggaggttgaactggnggtgaaccgatgcactgggcacctagacatgttacaacagggaaccgtgtgggatacatcccccacactgtttttttggncatgtcatgtgtttggcagttttttggtttttt

SEQ ID NO: 590007 - DNA, 862 bp, Homo sapiens
gcctatccctccacaacgatgtcaatcctactatgtgctcttgccacacaatcgagaacagcaaaaacgactcagtagcctttcagatcctgtctcagaaagaagagtgggagagcaggactcagcaccaccccaggaaaaacccacctcacctggcaggctatgaaaaaagagcaaaggatgacagtaggcgggtggtgaagagcactcaggacttaagcgatgtgttccatggcatgaagtgggcatcccactccggaacacctgagagatcaaaccgactggtacaagactatgttaaaagatcccacaaactgcaacagagactgatgattcagatctgtactctcccagatactcatcgcaatgacgacacacaatctccccttgctgtgcctcgtcaaaagtgcgctgagctacatgatggtgagaaggtagtcacagaggtcggacacaacataccacttcccagcccgtcttcctcactgaggtcagctcagaaagaaatgactgggcaacccccagaatagaaaaggtagaccacaaggaacatatgcgcggcagaggcccaacggagcacttacgaactcatcagccctggcaaagtctacggtctgacccacgaacacgatgagtcgggatattacggccccacagacagcacgagacaaagcacacaccacgcctgcgagcacgccacgcgccctgacaacaggccccaacacccccccccaccgccacacaggagacagagagcggcacaagcgcaaagaaccggcaacaacgagcgcgccccacacaaaccagccgggacgcggtgccaccaggggcggccgcgccacgggcccgccgcacccccgcg

SEQ ID NO: 590008 - DNA, 888 bp, Homo sapiens
  misc_feature (886)..(886): n is a, c, g, or t
gacatgtagggttttttaaaattatgaagccacaacagttatatttaggaaacaaaattttttttctcttcctggtgttttagattacccaattaaatccagaaccattacattgtaaattatatccataggttttagtttcttgtttttacatttgagacaaggtcttgctctgtcactccagcctgagcgacagagcaagactctgtctcaaaaagaaaaaaaaaaaaaggagagaaaagaagggaagaaagaattgtctttaaactttttttttaaaccaaatttggatttaagtagaggtggctttttcaagtttaagaagttggtttaattggacataatctattggagagatttttacccttttaaatagatgatccagtatccattcattcagaccacttaagtattcatggagacgtgtataatggtgctaaaatactgtcctaggcatggaatggtgggtgtataaacctttgatccaagaccagcctggcaacacaaggagactcgtctaacaaaaaatttaaaaaaaattacctgcacgtggtggcatatgcttgtggtccacctgcggcctcccagagtgtggagatttacggctgagttaaccaaccagctgggtggttttaaatctaacaaatttttctctggtcctctggtttttatacctaaagcctttgtttgaaggcccatcgatgatcctcttatttcaccttcgcattgaatgggtctatgccacattggttctggtcaagcgtcgaatcgatggttggatagcggttccactttgaaaggatatattagagcacaagaaaggtggggctacaaaagcgatatcacttgtcgcagttgtcgtactttgggtgatatatatattggntt

SEQ ID NO: 590009 - DNA, 105 bp, Homo sapiens
agggcaagagtacaagaccagacctaagcaacatagtgagaccccatctctcagaaaatataaaaaaaatcaaccatatggtgacccacaccgtgtagtcccaac

SEQ ID NO: 590010 - DNA, 1176 bp, Homo sapiens
taacctccatcaccgtctcggtctagcaggaacacagctgccctcccttgaccatgaactcacagtagagtggagaggggtggcctcctttacagttccaggtagggggtgattcctggacaggggttcctgagaggagtgggttgccatcccaagaatgcacacagcagaggacgcagaaggcctctagcatggaggaactggaggagaacccatttgtgacagcaacttgctcgcaacttggccctcactgagctaccagctacggcgtgtctgcatttgtgcagctccacatcaaaagctgcggctggaaccttggtctccagggggtgcagcgaacaacaggtccagtgtctcaactagaaacgcggtatttcaacctcttagccatttatccaattacgctgcaccgttcactaaccccttcctctccccttctagctggcgtcagaagaacaccatacacttagccatgaacctgggatacgcaacggcgaggagccttgtaatatctgatccaaggttctccatgccaacaacaggtttcctactacagtcttaccgaaaacattctcaagcctccatttgaagaaccctaactagcgcctttgcgcaggccaaaggcacggcggcatctacctgaggctccacgaagttggaagaccgacgcctgacccaactgctggctgaaaacccccgtactcctacctaacgcattaggcacatcagcccacgcgctgcggaagccaggcggcctgcatagtcccaagcctactggcaggcagcgctcgacgccccagcaccgcacagtgccgggaaacccacggacacggccctccacgggtacgcaccaccgacgctcttgccgactccccgcccacctagacacctccaagcccctggagccaaccacgacgggcgcaccggctcctccacaagcaccagagaccacatagccgctctacactgagggccctcctattgtgcaaacctcgttgccctgttcatccagccaaactggatcccttcaggcttttagctatcactgttgccttccttcgagtctcgccacgtccatcacctccgtcggcctgcccaacggtgctcgcccagtgcctcctcctctgccgctattccgactcgtgggctacaaccgactcctgttatccgcgtcgg

SEQ ID NO: 590011 - DNA, 864 bp, Homo sapiens
tccggcgcaaggccttcctgcactgcatacacgggcgagggcatggacgaagcatggtagttctagccgatggcctggagtagcaacatgaatgatctggtgtccgagtaccagcaagtaccaggatgccacagccgaggaggagggcgagttcgaggacgaggctggggatggagagtggcctacaagccgttcagtcacctgagtgggaaaatgcagggaacgcgacgggtgaagctctgttattcactcaccatgccttgtcggtgtgtgccttgtcccactggtgtgcaccattgcttggtgttccctgtccacatctcatggctgtacgcgacaccaccagttaaagcattttcatcgtgaaaccccaaaaagaagagaagccgggtggagcccggtcccttgggatgtcttcccttgggtggggcgcacgagcttcccaccgctatcccccacgccttctcccgctttggtccctcccctgctggtctcgcctctcattggcccgagtgctcgcggcgcttaatctacggacgcctcaggtccttggagcccgccaggttgtgactacaccgcgtccgccgaggtggcggcaaaggccctgcgacgtgcgacgagtgcgcgcctgctcgcgtggtagcaatgcgagccccgtgtcctgttcgtggaggcggtggacctttcgatgggagcgccactacgcttacagcaagcttttacttgcgtgtactcgctgccgtttcacgcttgtgacaagtgttcagtggtgttccaagtatcctggcgtatcgcggcggattgcaaaggtgttgggttaccggcgtacggtctttggcctttttgtcggggctctctctgtca

SEQ ID NO: 590012 - DNA, 890 bp, Homo sapiens
gcgcaagcgaggcagccatgtcgttatccgcgctgatgattatgagtctgaggcggcttatgacccctacgcttatcccaggcgactatgatatgcacacaggagatccaaagcaggaccttgcttattgaacgtcagtatgaacgagccaaacctgatcaagtgatccctggaggtgatcgaaataatttctagtccaggtattatccaacgaaaacgtggtactcaggattgtgatgtgaccgagaaagtgtcatgagctcacaaggcctagtctgagtctcacagatgatgtcgattggacacatagaggtgctatgaggatccgaggagcatctatcgagcaacgagctgggaccaagcgtgacgtgacacagattccttcaaggaagtcagcaccttgggcccgagggctgaatgccagttgctcgcactaggttggggaatgcatagctgtctgtcctggaattttatacagaagcaattgagtgacctacagtgcacaggtatatgccgaaagtgccagtggggggaccttacctatggaggcagagtgttgggaatccgtgattacaactacatgcaatctcgttcagactacagttcttcaatgcccatggttccttgctcacccttgaattagccaagcaaggggctctggggatagtgatccgatcgagttcatctacgcagtttcagtcattcagtcagtaccggtgtaagactggcaagaagtccgaggaggagattgacttggcttcgtgccaagtccgcaaaatcgtggaatgtccatagtgtcctcaatgtcttcattccctggtagacaaattcaacgatcaacgacaggtggaggtatacaccagcggaggtgacctgagagtgtggctggg

SEQ ID NO: 590013 - DNA, 220 bp, Homo sapiens
tacatatacgaatcgagccggtaccccaggtagactaacgtgtagtgagttgtcgcaggtagacctaactagaagtgtgaaaacgtagcgctttggattataggcgacagcgtatttctaggattagtcagtagaattagaattgtgaagatgataagtgtagagggaaggttaatggttgatattgctagggtggcgcttccaattaggtgcatgagta

SEQ ID NO: 590014 - DNA, 195 bp, Homo sapiens
gtgcgtgcctagaggatcccattacagccatatctacatcaagcaacaagtcattattaccctcactgtcaacccaacataggcatgctcggtcaggaaaggttaaaaaaaagtaagaaggaactcggcaaatcttaccccgcctgtttaccagataacatcacctcgtagcatcaccatgtattagaggggtac

SEQ ID NO: 590015 - DNA, 215 bp, Homo sapiens
cttaaatcttttcggagacgagactggagaggcggagactgtggggcagatgggcggctgctccctacctctgggtggcggccgtggtagctgagtcctcagcgggtggtctgctggacctgctcgcggaggagatgaccttgccatcctggacctcttccgcaatggtacgcaccttacgggtggtcacccggtacttatcttgtacttgagtc

SEQ ID NO: 590016 - DNA, 343 bp, Homo sapiens
gtaaaaggtaattgtcctgctaatgctgtacaaaggctcttggggttcggctcagctcaacatggcttgacatggtgggcacactggcgcccagcaaaagagagagagagccaaagctgtccgttttgcagatggacaggaaggagccaggacccagctcagcttgctcacgcccagagagagaaaaagttaagctgctgaccctgaaggcaagggagagcaggctgcccagctgtgtgtggaagccacgggctcaagcagccaaggcagggcggacagtgtgaaagagctagtgtaagctgttgatgaaagctgttgctgaataaaaccatattcccctgca

SEQ ID NO: 590017 - DNA, 109 bp, Homo sapiens
tcggcacgaggtgtgttgtacattaacacacacacacacacacacacacacacacacacacaacaaatctacatatacaaacaagggtttgggttttagtttttttttt

SEQ ID NO: 590018 - DNA, 193 bp, Homo sapiens
gaatagtataaggtgacgtcgttgatacctgaggatatagcaaagataggggaagtaattactccagaccagaatggctagttgcacgtttctgaaaacatcaacgaagtttccaaaggccctcgtttcccaaagcagacttcacttcatgaatggagcagcattcttctttgccttcacacgcatggaatat

SEQ ID NO: 590019 - DNA, 375 bp, Homo sapiens
gaaattccaagtgttttggaagctctatgccaggaacctgggacaaagaccagccaaattcttttcaaaattttatttatttggctgggcatagtggctcacacttgtaatcccagcactctgggaggccaagtcgggcggatcacttgaggctgggagttcgggaccagctttgctaacatggtgaatccccatctctgctaaaaatgcaaaaattagccaggcctggtggcgcacgcctgtagtctcagctattcgggaggctgaggcatgagaatcacttgaatccaggaggcagagtttgcagctggtgagctgagatcataccactgcactccagcctgggtgacacagcaagactgtttctcaaaacaa

SEQ ID NO: 590020 - DNA, 316 bp, Homo sapiens
  misc_feature (20)..(21): n is a, c, g, or t
  misc_feature (24)..(24): n is a, c, g, or t
  misc_feature (27)..(27): n is a, c, g, or t
  misc_feature (29)..(29): n is a, c, g, or t
  misc_feature (33)..(34): n is a, c, g, or t
  misc_feature (36)..(37): n is a, c, g, or t
  misc_feature (256)..(256): n is a, c, g, or t
acaaaagcgggatctaggcnngcnctncnatcnngnnccaagccgccttggggctgagctttgttccccgagctcagtttccctttgcagagtgcagctcctaggagcgcgttttgtgccgtttcgcagctaggccctaggtgggtccctccctagctggctatgggtgggttgccagggccagtgcacacagggcttcttcctgccaaatcagccttctccgcgaaggagaacacgtttggagttggtttcaagntgcggagaccaccagccaagcagcagtgcccacggagccagaggcattgttcggggcctg

SEQ ID NO: 590021 - DNA, 1442 bp, Homo sapiens
  misc_feature (360)..(360): n is a, c, g, or t
  misc_feature (365)..(365): n is a, c, g, or t
  misc_feature (374)..(374): n is a, c, g, or t
  misc_feature (376)..(376): n is a, c, g, or t
tggaaacagagtctcgctcggtcgcccaggcgggagggcaggggcacgatctcagctcacggcgaaggctccaactcccgggtgttcacgcgcctattctcctggcctcagccttccaatgtaagtctggggactacaggtgtggcccgccacccgtggcccgggctaaattttttgtggtagtatttttaatgtaaagaacggggtgttccaccatgtgtgtacgccggggatagggtcttgagattctcctctggacctctccatggtatccaccacactctacaggctctccacaaaggtggtggggagtattaacagggcgggagacgccatatgggcgccggggacaaaagaccnctttnttttttttnanaaaaaaaaaaaaacaacacaaacaacaatataaccggggaggggtcggccttctctcctcacaaatatattcgctctctctcgagggttcacccaagaaaattttatatacgcgtggtctctccaagatattttctgtggtcggagataggggggggcccccgcaaaaagagggggagctctcgctaaagtggagagagagctccgcgcacaccccgtaggcgcgcgctcacaaaaccgaggcagcctgcggaaaacatcgcggggacaccacaagcgagacccacactttgaggcacacaatcctgggcgaggacacagcgcacaccactctaacctgtcgggaggcgaggctgcgcggggcccaatataagcagcgggcgacacaaacgcgggagcccacagggaaacacacatgtccagaggcgccacacaatcgcagggacaacacgatgatacacacccaccccacaggggggttgaaaaaaaacccggcgtcaaaagcacccacccgcccagggacaacccacccccaaatagtacgacaaagcggacaaaacacatcgtgtcaccccggggggggctacatagatgcgaaaacacgggcggacatacgtgagccccccccccggtgatgaaaaggaccagcaaataacaccaggcggggagaaacaccagggagcaaaaggtcccacagcccccccagaaggaggacaacacagtacagcaaagcccaccaaaacattagggggcgcaccataacccacggggcccctatccgggaggccatcacacaaaggagctatacacaccgcccacacacatttgtagtaaccaagcgagggggagccaacactcccacagagcgagtgagacaaaaaactcgggcggccccatcgacaccagaagaacacacaaaatcgagaggacaggacacaccaacaatgagtctgagaccccccaagaggaaaaagcaaacaggcacaaatatcatagcagcaccagcaaggaaacaaagtggagcaccccacaaaaggcgtaagcacaggagacaaacgcatcgtcgt

SEQ ID NO: 590022 - DNA, 920 bp, Homo sapiens
  misc_feature (24)..(24): n is a, c, g, or t
gacaaccacatctggggcccctcngaaccagtattgtcggctcccctttcaaatatctctgcagtctaaacaaccgggtggttctttatcagacagctctctgtgttccccccgccaacgcgccgagttttcccttgtcgaaaccacccacttttcctggtataaaaccacaatgtccccccaaacttccaaaacaggtcgatgcggttagatgaccccgcacacaattcttctctaaaatggtctctacgcaccttagccacacaaggtgtcccccataaccacccacgcggttgaccctccaacattgcggctccagcaggcaaaacattaaataatcccccctttaacacctgggcgaaagccccaagagcttaacccgaccgtgttttatggcgcccacccccctacttataaacaaccttgccgtaacaccccgctgtctcttaatactgctaaagaacacaaatctgtccaccaacgcgctactctctgagagaaatatatatgacctcgactatttattttaataactataatcgcgattagaactctgtaaattgctatatcgcccccaagaaaattgtcttaatatcgtcgcccaataacacactcgctaagctctcccacaaataatattttgcgcccctccaaaataaataattcccacaacattccattgttccggcactcaatctctgggacagtgagaccattaataatgccactcctcaagaaaattttatcattctcctaatatgagcctaaatcagtaagtgaaacaggatgttgagggtctcaacattcttatttctctacgcccagacatgcgttccactttttcattcctctcaaatcaatcatgttttaaaaaattttccccaaaccccaaagggaacccttttcaccgaacaataaca

SEQ ID NO: 590023 - DNA, 418 bp, Homo sapiens
atagagttgacggacttcaggttatagacctcactgaatgttggagaatctaatgggaacctacgtacagccttctgctatggcataaataggattccgtctatttaatccacgaaattactttgcctcctgatctacatgcttgcctctagtctagggcttagaacaaggcctggttatttgaactggttgtcaatcaaggtccccttcattttcgctttcttggcttccaattcagccagctcttgcagtcgcctcttgctcatgcctttgcgctccagctgtttttcaatcactttggcattctgtgcatatgagtcagcaacttccctagcctcaatctcctcttcctcttcatcaatggtagacacggtgacagaactgaacttgcccatgtctttggtccgtttactctttg

SEQ ID NO: 590024 - DNA, 414 bp, Homo sapiens
taccgcggcccatagcgctcacagccgtaaagacttaagtcgttgaccgaaagcggctttttcacttacctgggcgacagagcaagactccatctcaacaaaaaaaaaaaaaaaaaacctagaagagatggataaattcctggaaagatacaaccctactagcttaaatcaggaagaactagatactctgaacagtccaataacaagcaacaagattgaaatgctaatttaaatattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataacc

SEQ ID NO: 590025 - DNA, 942 bp, Homo sapiens
ttatgggatcgctggctgcctgagtggcggcagtgctcattgcgcctgtgcgtctgcggttgctcgctgctctgggcgctggcgtgctgtgtgctctacccggctcctggtggcgtgatggtgcgacggcgtgtgtggcgccctgggcggtgcctgtgtgtggccgtggcggagtgagtgagctgctgcactgtgtgtgatgcgtctggtgcctgacctcacctactgcggagttcgtgcatgcagtactgccttcgtcatgtgccctgtcatcctgcatgggactcacggacaactcgaggttccgggccctgtgctcccgctgacaggttgctggcttcgttttggggacagagtggtcctggctgagcacctgccaacacctactcctaccacaaagtggacttgcccttccaggagtatgtggagcagctgctgcacccccaggagcccactccctgggcaatgacaccctgtacttcttcggggacaacaagcttcaccgagtggtgcctctctctttcggcactactccccagccccatttggcctgctgggaaccgctccagcttacagctttggaatcgcaggagctggctcgggggtgcccttccactggcattggagccggggtactcagaagtgatctacgggtcgtaaggtgctgtaacttcccccgaccggttggttggcattgctacggctcaagctttgacaccagcgtcttcatctccagcttcctcggcgtagccaaaacagctggcaggactgccggtcacacgaccagaaacgttcgcactcgtgctcacgggttttattacacgagatagtggcggccatggcctcaggccagccacgctcagctggttttccagcccacacagggggacagatcagggccaggcaaacagcgatgttggaggggaaacaggtcagaagtcg

SEQ ID NO: 590026 - DNA, 825 bp, Homo sapiens
cttaagaaagtgagaggaaattagcaagcattattagtgtttgactactgctatcaagtgaattcaaaggaaacaggtttttatgccatatttaagttacagaaaccaggcatgcttagaatagtttctaaggtgacagagtgagactccatctcaaaaaaaaaaaaaaaaaaaaaaaatagtttctagaaggtttattgggagaattagaaagctaaaaaaacctgtggttattacattttacaatggtgaaattattaatttacactttttatactctcagaaattatttatccagatttagacttcccgtgttatatcttttatataatctctggccattgtgatattaatgccgttgatcctttcaaagtttctttctcacattatttattattgatctctctttttatgaaaaaaatgtagatggctttaattcctggattattatttccagtttccccatctttagggcaaaacatgtggggtattattagatctggatgcgatttccaaaggtagatgaggaaaatccagggcacagagatggtcaacgggttgggtacagacccaatttcaccacaagatattggactttcaccagcgttataagttggatcatcaagggcggggcgggattggtctggctgtagtgtgtcaggaaattttataccctatttacttttccatttttctcaatattaggtcccttgatttgtactgtttagctgcaactttttcccctaattaaattggctgtcctggacccactgcttctgggtggcgaagttttgaccctctccagggtccgttatacagtgtgac

SEQ ID NO: 590027 - DNA, 407 bp, Homo sapiens
attcgtcaaggtgtttccattctagtcttcatttagctttacatattattagtccagcacagggtacacccagactggcagtttcttgtggacggactggcatatcatcacagtccttggaatttaggatgcttcatgtaggatgttcacgatttcattgtccctaaagtgtgtattacacactcctttactgatactgtcaaggatgaaccaactgtgcaggtaggactatttcaacagactaggttctcttccgatctgattactttctcctctgaggagagccgcttataaaatgctttcctcatagtcattgctttatcctctttggtcatcacaggttccatggaaggttcttctatggaaggtcactttgagcaatgggaaaagaatcctcagatgagcta

SEQ ID NO: 590028 - DNA, 113 bp, Homo sapiens
gggctccatacttgttcaacgctttatacttcctcaacgctttatacttcccggctttatacttcctcaacgcttctcatttcatttcccggtatgaagtataaagcgttgag

SEQ ID NO: 590029 - DNA, 162 bp, Homo sapiens
  misc_feature (63)..(64): n is a, c, g, or t
acccactccaccttactaccagacaaccgaagccaaaccatttacccaaataaaggtataggnnatagatattgaaacctggcgcaatagatatagtaccgcaaggatagatgacccattatagccagcataatatagcaagggataaccctataccttctg

SEQ ID NO: 590030 - DNA, 877 bp, Homo sapiens
ggggaaatgcttcttttggttggtgatagctatttaatcatttccttcatattttctcttataaaaatgtatttgatactgtgatatgtccacgaaaagtatcttaattatcctttgtatagtagagctgtccattatggatatttctgctgccagtcacaatctaaattaatttgtggcaaaagatggggtacttaagtttcctgttactgagtaagctctaatctttgtgaccaaagcaaaatgagagcaagtacttttcacactgtgtaaggatggagttatacatgtcatacattgtggaatattatgatcccaagtagtcttttaataatggggatggtatcgtatgtaagattttgataaaattgtgccaatttttacaggaagaaatactctgatcataaagtctatctattagaaatatgtaaaacgtggacttttttaaggtaatatgtgcccaaagttactttgtgtcccaaaggtctaaataaaggagcagtttccgaaaaaaaacaagagaagaaaaaaaaatatttggggggctgctaagaaggttttaaaaacaatttgtggggggggcgccaatatttaaggacactaggccaaaacggcgttcaaagagaaccctggcaagtacaaatgggtgtgggttcccccaataaaaaaccgcggggaacccagtgtcttgtaacaaaccccaatgagctctgaagcaaaaggggcaaacaccgaggccaggaacgataatcgcccggtggttaaacaacagcagacagaagaccacgcacaccacgacagacacaagagacgacgaacacaaaacacacagaaacagcaaatagagaaacacaccaaagacgcaacacaacacacg

SEQ ID NO: 590031 - DNA, 427 bp, Homo sapiens
atatataaataaatagaaagaccccggtttaacgaagagttgataggtgagcaaatagtgaaagtgaatgtctcaccagttctacaaggttggcggagataggaaggcaagaagagtagtagtgatggtgactcagagtgagctaatcaaatgcttaattgtattaaaatgggtgtgactctagtgtgtaggttggacaggtcaggaatcagctgtcatcttagtctagactccactgatacccattaggtcctacactatttctcttgtatacttcgcgaagtcatttgtcccatttttcatataattctcagagggtaccctcataaagacagtaacactgtgactgtagtgcaggtgaggaaatagaggcttaggcggtacgccctggggtcctagcatctagtaagactctagctgagtctag

SEQ ID NO: 590032 - DNA, 481 bp, Homo sapiens
tatacaattaattgggtacagggcattctccttgggggtcccacagggcacgggggaaggaaagatacacttccaggccaggcagaaccaaggaagcctgccaatacccaagctgtccaaactcctaacaaatacgggaacaaaaactacatcccggggtgtgaggacgtggatgacatgctaggaaagagaaagcagaaccttaaagtacaagcccagaaaccggtgcggacaccctataactcatatctcatttccaaaacctaagagctcagagaagacaacaaagcgtgtcaaagttcacaaagtgaatcacaactaaaactcggattccccaaactccaagtagatttcaggttcggtccaggaattttaagtaagtctccggagcttttcaacattagtagggcgggtcctataaaaatatggctgatacaaccattctccaccatcatggcagcaggggcaaacggtgctgggg

SEQ ID NO: 590033 - DNA, 239 bp, Homo sapiens
gctcaccaaagtgctgtgaataacaagagagtgagccactatgccaagacacaatatatagctttatcgcccttcactctctgactattatgagaggacagatcactcagaagtgatagttgctatggaggactcgaaataatacatttctgactggaaaacacatttcatggctagacagtgggcacacggcatggggcattctgggcatgctagatacatgtccacttccgcatctg

SEQ ID NO: 590034 - DNA, 186 bp, Homo sapiens
gccgctcgggtagtgtgtggtgtgtgtgtgtggtgtgtatgtagtgtgtgtgtagtgtaaggctggtcgtattatgtgaggatgtgtgtcatattcataagtgatattggtctgtagttttcttgtgatatatgtctggtttaggtatctgggtgatgccacataaccgagcgtggcaatggggat

SEQ ID NO: 590035 - DNA, 147 bp, Homo sapiens
ataccaacggagaaatacgtcttcataggatacgcaaaagtaactgttgggtacaccttctatcacagatccgaaggcaagaataatttttggcgccgttgtccgggaggcttacgcaaaagtcatataccaagtacctatcacaaa

SEQ ID NO: 590036 - DNA, 401 bp, Homo sapiens
ttatgtgcaacacacactagctaacagcaaatactgaaaagtttactgctacctctgacattctacaagatatgcctggtatcctatcccgacgtgctgataaggaccgaggctgaggctctggtgtggtcaccttacacgcttgtccctgtatctggactggggatggtttgagttcaaactgtgtacatttccattcttaaaattctttataaattaccgaattagcagtttaatgatgtgaccgcgcacattacctgtttcgagtactatgttcatgattccactaaaaggcagagggggagaaagtgacatcttgcacagttctatatatcaggatctatacagggaaggttcaggccacatctcagactctgagcctggcctcctccatagcattt

SEQ ID NO: 590037 - DNA, 897 bp, Homo sapiens
  misc_feature (896)..(896): n is a, c, g, or t
gttaaacataccaataaaggagctcctgctgcagtcacaataagaggtaccaacagatgatactaaagagatgtaatctcagagaaaaaatatccaactgacatggacagagcggaaaaacataaagaagtacttggacccacgaaaaagaagaggctaaagaacatgtcctgggatgaactctcagatcctggtcgtgaatcacagacacctcaggagttagacattcctaatgattagaggtccgatggaaaatatcacaagcgagttccaacactagcaagagaactgcaagcacggttgtcagtatatgagatcacttttgcgcgaatagcttaatgagacagttacagaagttgcatagaagatccttatatgagacagtactcatcagttgtataactctcgttcgatctgtgacgatgcgtgataaagagcaccatgtccagtataaagtattcactcttcgcacctctctgggtgattggccatcgagcacgtgctcgcacaagtagaggcctgcaagcaaatcgaagacgccactcgatgagtcaccgagtgcccgcggaagtccaacactcctcttcaaatagcatgaccggaaattgaggttccacgaatggtggatgatcgacggagggacttgatatgttagaacacagaagcgttctcctggtcatggattgggattcagacggtctgcccacgggcattttcctagagctacgaaaaagagggcggcaatgggtagcaacctcgaatgggttgaaaaccgacagtgccccgaaagtttttccgagaaaaaaaaaggggggccagaaaaaagggagggaaaaaagggagacaggctaacacgagcaatagttcagcaccaaaaagacccacacgcgccccang

SEQ ID NO: 590038 - DNA, 101 bp, Homo sapiens
  misc_feature (5)..(5): n is a, c, g, or t
cagcnatgggtgaatatcctcgcgcaggtcgtccaggttgcccttggcccagcccatcagcggcgcttccagctgcggcttgagttcgccaaccagcgaca

SEQ ID NO: 590039 - DNA, 633 bp, Homo sapiens
gagcggggtgagtctgacgggttcaaaatggcggcggctgcttcagcggctcctcctgtgtgagggaaacaacacccctccccggcagcggcggccggcggcggcggctctcggagcaccattcccagcggcatgggcaccgtggaccggatcatgatctaaccatggagcacgggggacgctccaggagaaggagggagcaaacgcacagaggaggcacacaatcccaccggaaactcccgtcatacatagcgacttggaggaagtagcacgagaggaggatccgatcacaagcagaagacaggaaaacaagaacacagaaggcggcagaacgacaaaagaagagaccaaggggaacacacaaaaaacttgaagcagacaaaagaacagagaccaagacacgagaatacagtgaaacaaccggaaagcacacagaaaagacacaaagagaaaacaagagagaagagacagagagaagacgacaaaaaaaagagaacaacaacaagacacaaaaacagtgaataaacaacaggaaaaacagtgaggacaagaaaccaacaacaaaaacgaataacagaaaccaaagaaaaagaacaaagaaagaaacaagagaaaagaagagaaaaaaaaaag

SEQ ID NO: 590040 - DNA, 1828 bp, Homo sapiens
  misc_feature (1364)..(1364): n is a, c, g, or t
  misc_feature (1527)..(1527): n is a, c, g, or t
ggatccctccgctctggggaggcagcgctggcggcgtgggcttggggccactgaggaaatccatccgcgccgccgccgccgacgccgcgaccgccgccgcctccgccgcggaggaagacagcgccgacccgaggcaccgacaagcgaacccccgccgcagagtcccaccgccacaggcctcgggcccagcggcgagagagctgcctcccaagagagcggcacggggatcacacaagcgagcacgaaatacgacaaaacaaggcaaacgaagcaccacacggcaacgcaaacacgaacaccaggcaccgaaggccacaacacgaaaagaaaaacaagacacacacacaggcaaagacaaaactagcaagacaccacccagacgaacaccacaaacaataaacgacaaaaaccagaaagcagaaacacaagagcaaccaaaacagaggacaaacaaagaaacacagaacaaagaacacaagaaagacagaccgaggacaaggaaagaccacagaagaaagacagaaagaaacagaagagcgaaataacacacataaacagcaaaaaccaataacaaccacgaagacagacgaggagagaaggcgacacggaagccgcgagactaacagcaccacacagaagcaaagaacagaagcaacagacaaaggagagagaagagaacacgaacaccagagcaagaccacaactgcgagagcgccacacaggcaggaaggccgaaccaacgcgaccacagcggaccgctcaacaaaacagacgacagccacaggtaccgcacaagaggcgacgcgcgccgagacggcagatagaacgacgcaccacgggacgcactggaaggaacgacgagcgacgcgcccaagcggcggccagcaagaccgagcaagcgaccgaagcgacggacacagaggacccacagagcaagcgcagaaataaccaagagcaagcagccggatgagcccgacgagaaagcgacacgcacagagcggtcataagaacgaggccggagacagcgccctcagcgcacgccagagcgcaacgaagtgacgcgacagacgagccgtaggcaaggtgccacacggcgagagcgcaccgcgcgcgccaggacagcacgagaccgtcgaggcgcagccaagagcagcacagcacgctaggctcggcaccgagaccgtgcagaaggcggcgaacgcagcagacgcacgcaggagaagagcaggacggcaggcgcgcagcagctagaggacagacgacagtcgctcaacagctgccacgacgtcacgcacgacaggactcaccgcgcacacagctctctgcacgcgcagcccacggctgccagcaccgagcacactgcnagtccgcacagtcagcagacggagagtgagaagcagcacataccagagcgtgcgtaggcatcacagcagagcagctaggcagccagtagcagcgcagctcggaccggatagtcacaggatcgaagactagcaagcagagacgagcatgcgcaagagcctgcanatgcgacgatatcgtgactagctaggcgaaccagcgagtcacgacgcacccacggaacgatagagtctagcgtaccgcgagagagcaagccgacacatgacgacagcacacagacgtagaacgaagcagatgcaagagaagcagaggaagcgcatcgagacagaacgtagacaccagaggcagctgacgacgcatacgagcaacggacgacggagtagcgagcggacgcaagatgcacacgccgcagacgagccgcacacgcgcacgccaccagtccgcagagagcgatcgagcacacgca

SEQ ID NO: 590041 - DNA, 501 bp, Homo sapiens
ttttgccatggaaatcctttaaaaagtgtgactttgaacgatggcaaccccttcaattctgggcaagaaaaaatagtttatgtgttccccggggtggcactggaattcattcccggggggatccggcccatcccaaatgagattttcctcctgacagcagagcaaattgcccaggaagtttttgagcagcatttgtcccaggggagattttaccccccactcagcaccatccgaaaagtgttttttagaattgccaacaaagtttttgggcaggggggaaaaacacaaactgggttctctctaccccaagccctaagaacaaggaggcttttgtaaaatccctggtttacactccagactatgattcctttacactggacaggtacacttggcccaaggaaaccataaatgttcaaacggttttaggcagtttcaaagggtagtatgggggtaaattaagcccaaagtaacccccccaaaaaaaatgggttccaaaatggc

SEQ ID NO: 590042 - DNA, 264 bp, Homo sapiens
cggtgtgtcgtgtccccgggacgtcaccgccccccgtgctgtgtccgtgtccgtgctccgggggtagggggcgcagaatggcgcttccccttctcctgtggctccggggtgtgcatgcgagaatcctctttccacgatgccgatgggcgacgtggcgtgggggcagggggacgatgggggagccctcgccccagactgtcggtcggcctctccgccccaggcgtcagtcagtgatcacgggtaaagagaattgtttcaaaatga

SEQ ID NO: 590043 - DNA, 160 bp, Homo sapiens
atccattttacacggttggcaagaaaaggcttggatattgcgctgggcaaaccagtttttgtagtagaaattgatcctgcaagaaaccgtgttgtactgggcgaacagcaacatttgcaaaggcgcggcatgctggtaaaaaacatcaacctgcaaaaat

SEQ ID NO: 590044 - DNA, 369 bp, Homo sapiens
ctcctgggctctagccattcctcacgcctacagcactccagagtagctgggaagctacaggcacatgccacgtacacccagctaatcagaacatgagtccacagagctaaaatgaaggtgttggcagggctatgttccttctggaagctctagggaagaatccatttccttgtcttttccagcttctagagggtgtcctctttccttggacttgtggccacctactccaacttcaaagccagcagggtagcatcttcccatctccctgctactctctgacctcatgcctgcctcttataaagacccttgtgattccattgggtccactgggataatccaggataatctcagtgggcacacattatggag

SEQ ID NO: 590045 - DNA, 107 bp, Homo sapiens
  misc_feature (77)..(77): n is a, c, g, or t
aaatgcaatgatcagtaccaaaatggctccaaactctgcaaccacccagatacctgctgcgtgagcgaaggtttctngggtggcatcgataaacaccgggtaccgag

SEQ ID NO: 590046 - DNA, 250 bp, Homo sapiens
tctttaattgaaaggctgtgaatcctggaatccactcctaatcattttcacagtagatattctttggcatttttttaataagatcgtcctggggtgtactcagcctgtggtgtggtattcaccagcaccctttttctcacacttaggtctccataagagataaagataaatacattttattttcttcagctaaagtatattcccattagaggtatagagttcttttctagaggtctctggggaatacgga

SEQ ID NO: 590047 - DNA, 158 bp, Homo sapiens
ttgtcctttccaagtatgagtgttgtcctcgctttccaagtatgagtgttgtccccagttgccaagtatgagtgttgtcctcagttgccaagtatgagtgttgtccttgatttccaagtatgagtgttgtcctcgctttcgaagtataaagcgttgag

SEQ ID NO: 590048 - DNA, 100 bp, Homo sapiens
agcgatatatggaggtcagcactggtgctcacgtgtctgacggaactagtacatggtaggcatgcacctgcagtggtgaatacacgtcgaccaggctcca

SEQ ID NO: 590049 - DNA, 226 bp, Homo sapiens
agacaaaaagaataaagataagaagaaaaagaaaggagaaaaggaagaacaagagaaagagaagaaaaaaggacctagcaaagtcactgttaaagctatgctagaagctctggctaagcttaaagaggaagaataaagacagaagatagaagaggaagaacgtataaaacggctagaagaattagaagccaagcgtaaagaagaggagcgattggaacaagaaaaa

SEQ ID NO: 590050 - DNA, 1940 bp, Homo sapiens
gatgcaggaaaaagtgaattgcttggtattcattacttcatgtatatcaagcgacagccagctaaaaccaaaaacccatgtatttaacctttttgtttaggcagttttgtgcttttgctgattttatttttatttatttctggatcactgtgcctaaacaagtgcagtggtgcgtggtaacacacatcagctctacaccagcgggaacacacaacacttggccagacagtgacagtggcctaagacttatgtggtctacaaagtggtcttatcagtgaaacacattttttcaagtgaacacaccatactctcaagagcctatcaaagtgtgtgtctcacagacacacccaccgtgtgtctctaattcaaactatctcacagtgtgtaacaagtgtgggcaccactcacaaacagggtttgctacacgtgcaagatgtgggcactaattatatcaaaaacattcagcatattatcactctctcacagaggctgtttttctccccagtggtctcaccacaacttatcaagactcccatggagcggagtctcgagtagcaacacactttctccctctgcttcaagacgagtgacaacacaagtggtgtcgtcagacaaaattgtattactcgatgtgggcagcaacacgatctcactgaaagttctgccgctgctgatcaatgatttgtccgcccacactactgctgtggggagcacaaagcgcgtcttaacgatgttgtggcagacccattcttatattaagcggcgaagaagggtgctctccgaaacacagccgtaccacaacaagatgtatgttcatagcttcgaatgataagcagccacaaagcagacacaatgattacgccgatcagctcgattaaagagtagtttatattaagacagcgttaacgccggcggaggtatacacacaccaatagttgtgttctcccccaaaggtggtaatatccacgacagcaagttccagttgcatattacacctacttcccccgacgaaaccctcctgttggtaggtacgaccaacacatcacacacgtggcagaggtatcgtccccgataatattttgtatacatcatcctagttggggccagaaaacaaccggcggcgagggaggcgagacagctagcggagctcttcaagcagcgcaccaatacagacacacctgtttggcgtcacagcagtggagttgatttaccagcaaagtatttttaatacaaccacactattcttcgcggggaggcgacaagtataatacgggcgcaacattatctagcaccgtaatcacacccttataagtcagagaaaaaagtcgaccctaacatcaacaacatgatgtatccttattggtagtagcgcccccaacattagacatttttggacaccacaatctagggaggatagaaccgccaccgatatccaacaccgcttggatgtaaccagcaacaccatatgtaggtacggagagcacattcacctcgcaacaacactacttcagacaggattctctacggggaggctcgtctttagtatcaagcacagatccactttactgttcgtggaacgaagctcgtcatatatataatgcatccattggccatcctaacctaaagatcaggaagagaccgcagtaagaaaacctaccaatataacataaaactacgaggacacgacggtgagcgacaaacaacaaaccttacacgcgtcgctcccgggggatcgataaaacaccccaccctaggagcagattgggacacccaacagacccaaactacctacacaacgagtggggcgcgcacacagagtcaccagtggcacaaacaacagcgcgacacaccaacagcactactcggccgcacacactcacatggcagcagatacagagccaactagagtacgatatagctaggaagcactcacacacaaa

SEQ ID NO: 590051 - DNA, 1500 bp, Homo sapiens
gggccgcttccggcgctcggcgttgtctctgtgcgggtcgcaggggaagacgagatcgcgcgacgctggtcatggacaatggctccggcatgtgctgacgcgtggatttcgcgtggcggacgacgactcgcctcgagccgtgggtttcgcttgcatcgttcggagcgccccaggacgacgcagggcggtcgtggtgggcagtgggccagcagaggactccgtaacggtggggacggaccggatggacccaagtacgactaatgcggtgagagactctcatggaccccctgcacccgttactccacgagttggcatgcagtgcgacacgtcgctgcatcacagaactccgtgcgatctgagcattggcaggacaatgactcttgggccgatccaagcagccccttgctagcggagcgatggcgtgctgccatgggcgccctggaacggtacgagcacccatgttgtctggcgtgacactctgagggtccgccccgcgtgtagagctcgccatatggtccaaacgaggagggactaaacgacttgagcatcaggaattactgctttgtgaggacccgtttcaatccacctccctgggccatgggtaaccgttgtgcctatccatgggccgtagcgatgtacccatacataacagcactcatagggggcagccaaccaacattgcgccactttgtcgaatgggaacctcctgcgaagcacggggggtcaaccccaacagcagggtgcccatcttactcgaagggggctagtcgcgtccttcgccccacaaacgcgcaattcctttgtcggtcctggggaccttgggactgggtccgggaaccttgactcccgacgtacgcttcattgacagcattccttccacctggaagacgacggggttaccaggctttcacccacacaacggggccgagccggggacaatccgtcgcggcggaaccatccaccgggcaagaaagcctgggagacttacgtacaggagcctgggaactgtgcggacgtcacgggaagcattgggccacgaccgtccgggacatcccttcactaccttacgtccctggcagaaagaagctcaacgcaagcctggcccgaaagggccacaggtcacgccacccaatgggcgcacgagcggcggatccagggaggcacgcgacgggcgccgggacccaacgccgctatcacccccccgggcggccgtgggaacgctgtggcggcgaaccccagaacgagacacagtttcgagcacttcaacgcctgcgaggtggtgcgcggggacaccccggaagagaaccgtgtacgccacacaagggagcttaccgcggcgcaccacagcgcttacgagatggccgaaagcaacgaacggactcacaccctggacctcacccgcgagaatactacgcggcccacacgaaaatccatgagtgaacggaccacagcgcacgacccacgacgactgaacagagacagacgcccactcgtatcaac

SEQ ID NO: 590052 - DNA, 134 bp, Homo sapiens
ccgagattgcgccactgcactccagcctgggcgacagaacaagactctgtcttaaataaataaataaataaataaataagatgaaaggacttaccaagtttagcccatattcaaggggaagccgggccggggga

SEQ ID NO: 590053 - DNA, 819 bp, Homo sapiens
gcggccgcgttcctccgtcgttctctcgtagtccacggtttggtcttccagtacccgccttcgtctccgagttgcgactcgcgaccgggtccccgggcgaagaggtgcactcggatctgtgctgagaaatggtgcatccggaagaaatggtgatggtggtgatggagccgtgtggaaagaatgcttgtcatagtcttcagcaaggaccagtcccagaggtgtatgttgccacagtgtttgaaaactatgtggcagatatcgaggtggatggaaagcaggagcggtgaaccctggaaagaaaggcagagatatggcaagcagggatggggctttggggtacatggagtgtcagcaaagaccaaagatggagtgagagaggtttggaaatggctacgagagctgtctgcagagctagacgtgggaaaaaaaatctgcgtgcttgtctgtgaaacttgttgagcacagccttatgcggtaatttgaagtgctgtataatctcagggtatgtactgactttatttatttataatttacccagatacaattaggagtatttgtaccagtttagaaggcactatgatttacgatgtcaaccgttgccaacagggcctttgaatgttaaaggcctctttggattccactggcaccagggaatcagggagttaattgtgttttagaaagaacagtgaatttggagtggggagataaaaagtcgggatattgagagggcggggactacggtaccacaatagtgtcgtggcggagatgcacaacaactcgagcgtggtattggtgtaaataatagtgatatagagtgta

SEQ ID NO: 590054 - DNA, 202 bp, Homo sapiens
acggccgtggtggccctggctgcggcgggtggcgcatggcctgggcggcggcggtggcgcggactggctcccggcgccgcggcgcacgagggcgcggtgcttgttcttggttgtgattctttggctatcctcttcctttgacctgccggtgtgcgcgtttgggcttggccgtggtcttccctttacacaccggatatgccca

SEQ ID NO: 590055 - DNA, 443 bp, Homo sapiens
  misc_feature (4)..(4): n is a, c, g, or t
accngcgcctggtttctctcagataagggggaactgtggactgaacttttaccacagtgcttgtttctaaatttcttcccaaggggtctggaggaggtcatgtccatgagcgagcactaatgttcttttctgctgacctcagatttttacacaaagctttgcgtcctggagcaatcgcaaatcagaaaatctttgactccaccttagacctttgggccctgcttcaagatgtcctactttttggctgggcgtggtggctcatgtctgtaatcccagcactttgggaggccaaggcaggtggatcacctgaggtcaggagttcgagaccagcctggccaacatggtgaaaccctgtctactaaaaatacaaaaaattagccaggtgtggtggcacatgcctatagtcccagctactcaggaaagtgaggcaggagaattgcttg

SEQ ID NO: 590056 - DNA, 861 bp, Homo sapiens
ggcctcccgactgtaaacataggggatatgtgttcaccttagcatggacttctgggaggggccaaaggaagggcggtctggacgtttgatggaatagagcagtgtgtattacggcatgcctgtccttgcccagccatgcttgcttctcatggctgtgctccgtgcttaaagaaatcagtccttccttgccgacttagtcctcgaggaagaaggtatcagactacaaggtatcatgtggaacatttcaagatcatcgatatctaaattccagcagggatggggtgaccgaaccagaatggctcgagacatctgattgtctgacctgtccagacgtcatctgggctccctgaaccttgaaatcacaccatggagtgagtggcgagcgtcgcagaagaacttggaaggcaacaagagggaggagaatgcgactcgaagcagaaggaagcgcctaccagaggaaggacgatgacgaagaggaggcagccgggcaacgggcgctgccagaagccccgagaggatcgggtgcgccgcgaagcatggcggaagaatcctggggacaggtgaccgcacatgtggacgtgaatgcccggaacatgtgcggaggaggaggccagaccatcacgagaacactcagtggagggagaactgggcccacttcctgaggagcggaccgagtgaggaaggacgcaagcctagaagccggatgcgaagcgttcgccacaaaaataggcggtgccacgcgaagagtcgggcaaaacacgaggggcggcggacaaaaaagggcgccagcaacagggggacgagcgcagaacacgcacgccacgcaagcagcatcatagaacaccaccaaaagccgcagag

SEQ ID NO: 590057 - DNA, 1271 bp, Homo sapiens
gagttactgacaactcataaggactgaagcgtaagtatcacctctatcgagaatccagcaggtctacatcggctcgcttgaacacaatcctgtcaaagaaagcccaggagaaaggacgcgccatggtattacatacagaacatatgcagcgtatctttgctcggtcacgattgtccggatgttgctgcgaatgtatctctcattcccgctacctgagtgtgcaggattgcccagaattgctacgctacatggtaaacaagcccattctttctcccatgccggagtgactcccaatacttacagtggcatgggctgttgcttctctagaagcatatccgactccagtaatggtccaatcgaaagacgtgatcgtttggtgccgtgaaagcgcacacgtcggtctcgaagagtccgaacttagcgttgtcgttacgctcatatactcgtattattatcctattgggtcgcgaagctcatattggtggaggtcttccaacagtgggcattgtacacctatcaccgagtcgcttgcgcacgattgcagtggataccactgcttcgtttactttttcgcacttagagtgcgttacacaccttcgtattctatcggcaaagtgtagcgtaaggtcttttagaactttgaaccttcgcatcgaatttccgcctggcgcacaactgggcacacaaacattcaaaggtatagtatataccgggacgatttagcttggcgtacaagtagaaagactgaacataaaccggtctttcgcttctctgtccctctcatcccgagttaccgcaatcatctgtggaacttccggctctgcaattgggcattgagtaaccttggcgcatggccctttgtgaacttaggtccttttccccttcgctttgagtccccttaaccgcgtttccccacaatccaggccagggtctttaacgttttcctttgtcgatccccgcggccactcgctcttttccctggccatttcttacgacctttggtgtgcccatgccttgagccaacaagtaagaagggccctttcttattaaacttccaatccaaatgccctgcaaagaattggcttgcgccaacaacacggcgcgccgggaccccaggaaattctatcatctcgggccttcacttcttagcagcgccgacctctgagaacgcaccacgcgcgtcgtcgtaacccccctcgcgcttctgaatgatgacagccctcagagcgcccgcccaatagaggggactacatctatcaagcacgcctagc

SEQ ID NO: 590058 - DNA, 204 bp, Homo sapiens
tggggtgctctagcacgatctttctcgaatactcaggatttcttaggtagcgttctgtgcagtgtgcaactcacaatccttcaatgagctacaaagcttgtcaggtcttgccctcctggtgctcaactcctcctgccccgtgcttctcgttccataggctccaggtacatctaccttcttccaggtctctgaactctgccatgg

SEQ ID NO: 590059 - DNA, 632 bp, Homo sapiens
ttttaaaatattctggtattgattgtaccaatccatacactgacctttttctcttaatttttttcttacagtcaccccaagcaggcacaaaagaaaagacactctgttgctggttctgtacctcaggcccaatatccttaagtgccaaaattgaaaggaagggctataccccaggtatgtaagaggtagattcccacaaaaaacttttcttcacttagcttttgtgtataaatttataatatgactactaaatataaacataatatagtattcttttgtgaaataacaaattgtgcttatccatttgtttttttcacaaagtagaatgtagtttcctttttcaaatagctactgattagttcatttctatgactcaagttatttgcagttcctgggacatcttttcatgtatgttagttgcactttcttactttagctttaagaatcttgacttcttttgttgtttttttctaacagtagatatgtatatatttttccctctctaggtgaatcaattcagatatttgctgagattgagaactgctcttcccgaatggtggtgccaaaggcagccatttaccaaacacaggccttctatgccaaagggaaaatgaaggaagtaaaacagcttg

SEQ ID NO: 590060 - DNA, 524 bp, Homo sapiens
  misc_feature (28)..(28): n is a, c, g, or t
  misc_feature (67)..(67): n is a, c, g, or t
  misc_feature (95)..(95): n is a, c, g, or t
  misc_feature (105)..(105): n is a, c, g, or t
  misc_feature (108)..(108): n is a, c, g, or t
  misc_feature (157)..(157): n is a, c, g, or t
  misc_feature (248)..(248): n is a, c, g, or t
  misc_feature (278)..(278): n is a, c, g, or t
accccgagccagcctcctcgcctggccncccaagtgctgggaacggctgaccacttgcccgatgatngctaccaagtaagcctttctagatttcnagaaagggantcnatagtatgtgtctttataacgactccatttagcgtagagatggtatacntttctgtaagactcagtggtaatattttaggcttacggcgggatggtcttgtaggatctacctactcagctctgctgttggtagtatgaangtgtactgaatgggtgtagctttgttccantaaaactttgactacaaaaatagggagagggccggatttggcccataagctagagtgtgccaatatctgatgcagcataattcactccggatttacttctattgttacatgtatcagcagtttattcttttttattgctgagtagtcttccattgtatggatgacgttttgtttattcatcgattgatggacatttgagttgttttgagcttttggcttttatgaataaagttgttatgaacatgc

SEQ ID NO: 590061 - DNA, 151 bp, Homo sapiens
  misc_feature (74)..(74): n is a, c, g, or t
tcttagtttcttcttggtaaatatcctatgggtggggtaagatttactatatctttagtttaaaattcggcggngtagactcgggcagctgcctctatggtgacgaaacaagctttttttttttttttttttttttttccataaaacgggg

SEQ ID NO: 590062 - DNA, 229 bp, Homo sapiens
gctgcatccgaggtgctggtggacagcgcggaggaggggtccctcgctgcggcggcggagctggccgctcacccgccccaacagagactgcgcaaaaaacagaaactgcacctgatgcggaatgaagctcgtaaattaaatcaccaggaagttgtggaagaagataaaagactaaaattacctgcaaattgggaagccacccaaagctcgtttggagtgggaactaaag

SEQ ID NO: 590063 - DNA, 158 bp, Homo sapiens
ccaagacccatatgactggctgctctaagcccacagagggagaaggcactgggacaatgacccaggcggtttttgtgcgctggcctagaagaagcacttactcctttcacccacattccactggccagcattgagccacaggaccacacctggacata

SEQ ID NO: 590064 - DNA, 817 bp, Homo sapiens
  misc_feature (10)..(10): n is a, c, g, or t
  misc_feature (74)..(74): n is a, c, g, or t
  misc_feature (80)..(80): n is a, c, g, or t
  misc_feature (87)..(87): n is a, c, g, or t
  misc_feature (116)..(116): n is a, c, g, or t
  misc_feature (147)..(147): n is a, c, g, or t
  misc_feature (157)..(157): n is a, c, g, or t
  misc_feature (166)..(166): n is a, c, g, or t
  misc_feature (203)..(203): n is a, c, g, or t
  misc_feature (217)..(217): n is a, c, g, or t
  misc_feature (232)..(232): n is a, c, g, or t
  misc_feature (257)..(257): n is a, c, g, or t
  misc_feature (261)..(261): n is a, c, g, or t
  misc_feature (266)..(266): n is a, c, g, or t
  misc_feature (274)..(274): n is a, c, g, or t
  misc_feature (392)..(392): n is a, c, g, or t
  misc_feature (396)..(396): n is a, c, g, or t
  misc_feature (751)..(751): n is a, c, g, or t
  misc_feature (753)..(753): n is a, c, g, or t
  misc_feature (761)..(761): n is a, c, g, or t
  misc_feature (764)..(765): n is a, c, g, or t
  misc_feature (779)..(779): n is a, c, g, or t
  misc_feature (784)..(785): n is a, c, g, or t
  misc_feature (788)..(788): n is a, c, g, or t
  misc_feature (793)..(793): n is a, c, g, or t
  misc_feature (795)..(795): n is a, c, g, or t
  misc_feature (804)..(804): n is a, c, g, or t
  misc_feature (808)..(808): n is a, c, g, or t
  misc_feature (811)..(811): n is a, c, g, or t
tcatgaatcntgacaaattgagatttgctgatggaagcataagaacatcggaactgcgactcagcatgcagaantcaatntaaaatnatgctgccgtgttccgtgttggaagcttnttgcaagaaggttgtgggaaaatcagcaagntgtatggagncgtaaagcnccggaagacgttcgaccggggaatgggggggaacacnggcctgccggaganccccgacccgcagancctgatgctgtgtgcgcggcagacnatcnacggnggagaggnacggaaggagtcacggggcgcgcatgccagggaagactacaagagtaataagaaacgtgatggtgtttctggcatcaggtgcggattgatgagtacgattactccaagcccatccagnggcnacagaagaagcccttgaggagcactggaggaagcacaccctgtcctatgtggacgttggcactgggaaggtcactctggaatatagacccgtgatcgacaaaactttgaacgaggctgactgtgccaccgctcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtccntngcttcatnctnntgagatgataaaantggcnnagntcttnantaaaatatnaatnaanaaaaaa

SEQ ID NO: 590065 - DNA, 782 bp, Homo sapiens
  misc_feature (10)..(10): n is a, c, g, or t
  misc_feature (74)..(74): n is a, c, g, or t
  misc_feature (80)..(80): n is a, c, g, or t
  misc_feature (87)..(87): n is a, c, g, or t
  misc_feature (116)..(116): n is a, c, g, or t
  misc_feature (147)..(147): n is a, c, g, or t
  misc_feature (157)..(157): n is a, c, g, or t
  misc_feature (166)..(166): n is a, c, g, or t
  misc_feature (203)..(203): n is a, c, g, or t
  misc_feature (217)..(217): n is a, c, g, or t
  misc_feature (232)..(232): n is a, c, g, or t
  misc_feature (257)..(257): n is a, c, g, or t
  misc_feature (261)..(261): n is a, c, g, or t
  misc_feature (266)..(266): n is a, c, g, or t
  misc_feature (274)..(274): n is a, c, g, or t
  misc_feature (357)..(357): n is a, c, g, or t
  misc_feature (361)..(361): n is a, c, g, or t
  misc_feature (716)..(716): n is a, c, g, or t
  misc_feature (718)..(718): n is a, c, g, or t
  misc_feature (726)..(726): n is a, c, g, or t
  misc_feature (729)..(730): n is a, c, g, or t
  misc_feature (744)..(744): n is a, c, g, or t
  misc_feature (749)..(750): n is a, c, g, or t
  misc_feature (753)..(753): n is a, c, g, or t
  misc_feature (758)..(758): n is a, c, g, or t
  misc_feature (760)..(760): n is a, c, g, or t
  misc_feature (769)..(769): n is a, c, g, or t
  misc_feature (773)..(773): n is a, c, g, or t
  misc_feature (776)..(776): n is a, c, g, or t
tcatgaatcntgacaaattgagatttgctgatggaagcataagaacatcggaactgcgactcagcatgcagaantcaatntaaaatnatgctgccgtgttccgtgttggaagcttnttgcaagaaggttgtgggaaaatcagcaagntgtatggagncgtaaagcnccggaagacgttcgaccggggaatgggggggaacacnggcctgccggaganccccgacccgcagancctgatgctgtgtgcgcggcagacnatcnacggnggagaggnacggaaggagtcacggggcgcgcatgccagggaagactacaaggtgcggattgatgagtacgattactccaagcccatccagnggcnacagaagaagcccttgaggagcactggaggaagcacaccctgtcctatgtggacgttggcactgggaaggtcactctggaatatagacccgtgatcgacaaaactttgaacgaggctgactgtgccaccgctcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtccntngcttcatnctnntgagatgataaaantggcnnagntcttnantaaaatatnaatnaanaaaaaa

SEQ ID NO: 590066 - DNA, 619 bp, Homo sapiens
tggaaatggggagtttggctcttctggcccaggtgggagtgcaagggcgcgatctgggctcatggcaacctctgcctcccgggtttaagtgattctccggcctcagcctcccgagttattggggattacaggcgcctgccaccatgcccggtctaatttggctatttttagtaaaaacggggtttctccatgtgggtcaggtgggtctctaactcctgacctcaggtgatccatccgcctcagcctcccaaagttctggggattacaggctgtgagccaccacaccgggccatagttggtctttcttatggtgggatttaatctggctattggtccctaagaactcagaattactggtggatgcttcaaaggggtgtgtggggtcgtcgtgtgtgtgtccagttaatccagaatattcctcccaggaaaatagaagaccccaggaggagtgggggcaacaactctttatctggctacggggcagacagatcttcatgaaaaccacacatgaacctccagaactcgatgtgctccaccagcccggccttagctggtcaaagccacccgtgggaatttcctggtgaagcccccagggaatagctcagctagcaggacacgg

SEQ ID NO: 590067 - DNA, 277 bp, Homo sapiens
tgcaggtcacctaagaagaggtattaatatgggcatattggggagatgggtggggaaagaggaaaagctcgctaactaagaatacacaacctgaaaggagcgcttctaaacaaaggtaaatcactaggacagatctgttagggtttacctttcactcttgtagtagaatgctgatctaacgggagttttgaagtgtggagcagtggggaaaaaaaagaaagaaaatgagaattttaatttcttgaaataaacggcaatttatccatttgcacatacc

SEQ ID NO: 590068 - DNA, 623 bp, Homo sapiens
  misc_feature (132)..(132): n is a, c, g, or t
  misc_feature (559)..(559): n is a, c, g, or t
  misc_feature (600)..(600): n is a, c, g, or t
cggggggggggggaagaaatttttttttttctcccgaaggggggcccccaccacaagggggggtgttggaaagcccccccccccttcaaaaagtatttttttttcccacggggttttctattaaaaaaaacnaaaaaccgccgtttttttttaaatctccctccccccccgaaaaaaaaaaaaaatgttggggggggggggggggagaaaaaaaaaaagaggccccctttttttttttttttttttttgagaagaaaaagccccccctcttttttttataaaaaaaaaaggggcccccgccccccccaaaaaaaaaaggggggggttttttttttttaaaaaaatttgtttttaataaagaagcaaaaaataagggggcttttttctcttcccccaaaaaatacttctttttttttttaaaaggggggggggagaccccccccccccctcttttaaaaaaagaaattttttttgtggtgggggaggtttccccccccggggggggaggttttttttttttgggggggtctcttaaaaaggggtggggcccttttcccgngccccttttttggtatttttttttgggccgttttatttttntggctctggctccactgccagtt

SEQ ID NO: 590069 - DNA, 219 bp, Homo sapiens
cctgtctgcattcaagtcacagagttgaacatgcctttcatagagcaggttggaaacgctcttttgtagtatatggaagtggatgttcggacggttggaggcccatggtgataaagggaatatcttcccctacaagctagaaagaagcatggtgtgaaactggttggtgatgtgtgtactcaactaacagagtggaacctttctttttacagaacagtg

SEQ ID NO: 590070 - DNA, 646 bp, Homo sapiens
ctatggagtttcagtaaatttgtattgctctgactagtgaaacacacacatctatgttgctgaggatatttttctgcagttcaagttgtaataatagctctgtttaagatccgtcagtcacttgaatcttctctaaggctttgtatgttagaagttaatttgctttcttacaaggccacattctatcttgtaactaaacaactgaattttatgtcttagcgtagatggtttattactttctggtttttctttagtaagaatcctataaaaacactagtatttttctctgagtttaaaattcaatacatgcctactgatatggttaggctttgtatccccacctgaatctcgtcttgaattgtaatccccatagcccccataatccccacaggtcaagggagagaccaggtggaggtaattgaatcatgggggcagtttcccctgtgctgttcttgtgatagtgagttctcacgagatttgatggttttataagggattctttcccctttgctcggcacttcttcatgctgccttgcgaagaagctggcttgcttcctctttgtcttccgccatgattgtagatttcctgaggcctcccaagctgtgctgaactgtgagccaattaaacttctttcctttataagta

SEQ ID NO: 590071 - DNA, 509 bp, Homo sapiens
tctagaggatcccagcgctagccagaggtgtcctcaattgaagtctgcttttgcactttgcatgccactggtatactcaatgtctgctgctgtggacaagcagctcgcggaaatcgtagaataagattattatcattaatgacaagggccgtctgagcatggaagacattgaacgtgttctccaggatgctgttaagtacgccgcttgtggatgagaagcgagggtacaaggtgccacccaagtactcacttgcttcccagtgcctctcaacatgaaagcgcctgttgaagatgagaaactttcaaggcatgatcaatcgatgaggcctgacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcccgggggtaggaggt

SEQ ID NO: 590072 - DNA, 1150 bp, Homo sapiens
  misc_feature (1150)..(1150): n is a, c, g, or t
ggaacaacttgagtgctcagtatatgatgctgcctgggatgacatatctagagttcggactaaccacagaattccgagcaggaggcagcgcgtgtgcgacaccttcactcacagcagcagagggcatcatagggagctcagccatcatcatcaatgatagcaagtagtcagatccacaaggatcagccagtccatgttaatctgggcgaagagttgggcgtgggcggccgagttgagggataatcaatgtatcgctccggaatgagtcattcgttctctggaatgtgcctggcatcaggtgtgtaatcctggcatcaatgtgtgtgctccatgaacgggcacggtgcatgtagcgtgcccattggtgtcagggcccgggatgggtgactgatataagcctatcctggagatggcagtgccttgatttgcataggctatatggggagtgtaatgactatatagaattcgataattttgaaagaagcagcgggagaacggctatcatgggtgggacttgagaaaggatacagcatatcaagcgggcgatgggccacaatctatactctgggcactcttggagttgaatctagcagcgcttgtgcacaaacgcaagttcgatggtggacggaacattctacgaccaacacgttctacgaaacttcttgcatacgccaaggcaattccatgtctttttactccacccgtccaagaactggggacgcatggtgttgatagctgtggttgattgggtaactcgtgcatccaaacgcataggagacgagtgcaattctcgtctctcgcatttcgcaagcgtatcgaattcgcccagctctaagtgggccgaggaacatcgtggggaaacgcaccccaaaaggttcgggaaggggtgcaacgggtggggtcaattcgaaaggttcacataccttgttttagagacacgccttcaagcggggacatgggcgttcacaggaaaccgaatgcaggaggcgttgaggggaatgccccgaagccccccaactggagaaaccaacaaattccgtgtgcgtggcagcgttgaattgctgcaattgaaagggggggaaagggccgaaggtaacccatggctcaagcgtccagaattggccgattcggtgtcgtgtggaagattccn

SEQ ID NO: 590073 - DNA, 340 bp, Homo sapiens
tttttttttttctatctcttttctgttttctttaatcgtcagttttttttttttggagacagggtctcattctgtcttccaggctggagtgcagtggcaggatctcggctcactgcaacctccgctttcccggtagctgggattacaggtgcatgccatcacgcctggctaattttttgtatttttagtagagacaaggtttcatcatgttgaccaggctggtctcaaactcttgacctcgagtgatccatccatctcagcctcccaaagtgttgggattacaggcgtgagccaccgcgcccggccttccctgtcattttcaagcaatcctcaaactccc

SEQ ID NO: 590074 - DNA, 440 bp, Homo sapiens
ttgggaaggcacggcaggtcaggggggtgctgaccgcgcgaccgttgtggcttatgttcgggggcccgagaccgtggggtcctggggaacccaccaccgccaaggggcgtcaacgttgcggctgatccctactcgcgggccctgtcggaattcggcaatctccggtgcgggttcgaggcgccagcccaaggcagatatcgcatcattgccgatgatgctcaccgggtttccagactcttcgagactggcacccaaagctgaccccatatttcctggtccgcaggcaaggcggttctcggcgacgttcccgcgatgccgacgagcatcatcgtggcctgctatgacttgcccgccacgcagcagcacggcagatgcctccccatctggtgaacacacgaggttcacgcagcgatgcatgccgtaagacaagtacacgtata

SEQ ID NO: 590075 - DNA, 162 bp, Homo sapiens
cagatttttctttttcttttggttctagcttgggtaatttgtgtctttcaagaaattggttcatttaatttacattttcaagtttattggcataaagttgttcatagttttataattcttttaatatctgctgaatctataatgatattttggctttcattc

SEQ ID NO: 590076 - DNA, 186 bp, Homo sapiens
gatacgaatcgagctcggtcccaggagagggggaggaaaggacagaaggctgcgggtggtgttatgaagcagaagaagcctctggtgggaagaaaggcagtcagtaccaagaaacgagccccatgtagaaacgaagcctgcagaggaagaaacctcactacagcaggagatagaagccgtgctgca

SEQ ID NO: 590077 - DNA, 949 bp, Homo sapiens
  misc_feature (1)..(1): n is a, c, g, or t
  misc_feature (79)..(79): n is a, c, g, or t
  misc_feature (164)..(164): n is a, c, g, or t
  misc_feature (169)..(169): n is a, c, g, or t
  misc_feature (194)..(194): n is a, c, g, or t
  misc_feature (248)..(248): n is a, c, g, or t
  misc_feature (264)..(264): n is a, c, g, or t
  misc_feature (277)..(277): n is a, c, g, or t
  misc_feature (327)..(327): n is a, c, g, or t
  misc_feature (397)..(397): n is a, c, g, or t
  misc_feature (469)..(469): n is a, c, g, or t
  misc_feature (490)..(490): n is a, c, g, or t
  misc_feature (492)..(492): n is a, c, g, or t
  misc_feature (539)..(539): n is a, c, g, or t
  misc_feature (553)..(553): n is a, c, g, or t
  misc_feature (627)..(627): n is a, c, g, or t
  misc_feature (671)..(671): n is a, c, g, or t
  misc_feature (673)..(674): n is a, c, g, or t
  misc_feature (707)..(707): n is a, c, g, or t
  misc_feature (722)..(722): n is a, c, g, or t
  misc_feature (747)..(747): n is a, c, g, or t
  misc_feature (762)..(762): n is a, c, g, or t
  misc_feature (765)..(766): n is a, c, g, or t
  misc_feature (780)..(780): n is a, c, g, or t
  misc_feature (799)..(799): n is a, c, g, or t
  misc_feature (807)..(807): n is a, c, g, or t
  misc_feature (813)..(813): n is a, c, g, or t
  misc_feature (857)..(857): n is a, c, g, or t
  misc_feature (859)..(859): n is a, c, g, or t
  misc_feature (874)..(874): n is a, c, g, or t
  misc_feature (940)..(940): n is a, c, g, or t
nttaatggattcaaatcttcaggtacccagtctcagttgccgttcagtggggacaagagtcgtgtctgtagggcatggncacaccgcttctgtgctgcatgcagaggggtgcaaggccagggcagctgacctggtcagccaccaggggagcccacgcctctganaacanagtgtccttgaggtcaggaatttgnagtttattttgttattaagatggcgagataatttttcgtccatttagagcctancatttttagatgtatnttaatggcatctnggttgggatggtattcgtgttcatttctcagctgctgaaggatgtgtgtnctaaaacaaaagggctctcagtctgctctcctggctgcatgatagagaagtgttttgtaagacgcttgtnaaaaacccatatcccctggcccctcttgtggagaccctgtttcagtagatgggaatggggctggggtctgtntaacctgtgcccaggagactntnttaccagcttgggaagctcctgcagggaggaaggaatgatccacaanttcccaagcccttnatgctgaggcatctgtctggctggagaaacactaaggttggcattgtgctcacactgggaaatgacctggaggnagtcgggaagaggagtgcaggccggttccaccctctgggtcatntnnccggctggtaagcactggaaatagggaaatagnagaccgaaaggctgngaccccctcacacccaacctgcgtncatggccgaggttgngtnnggagttctggagantctggcttcatggtctttnctcttgtncttctnttcctcaggggtcgctgcccaccaggctcagcagggcgttcttntngtcgccgctggtgtnttccatgaacatgctgctgagggtctggccgtacatcttcttgaagttacatttgataagattaantaatttcgc

SEQ ID NO: 590078 - DNA, 177 bp, Homo sapiens
  misc_feature (98)..(98): n is a, c, g, or t
  misc_feature (158)..(159): n is a, c, g, or t
ggaagaccattctgatcatcctcactgacgccacaggcaagagggtggttttcctgaagcagctggctgtggcttatactcgtgactggacctctggnctcaattgagttcctcaacgaagaccacaccagaaattgtcattgccacctcaaccgaanngatattacaatgtaaaaa

SEQ ID NO: 590079 - DNA, 408 bp, Homo sapiens
cttgtccacacggtaacatccatgtcagtgtatctgattatgtgctcagatctcagcaagctgtggctgcaaaataaggatgcatctagattgtaatgacttggagtcatcacccgcccaaaagagcagaaaattcaggcccccttcccttggttcccttcctcagggtccatgtttgtctattattacttacataattaatagctctaaaggaatgcatcttataactaacatcaaaaattaaaaacacaactcttggagtacctcaagttcaaggtgttggctgttcctagttgtctgatggtcatcctcagcctgtgtgctgaggatccactcatctggtcgtccctgcttggagttatctgcactgggataactggaggtgggaggcagtggaaatttcggttc

SEQ ID NO: 590080 - DNA, 397 bp, Homo sapiens
  misc_feature (101)..(101): n is a, c, g, or t
  misc_feature (189)..(189): n is a, c, g, or t
tgatctgtgtattatgcatttctctggctctacagcgattagaagaacaacagatgtgcttggttcctagaagcaacaaaataggattgaagaaaagaatngcagcaatgaagagaatcggaagtggatgagagaaaatgtacctgaaaatagtcgaccagccacaggtttacccctgccacctcagantttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaatta

SEQ ID NO: 590081 - DNA, 267 bp, Homo sapiens
  misc_feature (244)..(244): n is a, c, g, or t
ccatcttctcatagcaactcataacctgaaaacttcacgacattttaccaaaactctcctcccagaagagcatcagtgatgagacgtagaaggctaattggttcttcgatgacgggtgctgaaccacagagggcgctggtgagaaggtggtgcctaaagattcagagaatctgagaataatttcatagtcccagacatttcacttaaaggcaattcaggatggttcactgctctgctgcttggnggcgtcatcgaagaaccaattag

SEQ ID NO: 590082 - DNA, 696 bp, Homo sapiens
  misc_feature (211)..(212): n is a, c, g, or t
  misc_feature (316)..(316): n is a, c, g, or t
  misc_feature (650)..(650): n is a, c, g, or t
atttggagagtaaagggtaatttggatctttcaaggcctatctttttaaccccagtcatcctacttccccccaaagattgaattgccctcgggaaatgtggggatggcccgggctttcaaactatccttccctttatggcgctgcaaggtgtgggcaagtcatctttactgaacggaagctcactgcatggcctccgtgtcccactgcaanntgtcagtggtggaccttcctgccgtctaaaaaaactgcccaatattattcatcaaaaaggtggttaagcaggggtcggagggccccctcaagggcattctgggntacacttagcaccaggtggtttcctttgattttaaaaacgacaacccctcctccccctttgacggtgggggtggcattgccctcaacgacccctttgtcaagctcattttttggtatgacaacgaatttgggtacaacaacagggtggtggacctcatggcccccatggccttcaaggagttaaacccctgggcccccagccccagcaaaagcccaaaaggaaaaaaaagaccctcccttttggggagtccctgcccccctcagtccccccccccactgaatttcccctcctcccagttttcatgtaaacccctttaaaaggggaggggcctanggaaccccccctttttatgttccctcaataaagtaccctgtgctca

SEQ ID NO: 590083 - DNA, 324 bp, Homo sapiens
gagacagggtctcactctgtcgcccaggctggagcgcagtggtgggatcacggctcactgcagcctcaacttcccgggctcaagcagtcctcccatcttagcctccctagtagctggatccacaggtgtgcaccaccatgcctggctgatttttctattttttgtagagatgaggttttgccattattgcccaggttggtctcgcaaggggatcctcccatcttggcctcccaaagtgctgcgattataggcatgagccaccatgctcagcccactatggatattaatagctctctagtgatcctgataagcttatgatcaata

SEQ ID NO: 590084 - DNA, 1230 bp, Homo sapiens
agcggaagtccccacccgacccagaagccggctggtttcacctctcaatggctccagccgctgcctctcccagcacatccccctttcgcagatgcgagtcccgcttccacagccctgggctagccccaagagagtgtgccgcctactccgtgcattccgcgctgctgacagcggcctccctcactgcacgcgcccgactgccgcgcggaccacccactgacggctgctcgatccactcgtctcctcttcacccctcagcaacgtctcgcactctgcgctgcgggcgcccgccactctcctgcttacgctgctgcacacccaccggtcctcgcgcccctccgcctgcctccacccctcgcccccgacccccacccgccctgctcttgcgcactcttcgccccgcgccctgccactgcccacccccgccaccccaatcatcaaccaccactcctcccttccccaacccctcaccccccactccaccaacctccgccccactccctcacccaacccccacccaccccaccacaacccccacccccccacaacaaaacaccacataccccacctctccacccaatcattcgcacctctccctcactcctcaacacaagccgagatactatactagagacccacttgagcctcgccaggtcacacgtgctaactacaccgcagagaagacactctgattaaccagcaaatctagaagccaccgcgcacaccctacggaagctaaagctactgccagatccattctccaggacccaattctacttgcttacgccatacgctcatatcttcatcagctctacgagctaaaacgtgacagtacctacagcccggaagtagacttatcttccctccaacattacatatcattctataccccacccttcaccttcatactcacatctctccccatcgcccccacacttccaaacaacccacaaacacaccacatagcccactccccatccccccccacaacacacccaatcatcgcatcttcccccacacacaacaacacgacacaacacataaccatgaccaccctaccccaaactcccctcaccctctcccccacaaacccatcctcccacacccacatacaccacacacacacccagcccctaccacactctcaccatacccacaccgcacaccaccacatcaacaaacaaccaacatccccccaacaaccacatcacccctcaaacacccccataa

SEQ ID NO: 590085 - DNA, 609 bp, Homo sapiens
gcacgaggagagacatgagtcgggtcacatactgtgcatagagctctagagactcggtatatttaaccacttacatgaggcgcgctcaccaaatatataggtcgaatgtgattgggacacaacgcgattgagattcatctattcatggggctttgagtatgaagaagaaaggagattattctgacacacaagggtgacaacctggatatgagcctgaggcgttatactattaacaccattcttttatggttcaagtcgatgaatttaaacctcttgtggaagaacctcagaatttaatcaaacacaaattgtgagctttttgagcacattggagagtgccaatttcagaatgcgctattaggtcggtacacccagaaagtgccccaagtgtcaacttcaactcttgtggagaggtcaagcctatgacaagactatctatatcgggtgctgaaccaatatgtgtgttgcatgagagaacgccagttagtgacacagataccacatgctgtgcagaatactctgggaacacgcgagcatgcgttttagatctggaagtccatgagacatacgcttccacagagagttgctgtgacatttacctttctgcgg

SEQ ID NO: 590086 - DNA, 317 bp, Homo sapiens
cgtcgacagagggccctattcatagtggatcctacggaccacagaggttgtgaacctccggatgctctggaagaatttgccattttcagtaagaagacaagtggtcgttactagctaagatgtgtttgtactttggaagagcatatgctacacccttccttgtagtaagacaccaagtagttaaaacataaggatgtttcagttcatccatttaacagatatgaagagcattttaaagggtgcagcctctggaagtgcatcaaactagaactcatatgccatactagatatgtgttgtcaataaacttatgacgtga

SEQ ID NO: 590087 - DNA, 496 bp, Homo sapiens
cgctccgcctgtaggattactcaagtgatctgcccgcctcgactcccaaagtgctgggattacaggtgtgagccagcgtgcctggcctagaaatggcttgtttgactcagcataatgtcctcaaggttcatccatgttgtagcatgggacaggatttccttcattcccaacgctgaataatattccactggacacttggattgttgagaataatgctgctatgaatgtgggtgtacaaatgaatctctcctcaagaccctgctttcaattcttctggagatatgcccagcagtggagttgctggatcatatgatatcctatgtttcattttttaggaactgccatacagtcttccacagtggctagaccattttatattcccatcatcagtgcacaagagtaccactttctccacattctcgccaacacgtatttggtttttttggataatcctaacaggtgtgaggtagtatcttattgaggtaatccgtgaggg

SEQ ID NO: 590088 - DNA, 154 bp, Homo sapiens
acgactcaggagtctagcctgaaactggggtccagaaagctaggaaagagtcccctcttcctcccatctcaaatcctctctagggaacagagtggccctggctataattttatcacatacattataattagaattaagtcttcttcatgatggt

SEQ ID NO: 590089 - DNA, 290 bp, Homo sapiens
taatatttttttgtaaaaaaaaaaaaaaaaaaaaaggggggggaaaaaaaaaaagggggaaaaaaggttaaaagggggggggggaaagggagcggccacgaaactcaccacgcatagaagaacccgccaacgggggtgcccgcgcgacccctcatcgaggcaaccaaaacaacggtgggcgctatagaaaccccccaccagagaggacacaaatatagaaagggcaaactcagtggatgtgacgaaccgggacacaaaagggggaatctaagaaagaaaaaaaaaaaggg

SEQ ID NO: 590090 - DNA, 1360 bp, Homo sapiens
ggcttcggcggggctagcttgcagcgcggatatctctggccgccaagactccgcctcccgccccgggactgtgcccctgggggctcgcctgtagagccagagtcagcgccgacagcgcctccatgcttcggtagactgggacttgtggcctcgatggacccagcctgtcattcgcgcagctgcgccgaggtaagagcttccaggtatggctcgaccgcatcgactaactgccgcgcgatcctgcgacgtactggctgtcaagaggggactgctgcatatgccagtgtccgggtgcgcgttcgcgtcagcacgtcgcgacccgcgtagagcttgctcgcgcggccccgcttgcctcgcaggatcgccttgccggggccctgctattgagcgagtcccgtcgccgatggactgtacgagcgagcgagtgctgtgtgttgtgctgcaccgtaacgtgtcgctcgacttgttgccgagccagagtgagaccttgccgtgaagagtctcccccagcgggaacgttgcactgggcccccgaacgctcgcgggcgtacattctgacgtgcgaaaggggcagagcccaattcgcctggagagtgaacctaccctttctcggtcgacttcgacgtagcgaccgtcgcaggaactttgggcgtggtccttgtgggagcagctatggcaagtccacctccttgcattgtcataggtcacattccacaaggaggatcggtgttacaacacccaaaggggggagggctttgcggaaggccatgggcaagttctcccggctaattattgcccctaagttgcgacctaaatttgattttggaaccgatcttgtaataagaaagtactcctaagatccaccacgtttggaacaaagatcttccccaatttttaaacattctttcacatgcctacattagttcgttgttagtacccaaacccattggacaaacggcgttccatatggttacccaccctgttcgtagaacgagccggtatgcaaaaagttatgcctagggggcgaagcgcgccgtgccattaggaacaggggcatgcgcatctccgcgcgaatactaggtgggcgattccacgaggggcgggaacggccaattaggggaacgcaagttcaccccttagagataagaccgctaggggcgatcgccatatggcggagagggagaagccacattttggggttgtggtgcgtataccatttgcgcgcaagagcgcatggtggcccggccccctatatggctagattgttgggcccggtttatggaacgtgggccctagaataaagccccccgaagaaagtccccttcgagccccaggaccctgtgtggcagtgttgacttag

SEQ ID NO: 590091 - DNA, 596 bp, Homo sapiens
gtgtacgggttgtttgaaggtaatctctgttactttaccctcctggggtaggaagtcaatcacaagttgggtaaattccccattttggcagtatgtgaaatgacagaaagatcagaaagtcagaaatcccacacacctgctaagtggtggcttatctgtatggctgtgcaaatgaagcacgctgcttccctcattcctgtattcagttttattgcttgtcttgcaaaatggcacatttcaagattaaagccattttgactttgagttactgtctttgaagtataggatttcctatttataaaaacacatactaattgtagaaaaataggataatagaagaaaatatgcagaaaagaaatttatctaaggcctcctacctcaaatccaactgctgtaaatgtataagtgaattggcttccaatacttttatgagctctttaaaaacatatttgagatcatactgtgatatagtgttgtatctatgcatatactcctcaatgttgttagtgtaagcataaggtcttcattactgtttcaatggctatgtgccaggaatctgtacattgccatctcacttatatcagtgaatggtagat

SEQ ID NO: 590092 - DNA, 656 bp, Homo sapiens
  misc_feature (65)..(65): n is a, c, g, or t
  misc_feature (70)..(70): n is a, c, g, or t
  misc_feature (79)..(80): n is a, c, g, or t
  misc_feature (90)..(90): n is a, c, g, or t
  misc_feature (93)..(94): n is a, c, g, or t
  misc_feature (98)..(99): n is a, c, g, or t
  misc_feature (104)..(105): n is a, c, g, or t
  misc_feature (108)..(108): n is a, c, g, or t
  misc_feature (114)..(114): n is a, c, g, or t
  misc_feature (122)..(122): n is a, c, g, or t
  misc_feature (127)..(128): n is a, c, g, or t
  misc_feature (130)..(130): n is a, c, g, or t
  misc_feature (133)..(134): n is a, c, g, or t
  misc_feature (139)..(139): n is a, c, g, or t
  misc_feature (153)..(153): n is a, c, g, or t
  misc_feature (158)..(158): n is a, c, g, or t
  misc_feature (165)..(165): n is a, c, g, or t
  misc_feature (172)..(172): n is a, c, g, or t
  misc_feature (176)..(176): n is a, c, g, or t
  misc_feature (182)..(182): n is a, c, g, or t
  misc_feature (193)..(193): n is a, c, g, or t
  misc_feature (404)..(404): n is a, c, g, or t
  misc_feature (417)..(417): n is a, c, g, or t
  misc_feature (435)..(435): n is a, c, g, or t
  misc_feature (479)..(479): n is a, c, g, or t
  misc_feature (489)..(489): n is a, c, g, or t
  misc_feature (511)..(511): n is a, c, g, or t
  misc_feature (521)..(521): n is a, c, g, or t
  misc_feature (557)..(557): n is a, c, g, or t
  misc_feature (567)..(567): n is a, c, g, or t
  misc_feature (602)..(602): n is a, c, g, or t
  misc_feature (609)..(609): n is a, c, g, or t
ggaagtccccaaaaatgtccgcttgggcgccccaattataaataccgggagccaccaccgagttnatccntgtgaaaannccatcccccntcnngccnntaatnntangaattntccaaggncatcnngnttnngcagntgagagaaaggccnagggnccagagntgtgcancccntcaggntacctagcaanaaggcccaggttaagccagggcaaacattcagtgtggccggttgggggcaaacggcccccctgggaaaacattcacacaccctacaaaaggtgaagatgacagtgcaggaagattgaaagtgcgaatctgacttacgccattatttcgacggaccatttagtttgtgggtgggggccccaaaaattaaaaaaactttcctttaagggggantttggaggccctnttgtgtgtaacaaggtgncccagggcattgtttcctatggacgaaacaatggcatgcctccncgagcctgcnccaaagtttcaagctttgtacnctggataaanaaaaccatgaaacgctactaactacaggaagcaaantaagcccccnctgtaatgaaaccccttttttggagccaagtccanatttacnctgggaaaggggccagcaactgaataaaaaccttttagctgagggga

SEQ ID NO: 590093 - DNA, 178 bp, Homo sapiens
ggaagttcaaaggaactccctctccagcttttttgaatcttggggcccagcctaaaaagggccaaaagttagaagacagcatagccactcagctcagggagctaccaaagaaaaatagccactgatgtgggggccttttttttttttttttaatttgaataaaaagaattagaagtga

SEQ ID NO: 590094 - DNA, 1265 bp, Homo sapiens
caaaacaccaaatgtgcggatgactgccggtgcagcgggggtggcccgtgggtgccctgtgtggccctgggatggggaacctgctggtggcattccgcggaggtttcggcagtggcatccgggtgcctgggagtcgcggaccgtggacggggcctggtggccgatggccgcggagctctgcggaggcaaggccgaggataaggagtggatgccctgtcaccaagttgggccgcattggtcaaggacatgaagatcaagtccctggcaggagatctatactcttactccctgacactattaaggaatcagagatcattgatataacttccatgggaggcctactctcaaggcattgagagttaacgaagcatacatgccagatgcagagcaagcagacccggtgaccggccagaggcaccagggtttcaaggacatatagtagactaatcggggacatacaaatgcgacaagatacggtactggggtgtacaagatagctcccacgggagtgtggcaacccgaacataccgttggggcacatcaatacctgggccaagactcatccatcgtacccacgtgcgacagaggcaacctgggggcggaaccacgcattacgcgcagagcccagcaaaacatggttcctctctgcacaccgctgaccacgggcccgccttgacgggcatctagatacttgggtacggcctccaatacccgctggacccagaggcgcacactggtgactttgatccggacacctgttgccataaaaaggcttgctccgttagatcgcgttggatctcggaagaacgatgggtcgcagcgtaaagccccggggcacagacattgcccgagccatgggcccagtatcagccccaagggcacacattatgaagcagtttcgttaagaacctaacagataaccttgacccccggaccattcgtgacaggagaactgtgatacgcaccaagacatgctatcacggactacccgtggccacgcgaacgaaccccaaccggaagccccgcacgggcgcacggcccccgcgtgggcaacagcaaagtgttactctcggacgagacggattagccgaaacaacacaacgcggcgccaacgacccgagcggccgcacacacgccaccacacaagccgcaagtgagcgatacagcggtcccaaagcgagaaacgcatggagaacccaacggagccaccagtagagataaagatcaacagccgtattacagcgggggtcacgacaaaccagcga

SEQ ID NO: 590095 - DNA, 996 bp, Homo sapiens
tgtggtgtctcccttgttgattctgtcttctcactctataccttctaccgttttttgtcgtctatctgatggtggttggtggtcttggttctttcccggggcgttcgatgctgcctcggtttttatggggagctgttgtttattttcctgtaaccgtgcttgtgggacattcttgtgttccttgttgactgtctcgtgtgtctttttttttgttgtctcgtgcccccccccggggaaatgggcgccttggggccaccccctcctcttgccctcctactgctctctttttcgggctttgtggccccacgagagggttttccccccccgagccccacgcgttgtgggagaacactctgtggcgcccacgccgccttcttctgtgcttctgggtaacaaaaatggtaatgaatgcgtgttgggcctctttcttaaccccagcgagggggcccccactggagtttcccccccacgtcacccaacaccggtgtcccctttccactcggccctcgcggagtgccctccacccaccaccccacggttgttctgttcctctttgctctctgaaggtgccctctcccaggcgctctccccacatccacaggccccaaacgccccccatgtgccccctgttccacggagatactgtcctgggggccacatatcgagaggggcccacaacacagaagggcgccaccaccacaccacacccgaacgcggcatgggggagacccacacccacgaccccctttctccctcttttggtcccagaacatcacattgtcccattgcccgcgagaatggccccctaccagccaccccccgttttgccacccagaagaggagactgtagattggccagaaccgggcccccctgtaacccccacccccatctcccacccacgccccggccttgtctttttttggcctcacgtgtttcagattttttataggaccccaaaaaaaaaagggaaaaaaacaccaaaccaccaaaaccca

SEQ ID NO: 590096 - DNA, 837 bp, Homo sapiens
attctagaggccgaggcgccgacatgttatatatcttttttttattttctttttgggggaaaaaaatccgggggtattctcccgcgacaaatggatcatgagagaggacgaacagagatgtagccgcccagactgtaggagtgatacacaggggaggatgacacaacgcggtgtagacagaggagccggatggagacaaaaagagggcccacagagggtggcgcaccaccaacaacgatcccccgaagatgtaatggggcgaggaaaaaacgacgacgtgagcagcgtcacaagcagggacacagagtgcgggtgagagacccaacgctaaccacaaaaagaaacaccgtggtggggaaacacggtcgggaagccaaccactgtgcggattaaggcggagccaagcaacgctgcagagggggggcgccacactcagggggggacaagaacgcccaacattagcagcgggggggggcccccccacgaaccggtggagcgacagcaaaacacagccccgccaaagaggagcaccactctggtgggaacaacaggatatgtaaatcattgcaataacggggggaggtacagccacaaacagaggagggcgggcccgtgacaagcaaacaatgagatagctacaacgagagagaaggcattaagggaccacaccaaggtgctaacacggagaaaacagagaggagtgggcgagaagacccctcgccaagcaaacagaagagggctcttgagtgacgtatcggcgaggggcagaaaccctcacgagaataaacgccgtcgtgcagcgagccaaccacactgacgggccaccccctcttgtgt

SEQ ID NO: 590097 - DNA, 176 bp, Homo sapiens
ctgttgctagttatggtactcgtaagcattaataaattacagctccatagggtcttctcgtcttgctgtgtcatgcccgcctcttcacgggcaggtcaatttcactgtgtttacaagtcagagacagctgaacccttcgctggagccattcatacaggtccctaattcaggaacaa

SEQ ID NO: 590098 - DNA, 1047 bp, Homo sapiens
  misc_feature (10)..(10): n is a, c, g, or t
  misc_feature (38)..(38): n is a, c, g, or t
  misc_feature (74)..(74): n is a, c, g, or t
  misc_feature (88)..(88): n is a, c, g, or t
  misc_feature (93)..(93): n is a, c, g, or t
  misc_feature (110)..(110): n is a, c, g, or t
  misc_feature (158)..(158): n is a, c, g, or t
  misc_feature (1012)..(1012): n is a, c, g, or t
  misc_feature (1039)..(1039): n is a, c, g, or t
gataaggatnagagcatagcacccaaaactacccggtnacatacccagccaaagccagggcacattcatcgcanacagccaccagaantcgcnttgttcttccagctggnagatgtgaacactggtgctgtactcactcctcaccagacatttgtccnactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaaccattcacagtatgagaagaaaaatggaaaaaaaaaactttatttaaaaaagaaaaaagtccagattgtagttatacttttgcttgtttttcagtttcccccacacacagcagatacctggtgagctcagatagtctctttctctgacactgtgtaagaagctgtgaatattcctaacttacccagatgttgcttttgaaaagttgaaatgngtaattgttttggaataaaaagggtanccatagga

SEQ ID NO: 590099 - DNA, 196 bp, Homo sapiens
aactaacaaattgtatttactatacctagtgaaatctggaatgactgctacttcctagtgaatgtacaggtttgctattcgtgtaccctctttctggttgctttacaagtgacgtgtaatttctgaacccatgtttcatctgtataatagaacatctgcaccaatttctctcctgccccttatccagagccttggt

SEQ ID NO: 590100 - DNA, 1048 bp, Homo sapiens
  misc_feature (10)..(10): n is a, c, g, or t
  misc_feature (38)..(38): n is a, c, g, or t
  misc_feature (74)..(74): n is a, c, g, or t
  misc_feature (88)..(88): n is a, c, g, or t
  misc_feature (93)..(93): n is a, c, g, or t
  misc_feature (110)..(110): n is a, c, g, or t
  misc_feature (158)..(158): n is a, c, g, or t
  misc_feature (659)..(659): n is a, c, g, or t
  misc_feature (669)..(669): n is a, c, g, or t
  misc_feature (674)..(674): n is a, c, g, or t
  misc_feature (679)..(680): n is a, c, g, or t
  misc_feature (685)..(685): n is a, c, g, or t
  misc_feature (688)..(688): n is a, c, g, or t
  misc_feature (697)..(697): n is a, c, g, or t
  misc_feature (699)..(699): n is a, c, g, or t
  misc_feature (702)..(702): n is a, c, g, or t
  misc_feature (725)..(725): n is a, c, g, or t
  misc_feature (728)..(728): n is a, c, g, or t
  misc_feature (1013)..(1013): n is a, c, g, or t
  misc_feature (1040)..(1040): n is a, c, g, or t
gataaggatnagagcatagcacccaaaactacccggtnacatacccagccaaagccagggcacattcatcgcanacagccaccagaantcgcnttgttcttccagctggnagatgtgaacactggtgctgtactcactcctcaccagacatttgtccnactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgancccccccccnccctncccannccccnccnccccccccncncanccccaccctccccccccacccanccnacagaacagcacattagttccagaagaaagatggaaattctgaaaactgaatgtcaagaaaaggagtcaagaaccattcacagtatgagaagaaaaatggaaaaaaaaaactttatttaaaaaagaaaaaagtccagattgtagttatacttttgcttgtttttcagtttcccccacacacagcagatacctggtgagctcagatagtctctttctctgacactgtgtaagaagctgtgaatattcctaacttacccagatgttgcttttgaaaagttgaaatgngtaattgttttggaataaaaagggtanccatagga

SEQ ID NO: 590101 - DNA, 913 bp, Homo sapiens
  misc_feature (308)..(308): n is a, c, g, or t
gaatatatttataaataggaaagtggtagctttcagatttttgtttgttctgttgtgtttggagacggagtctcactcgtgttacccaggcgtggaggtgcaagtggaaccatcgtcagctcacgtggaacctccagctccgggattcaagcgatgctccgtgcctcagactccagagtagcgtgggattacaggcgcatgcaccaagcccggccagtttggtatttttaatagagacaggttttcaccatggtgggccaggcgtggtctgtgaactggctgacctcaggtgatccagccgccagggnctcccaaagtggctgggattcacaggttgtgagccacgatgtgcccagcccagatttaaattatggagtaaaagagcacggattttttgtaaaaagtaagtctgtgtcttaatggaaacatactctagtccttactcacattagagaatcgtggttttaatttggtctattgagcaatcaacaattaacttggtatctcgtgactttaaatttgggtaatctgtatgaaagcagtgcctttgtggcaagctttctaagcgctgttttcacgggtcatctgtgttagatagtcggagttaatattagatatttacaggtcttctcatgtttcaaagcacatagtgtgggattcaaatagagttaacttcatggagacctaggatttaagaatgtcattaatggggccaaatttggagcggggagagattttttaggaaccttcgagttggaatttggacctgtgattgtgtgtgccttcagattaatcggggaaagggatgagggaattgggacaaaaggtatgttaacatttttgtggcaaggtaaacaatggggtaaaacacggggtgggggataacaaaatggggagcaacaaacagagaatg

SEQ ID NO: 590102 - DNA, 656 bp, Homo sapiens
caagatcgtaccattgcactccagcctgggcagcaagagcgaaactccatctaaaaaaaaaaaaaaaaaaaacagaaaagaaaaagaaaggtgccagagagctgccttgccccttctaccatgtgaggacacagcaagaaggagtcctccctgaggagtgggtcctcaccagatcctgagcctaccagtgccttgaccttggactctccaggctccaaaactgtgagaaatacatttctgtttataaaccacacaatcagcagggcatagtggcccacacctgtaatcccagcactttgggaggccaaggcaggcagatcccttgagatcaggagctccagaccagcctggccaacatggcaaaaccccttctctactaaaaatacaaaaacgtttgccaggcgtggtggcacacgcctgtaatcccagctacttgggaggctgaggcaagagaatcacttgaacctgtgaggcggaggttgcggcgagccaatatcatgccattgcgctacagcctgtgcaacagagtgagacttcatctcaaaacaacaacaacatacaacaaaaaaaaaaacttgagggaggccccggacccaattcgcctatagtgagccgattacaattcattggccgcgttttaacaacgtgtgactggg

SEQ ID NO: 590103 - DNA, 871 bp, Homo sapiens
aaaagccctgaaagttcagtgttgaggctcagggtggggaccctagagaggcaaaagatgcccagccagatggaattggtggtgtgaattgccaggtctggaaagagcccagatgggggctgcagcatgggccttggttgaagcctctaatcctgtaagggctgctttggcccaagaggccttagaaacccggtgtaagcctcaatcggtagccggtctggcctctttctcacacttaaccgacacagctcttgctctgatctcatcccaagtcatctcgctggaggacaattaactcggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttcggtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgtgactagcagtttttcaaaaatacatatatatgtatgcatgtacagatatgcgtgtatctcccaactccagacagctgaaaatctgccaaaagcgttgtttgccagatttagctcatcggccaggattactcact

SEQ ID NO: 590104 - DNA, 521 bp, Homo sapiens
gccccttaggccaatagaactatttctctaatggcccaagttttttaagagtcataaccgtctagttgggagagaagatgtttttggagagttgaagacttcttgaaaaagttcgaaaagttcttgaaaaagcaaaggatgcttctttcggtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgtgactagcagtttttctcccagtcatagaacgattgtaagaagacgcaccagatgcccagtatcgtcatcca

SEQ ID NO: 590105 - DNA, 330 bp, Homo sapiens
  misc_feature (8)..(8): n is a, c, g, or t
  misc_feature (151)..(151): n is a, c, g, or t
  misc_feature (170)..(170): n is a, c, g, or t
gcgtcgancttctgctctgtagatgaaatagtatatcccacagcccaccacgcagggccccagtagcttcccgggcgctggaagaatctctgctaccaaacagtgatagaaaggattgtctccaaagccatctgctctcagggctgccgangattggagctgtgacaaangagatcagagaaagaggacgtgggtgtatagcccaagcctggagctggtcagccctggggaacccatttccctcaatttcctccccaggcctccgccaagaaacctggggcgcttgagcccccaaccttttcttccactgatcctttcaccttgaatccg

SEQ ID NO: 590106 - DNA, 233 bp, Homo sapiens
ctgcgagagaagaaagaacatttagggacccaggaaagtgtgcatatctagtatttgcctcatgttgaaagagaaaggcagggcttcagaattcactttcattcaggtttaaaaaattcaggcaaagaacatttgccctctgctggattattttgggaaaaatacagattttcttttttctaactattaaagtagaatggaagaatagagtgacaaagagacacagggaaagt

SEQ ID NO: 590107 - DNA, 1434 bp, Homo sapiens
aaaagccctgaaagttcagtgttgaggctcagggtggggaccctagagaggcaaaagatgcccagccagatggaattggtggtgtgaattgccaggtctggaaagagcccagatgggggctgcagcatgggccttggttgaagcctctaatcctgtaagggctgctttggcccaagaggccttagaaacccggtgtaagcctcaatcggtagccggtctggcctctttctcacacttaaccgacacagctcttgctctgatctcatcccaagtcatctcgctggaggacaattaactcggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttcggtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgtgactagcagtttttcaaaaatacatatatatgtatgcatgtacagatatgcgtgtatctcccaactccagacagctgaaaatctgccaaaagcgttgtttgccaggattcagaatttcccacataagggctactcacttcttaaaagacaactcatgaatcaagcacctctgtttgatctttaaaatcaattcctcgactgctaatgggtacacagttttttgtttgtttgtttgtctttggcgggttatgaaaatgtcctggaattcgataatggtgttggttgcagagtgtttttgcaacatcagttcctggcccagttactgaaggtggtaggaggagttaagatctaggcaattaaaaagaatgaaaggcacccattcatgggaaggcctcagtgacgtttcttaagacagtttcatcagtggttttcacaattctctgcatttggtgtttcagaggacactgcaatacgaaacacctgtgggagtgccctctttctgcttctaggaatctgaggctgagaaaccttcctgactctatttgtgtagtttttcggccacgttagcctcattctatttttttttcccccagtatgaactcagggcaggagagggagtggtttcctaataatttttttttttgagacggaatccagcctgggcaacagagggagactccgtccccctgcaaaaaaa

SEQ ID NO: 590108 - DNA, 635 bp, Homo sapiens
cgcaggagacgatccaggagtacagatgctgtgctagatttatcaccccagccgcatcttccagcctcatattgccccttggtgtcatgatcctccctcagcccttatatgagacatgctccagaccaagagaatctggtccggagtaccttgcgttacctgatcctggtagagaaaaaaaaccttctctctccctgggctgaattagaaagtagcagggaagaactctgattggccaggcctgtttcctgtgccctcccctgtgacttagtagaggtggggcctgatgctgtgattgacagcctggttaatcggctaaactcagtaggcgtgtcccatgcaccacaaggaattggggaggaacaattcccaaaggaaggaggttgctgttagcagaagaaaggcaaaacaacctgtgtccacatcatccctcctgccacctctggccctgtgctttcactgcactctgcacacacccccagcagaccccacccgagcttccagggatgatttgggtacttgggtatgggtgactgtccctgccactggacgatgaagtcttaaagggccaagactctggtcaccttggctctcccagccctctactctgtccctgatcataaactacttttgac

SEQ ID NO: 590109 - DNA, 366 bp, Homo sapiens
cttccaagacactcaaataaaagacacaagctacacaggtccatcggaaacctggggccaggtacgcttcctactctagaaccttacatgtcagagaagagtatgcacacaccagggtttcgggacagtgcctggaacatgccacggagaccttctgcagacttaagagtcttcagagcaagtgagattcatacagacccagagtagccccacggcagttcccgttaggttttgccaccacatatccacgccccaaatttaggggagaaaatgaagaattcaaaacgttctgaatttggtacttagaaggaagcgattataaacgtgttcagaggagttcccgtcatggctcaatggaaacaaatc

SEQ ID NO: 590110 - DNA, 101 bp, Homo sapiens
agccggtccgttctatgattctatgaccattggtcttctgagttttgcatttctagagaaggactgggctgaccatgcatcgatgctgccatcttgaaaac

SEQ ID NO: 590111 - DNA, 1858 bp, Homo sapiens
ccacgcgtacggttctagatcgcgagcggccgccctttgggttctttttataggaacttaaatgtgctttattagggcctattttgtaacaataataaattattcctaggaaacccaccctggccgaggtggctccatatctggcggactggctgagtggggtatacactcaaacaccatacctggcactggagtgaggcgtggcttgaatcgaacactcccgaccctatagttatacctggactaagctaccaggaacagcatcttgagcgggctatgcgacgcagataggcgcgccctcacacataggctgtgtgtgacaacctatatatgtatctaacacgtcgttgagcgacactattagcctatcacctagggtactatggcgacgccactatgcgggtctcgacacgtcactattacgcatatggggtgactacataagtgtgctacacaggactttcaacagtctacgcaccatcaaaacgaaccaggggatctccaagcagacccgtgcagggagcataaagtgcgctccatatgtagacaacgccacacgattgcgctacagtgcacaaagggagaaataaccaacatgtagactcggcacacacaacaacatctgagtccatgagggacgattcatctcacacacatatataccagggaaccatgtgctaccctcaacaaacagcaacaaaacactggttcacgtgtgcactactccaacaatatactagcgctcccccaacagggcgtgcgccatagcactattgtcgagcaccacacgcgcctctgcatcacacgctctcacaccaattgcaccccaccttcaggaaccgaagtacgacactaatccaaattgtcgtcatacacagcactatatacaccaaagatggagcaccgtgagggaggctggattttcacccattacgatcatttctagtggccgcagtccccaccaattcaatcatgcacagggattgcaatccccatcaaacttatctagcgagtgcagcgaatcacaccaaacagttatatcatatactgcaagaaagagaaacatccatacatacacagctgtaatgagagttcacccccaccacaaaacggaccccccaatgtgggaggacaacacaccggcttggaaaagcacaccccaagaggcgacacatataaggcggcccaccgacggcagaccactaccacagcaactcagccgggggtactacccccgtggcgcaggcaactcaccgaacacacccagccaaataatcacggcgagcgcagacacagggaagaactccacccagatgaaaacaacgagacagtcaggacgaccatcgcatcagcactacaagacaactacgaaaggccgatacccactgcagaacacacaacataacagtcatggatacagtcaccccaccaacaactagcagcgcagatagacccacccacgagcaggccgatcaagcgccgacccccaaccacacgtagcagaggaatgcacaatgcggagaagtcgagcccacccagcacaagccgccaacacaacgaacgtaactatgaatacgcacaacgcacacaccgctacgcacagagggtgatacaagacaccacacgaagacaactaaatgtagcgccaccactagaagacaagaaaagaaacaccacaatcgagcacacacagcccaacaagtcagcaatcgaaacatagaatagatatgcacaacacagaatcacacacaacgaagcattctacgaccagccagagcataggtcctacacaagaacagaagcgagcagcaagacccgcagaaatcagacacctacacaagtcaacaacaacactcat

SEQ ID NO: 590112 - DNA, 332 bp, Homo sapiens
ctagaggatcccggcacgtgtgtggctcttgcgggtggctcatgggcggggcgcgtgtgtgtctccttgtgtggctccttgggtggctcgtggggcggcgcgtcgagtggcgcttcgggtggcgcgtggtgaggctcatcgtggggctcattgcgtggctcgttgtggagtgtggcgagtcagctaaatactttgacgccggtcgggatagcgatgattatggtagcggaggtggctcttcgggccacgcaaagagcacccaacgagccacaccaagagccacaccaggccgccacgcaacgagccacacgacgggccccgcaaagtgccgg

SEQ ID NO: 590113 - DNA, 338 bp, Homo sapiens
ccgggtgtagggagtgaggaatgaagagaggttggttattgggtacaaaaatacagttaggtagaaggattaagtcctagtgttcaatagcacagtatggttacaagtgttagcaataatttattagctatcagaatagctagaagatttcgaatatttgcaacacaaagaaatgataaatgaggcggtggatattgtaattaccccgatttgatcatgacacattgtatgcatatatcaaaatatcacatgtaccccacaaatatgtacattatgtaccaaaaaaaaaactaaaataagcagcaaaaaccacttccagctaccacggtgctataacg

SEQ ID NO: 590114 - DNA, 686 bp, Homo sapiens
  misc_feature (4)..(4): n is a, c, g, or t
  misc_feature (503)..(503): n is a, c, g, or t
  misc_feature (579)..(579): n is a, c, g, or t
acanctccttcccgcaagacatcacccttaccgtcaattccatatccctctcgccaaatcggtaagttagcaccacccggcatccgaatgctggccgtatgccgcatcatgcccacaaagaatgctttttccaagaagagttgattccggccagaccagaaaaagctcacatgggccagaacatgaggtcggctttcgcctcgtactaaaagccctccttcaagtagacttgttacgtaaaactcttgccacacaggaacaatgttcccagcagtacgcaaggcaaaacgcagcggtgctctatagggacgtagcaggatgacatgacaatcaaaaaacaagctaaacctactgaaacacttttgaccttcgaggttttttcaatggtgagctgtttcaaaccgtcgagttttccagcctccgcaaatgcaacaactggcgcgaaaatagccttgggcccctagtgttttgaccacctgacgttgacctgtgcggaacagggnagtaaaagcaagcattcgctatgcaaaatccttaaattccgctagaaagcgaaattcgaagtaccactgtggaatngagctttgatcgactcaaggacagaaaattaagaaaattcgccgcagatactccgataaaaaaataaaataatctatttaatcaatcagttacgaaggccgttagag

SEQ ID NO: 590115 - DNA, 115 bp, Homo sapiens
ggacctgtcgcatagtttattcttgctgctgctgattcttctcacgtgtgcgcgccttcctcctgcctgagctccagtatgctttcgtattttgcacctcttgcttgtaccgctg

SEQ ID NO: 590116 - DNA, 892 bp, Homo sapiens
tagtttctttttttaaggtatttcttcttttagttttgtattttttttttgttttggagtttttttctattaatgtttttagattttgttttaggatgttttttggttagttttttattttttgattttttttctatttttgttgggtttaaatttttatgattttggtatttctttagtaatgtttttttttcgttgttaatttggtgttatttttttctcttatttgtgtattctatttttttttttgtgtatattgattcttcgtacacttgttaccgatttgcggtttttttccacttcgtcgttttcttctctttgtctacagactctgaagcatgttccttgcggcggctggctcctacacgcttttgggtagtttggttttatgtcactgtgttccgttagtttctgttaatttatagtataaagttctgttgcaaacgactgctgttggattctgagggtgttgaggtgagagtgagtggaggtagagggatgtgaagagcctgccctcctatatggattcttcagggccctccacatctgaggtggctcattcccatcacacacagattgtcctggtgttcatttcaaggccagtgttcagcagcagcgtttggaaagcatgttctgtgggacccccctgccccgccaacaccgcactccctcctaagcagcagtagtggcttctccatcctgttttctgcaacattctatacaaaactgtgctggaccttgcggaggcatggatcggcaaagagaatacaaatgaaaccccattcatttctctttcagtccaacaactctgaccgcgtcttgcaccattacccctttccacctgtgtattaattttaagttcagtgacgcaagtactcgaggcagatagaat

SEQ ID NO: 590117 - DNA, 278 bp, Homo sapiens
atgtccagatccatgccctgtaatctattccacagatcacggatagccagtatcgtgctcatagttatatgtgatatccatgaagaagattctttgtcgcatgtaaactgttatttctgttacttaaaaagtattgtaagtgggctattaaacttggaatctacttatgttgatgaatgcagtatgttctttttattcaagtatgaacttggagagaagactatagtaatatgatttttaagagatttatgttctacttaaactgtgaattgtactaa

SEQ ID NO: 590118 - DNA, 114 bp, Homo sapiens
cgggatcccctggtagtatcgccggagtgtgcagcacatcacaaaagcaataccctcagcgaagcgcttgagtggtcatagttgacccagtaaaccaatacagaaatgtctgtt

SEQ ID NO: 590119 - DNA, 568 bp, Homo sapiens
cggaatgccaatccgaaggcttcccaaatcagcccgcacatccattctagttttctccgaggggctaattcgacgagggccggagcgctaccggcgaccctccaacatcctaccggccaaactattaaggatctttgtataaatgaatgcggattaccttacttgacttccgggcttgtttttaccctcttatctaactcctggggtactaagtccgaaaacctaagagattaattttatctctaattgttatttgataacgcgcggaatgctagctaggggcggaaacatttttatgcgtcccttttgcccgcgtacgctcttaaaagaatcgatagtaattaaggatccctactaacgccatctctaccgtgacgttaaaaagacgctttgattatccatttttccgaactggtccgttccttggtagcttggattagcgtttattaggttgtaagatgcagattcactgacgctactgtggcgggatgccgcgggctaaataacttaggaggtctcgatatgtaatctcgactctaagagccgactatctagagtcggaatatct

SEQ ID NO: 590120 - DNA, 610 bp, Homo sapiens
aaggagagatgccccaagaggaaccaaacctcatgacactatgatcatggacttctagtcttcgatactgtgacacaatcaatctctgttttttcagccacacagtctgtggtattttgttctggcgagccccatagcctgactgtggatagtctcccagtggtgaaggtgtcactgatgggccaggcagagattcttgttcccagggcagtggctcaggccctttcctgtcttactggcttttgcatgtgatactcatgtcagtaggataccgtcctttattgcttcacatatcccaaatcctacctgtcgcttccaactggaaagggtaagcaccctacactaacgtggtaaaactgcgaatcagggtctaccgctatgttgcactcaggctgacctcataactcctgaccggcaaatgactcctccatgcactgagcctcaccaagatgtctgggaatttacaggacaccaatatagcgggcaatagttatcagcaaagatagcagctgcttggtttgtcttatgaagtttgtgtttagctttgttgtgccatccgtgatactattcttctgcaatcacttttgcctaaaaaagtctctgtgggggg

SEQ ID NO: 590121 - DNA, 547 bp, Homo sapiens
tgggggagacatggtcggcatggagcggagctccgctggctgacccgagcgctggtctccgccggtgagaccctggggcatggagaggtctgaggtacctcggtcgcggcgcgacgctgctagtcgcgggacgccaggcctgaggacgtgagtggtggcgggctccgtttcccgtgaccatgcttccggtgagacggtgtggggcctgagctgatgcgacgccgtcaagggaggtgttcaacggctgccggtgtcccagtggagttcctaaggagcaccgagctgagtgaggtgcacgaatatggcatctgaggatgaacgctggagcaggtgctgagttccatgaaggagaagccaaagttggcatcattgggaagattcataccccgatggagtataagggggagctagtctcctatgatatgcggctgaggcgtaagttggacttatttgcctaacgtgagtaccatgtgaagtcactatcctggggatatgactcgggacaacaagctagaccgtggtgatcattcgagagcagacagaaggg

SEQ ID NO: 590122 - DNA, 285 bp, Homo sapiens
gcaagacgtggaggtatttcatctgttcgtgtctctgggtatggactgtccatgtaaaccccagcataattacatgcagacctactgaatagtcagtgatccatgagttgaacttctactccagaactacatgagaattaagggtatggtggaagcggatctacgtaatatctggtgtaaagacagaatgtctggcatgtggacaccctagagtgctcaggcggagcaagcccatgaagtgcggttcgtatagtccaatacactctgtcctccatcacatcatgg

SEQ ID NO: 590123 - DNA, 1582 bp, Homo sapiens
  misc_feature (145)..(145): n is a, c, g, or t
tggggtagtaggggtggacaggtgattttatcggaatgtgggagggtgatctcctagggggttgtgttggactcccgatttcggtgcacagcaattacggagggtggaggtgcgtgcatagggcgtgcaactacagtgaagggcnaagagtgaaggtgaaaggtaaagaactcggtgttgacggggtgggcacgtgctcttacgtggagttagcccctccctcgagaatttcattgtgcaaccctaggtctcttgctctccaatgtgttgtggggctgtgggcggcaactagcctcacgctctgggtacactccacccgtggggacctctcctcgagcactgtgcctcctctggggcacctcccacgcggcgagcgccccccatataggccctatatgtgcacacggccgcggtgcgcccaacataagactgtgccaccacacacaggacgcagaatacagttgcccagcaacttgtttctcccacgagattccccatcgcacctctcacgcagaacaaacgcgcatctccctggctacacaatactacgcggcctctcggcccccgcgacaactgtgtgcttccggagaacagcacgccgccacccacttcaccacgcacaactcacctgcgcacgcgcgccaccaccacgtgagcgcggcgttcaacccagcgctcatacatccgcacctggcacctccccaccaccccaccacaactcactacccgctctctccacacgatgcgtactccctgcccgccaacccttagcaacagcaccaccacaagtgccccgagacagacaccgtacgtcctccgagtcagaacaccccaccagcgaccacctggcgccccacgcaggaacacacaacacccccacggcacgaccacaacccaccggagaaggcacaaaccaccgacgcaccaaaccaacacaaacgacaaccacaaacacccacaacaacaccccacaccaacgtccgccaacatcctcaccaacaagacgaatagagaacaccagcagtccacaccataaacactgaactctgataatcacacacacacataccaactctcaaagcaacgagcaaacaatattgctcgtctacttgaacaatcacaacaaacgcgagataatcagaagtgcaccgtccccacaccactccacaccacagcagcactacacgcacacatgccactcggagctacctcaccataaccccaaccaccctgcaacaccccacccccaaccacccgcccaccctcctccatcccagcctcacacaccacacaacaacacacaccacaacacactaaacacacaaaactcccaaacataacagccatcccaccaccttaacacataaccactgccacaccttatctcccatcatataacttctccccctatccacccacatcctcaacacagaccacaatacaacacaacaaaaacatcaaccatcactacacaactacaactaaaacaactcaacacacatccacaccaccaacgcaaactaaacaaaatatctatcacaccaacatccatctctcactaatatatactcgacatataccc

SEQ ID NO: 590124 - DNA, 396 bp, Homo sapiens
  misc_feature (11)..(11): n is a, c, g, or t
  misc_feature (25)..(25): n is a, c, g, or t
  misc_feature (40)..(40): n is a, c, g, or t
  misc_feature (61)..(61): n is a, c, g, or t
  misc_feature (125)..(125): n is a, c, g, or t
  misc_feature (176)..(176): n is a, c, g, or t
  misc_feature (185)..(185): n is a, c, g, or t
  misc_feature (231)..(231): n is a, c, g, or t
  misc_feature (241)..(241): n is a, c, g, or t
  misc_feature (260)..(260): n is a, c, g, or t
  misc_feature (288)..(288): n is a, c, g, or t
  misc_feature (296)..(296): n is a, c, g, or t
atatttgaacnaaatactgccccanaaacttcacaaactngaatttgggaaattcacaaanatgtggaaattaaacaacacactgttaaataccccggatatcaaagagaaatcacaaagtgcantctttgtagttgttagaaaatcaaagaaaggccccaggcgtggtggcttanacccgtaancccagcactttgggaggctgaggcaggtggatcacctgcagtcaantcaagaacancctggccaatgtggcgaancgctgtctttactaaaaatacaaaaaantggctgancgtggtggtgggtgcctgtagtcccggctactccggaggctgaggcgggagaatcggttgaacctgggaggcggaggttgcggtgggccgggattgtgcc

SEQ ID NO: 590125 - DNA, 356 bp, Homo sapiens
tgtggtgtccgtccatggtcatcttggaagctgtgggagtctctgctttctccctcctcttcctcctcttctacactttcttcatcttcttcttcctcttcttcctcctcctcctcctcttcagggtttgctattacttctatatgaactgtgtttccttctacttgttctgtctcctcatcactggccatatcgttcccaatcatccaatcaagactgctcagaatcttcttctacttctggttcaacaggaggtgatgtctcttcctttgctggtactccttgcttgggttgcattgccgttgactatgactgacattggattcaataaacaaccagattttccgtatggatgc

SEQ ID NO: 590126 - DNA, 158 bp, Homo sapiens
cagtacggatgtgctgctggactgcgccaggcgtatcctggcagagggaggggccccgtgccttctaccgcgggtatcgtccccaatcgtgctgggcatcatccccgtagtgcgggcatccgacctggcacgtctacgaagacatctgatggaaactg

SEQ ID NO: 590127 - DNA, 1184 bp, Homo sapiens
gtgctatgaagtggtgatgaacagtatgatccaccagttggatgcacctctatatcagtaacaagattgcacccaaagattatagagacaactggagttcatgtttcagacgtatgtatgagcacgtggggagcaacgtgctaacagattatcgctcacccatggagtgaacattatggataatcatagtcagcactgcaaaggaccactggcactcatgtaccaacacaggttactgaagatcgtgtccagtcacacatccttcacaaactttggaattcaggacagacaaacattcaaagccatcttgacacacagtatcttgcgctgaacgctacgaagggcaactctacatggcatggcaactgactatgccagggccatgatactcaggcacacacacaactatgcacttcgtctcaatggcaggcagtactcctgttgctcacacacaaccactagctaactatcccgcctcgacgcgcaactcccgccaccacctacgtactacccggctccacacacccgcggcacacactgtcacgcacacgccccaaccactcgcgcaggaaaccataactggaacactcggacaccaagacgagcacctacacgtaatcgcttcagcgaaattctggttcgcacctccctcccgctcctcagggcccacctctcccacgcatttgatctccgataccctcaattcggcgtacatcgacacgccccccactaacaggttcatatctacatccgggcaccaatttttggtatacacgacctccggcgtacgccaatcgcccctttcgcatcctcccttacaaccttggccctacaactcaactcccatctccggcgtcttatcacctggacctccaactttcaccaccggcactcctcacccaaaatccgtaggcccacttctctagccttgtcccacaatcacctcagttcagtataacggaaccgcatgcaaaaccaccctccgccctgctacaccaatatgtcgccctcgactcttccgcgttagtaacttatctacgtgggcaactagctcctgctccatgcctcagctacactcacgctcctgtactgccctcctaaacattcccgtcatcaaaccacaataagattatgtgcagccactgactcatctcccccattaccgcgcttccaacagcaccagc

SEQ ID NO: 590128 - DNA, 1012 bp, Homo sapiens
gaacaatggctaggatcaggccttgtttaattggacgaggactgctccccgctgcgcctcgccatggctggcggccccgggctcatctcggtgttctcgagttcccaggagctgggtcctggccgctagcgcagtggtggcccagcgcgcagcatgctgactggcagttggtgcccgcgcccgtttcgcgctcggttgtcgggctgggagcctcgtctcgatgctagcccggagctaccctgcgcgtcgccctgcgggccagtagcttagcgctgctggacgcttgggcttctgcgacgagcgcctcgtgcccttccgatcacgccgagagcacggtactggcctctacctggacgcatcttctctccagactgccgatcccagaaatgccaggtgatcaccattaaccctgagctgcctgtggaggaggcggcttgaggatacgccaagaaggctgagagcaggcattccaaggggatccatcccggtttacgacctgctgatcctgggggtgtggccccgatggtcacacctgtctcacatcttcccagacagcccctcctacagggagcgggagaagatgtggtcacattcagtgactcaccgaaggcaagcgcacagcgtggttgaccctcatgctacctgtacctgaatgcaggacgaactgtaatctaatgtggcaactggacgaatgcaaggaagctgtctgaggcgcattattggagggacaggaggaacaaccgatgcctgacgaactgttcagcgccgagagagggaaaggtagcatgttcatatgacgaggaggggcagattcattaacgtgccttgaaagaatcaatttaagtggcagaaggcgcggagtggacatgtaggggccatggtatggccgtgatggcggatatcaggaattataaaatcagtgtgagatatgaagacggcaggaaagaacggaaaaaagtaggagaaacgataaagagtcgaaaaaaaaaaagagaagaaatatagaaaaaaa

SEQ ID NO: 590129 - DNA, 331 bp, Homo sapiens
  misc_feature (39)..(39): n is a, c, g, or t
  misc_feature (47)..(47): n is a, c, g, or t
  misc_feature (52)..(52): n is a, c, g, or t
  misc_feature (67)..(67): n is a, c, g, or t
  misc_feature (73)..(73): n is a, c, g, or t
  misc_feature (184)..(184): n is a, c, g, or t
  misc_feature (246)..(246): n is a, c, g, or t
  misc_feature (271)..(271): n is a, c, g, or t
  misc_feature (288)..(288): n is a, c, g, or t
  misc_feature (300)..(300): n is a, c, g, or t
  misc_feature (329)..(329): n is a, c, g, or t
ggcagcctcgtacgggacacgatcgccagggtgcacggnaactttcngcgcncctggctccatcggncttcgngggttcgatatctcaatgcctatacttgaatagtgctacttcgatggcaggaaaagaattctattcagcttgtgtgggtcaggctcttcccttcatcacatactttggagnaacaaaggacaccgttgacccatggctttttcaacacattaacatgtggggagggtacaatnaggaacatgttcaggaagttcctantttcagttacaacaggnggacagctgttngatcttgtttggcaggaactgcactggangg

SEQ ID NO: 590130 - DNA, 255 bp, Homo sapiens
aacgagggaacaccatctcccgggataaagagagttgccagccgcagaccaaaggaacttgtggtgttgcagagagttaatgtgtttctaagataggataatcaacacataagatttgtgaaaattgacctgctaatttgaactgcctattgtggctggacagtgtcattggggaaatatgcctgagaggttaattaaagatggcactaaacgacattcacacgagattggatttcatattaactcaatatttga

SEQ ID NO: 590131 - DNA, 240 bp, Homo sapiens
acttacgcagataagagtatgtctgtttgagaaggaagcatcatgtttactcataaaacacaatttcattccttgggaatttttctctctgctgtgtgttaggtaagggctgcagagaaataaaggtacctcacatatacacacctgaaactatctgcagtgtccacaacgtatcttgttattattccaaattagattgtgacttaaatctcgtaagttgctccggggtacggagctcga

SEQ ID NO: 590132 - DNA, 86 bp, Homo sapiens
  misc_feature (3)..(3): n is a, c, g, or t
tcnccactgctcaaaatgtaatgcaaacatgaactgacttagttttctcaatgttcaaacttgaaataaaataaacattttgttcc

SEQ ID NO: 590133 - DNA, 119 bp, Homo sapiens
actgttgtataaatttgtgctggtgctgagacaagattgcggtaggtcagtctagagcacgagaagcagaatctggagctcaagcaccatgcagaatcctagcaccagcacgaatccct

SEQ ID NO: 590134 - DNA, 1199 bp, Homo sapiens
tgtgacgttttaaaaaaatagagagaattaaggcttcccaaaaaagaaatggggaggaggcagatggatggccgaggtgtggggtctgggaggcaagtttggccgtccgaaagctcggggtcccgggggatagacacgggtctcgtgtggcgcaggacacagcccttgcccaggctgtcgcccatctaccggtctgcgctgtacccaatggggcacagttgtgtcaggcccagtctggccaagtggagagggccaccgatagtggcagctcctgaacctcgtgctgcgagaaaccagggcgcgcggtggcacaggctgtggcccgcaaaggcctggcagctccccccacaggcccacgtgcccacagcgttccagaagcacccagaggcagtcggctctcagcgagcgcaacactcgcgcacacctcgtcgctgtgagcacgctacgaactcccggcgtaccacatcggggtgattcccccaatcatgcgggccccctaccacgcggtcaccccccccaccttctgtgatcgcgcatcccgcgacggaccacgcacttccttcccagaacggcgctctccggtccacaggacgcgtactcccccttgctccatacgtcgctcccactgcggccacacaccactcgcgcacacgccactagaacacccccaaaacacacgggcggcgacacaccactcgctcggcgccaccacacgtagccccaactactacgccgacgccccacccaccccaatgacacccccctcactgcctacggcaacaacgcgagggtctaccaacccgcctcgccccctgacaaagcgcgcggccatcacgccacaacaccacaagtcccacccccaccaccacctcgcgtatcgtcattctgatagctgttgtttcgagcccacacactgcgatgacataggtcttcgagatggtgacaaaaacccctccctcccttatcggctgtcccccctccatcaccatgatctcgcacacttgtgatccaaacaggcagagaacctctctctctgttgtgactccacacaactctctccctgttctgatcaatttcaattgctcctcagcatccttgtacactctcacttgatctctatgactacaccgtgcctgtgtcgctactgaaccacgacgcgccgctcacactaacctcctccaatctatcttcgtgccccc

SEQ ID NO: 590135 - DNA, 882 bp, Homo sapiens
tgccttcgtgagctcgagattctgtacttgtaccaagtgtttgtacgaaacatgatccgatcactctcttctcagatatccgaccgacttcgcgatacctctcctgatatgtatccgtccgggcatcatcttttcgcgtcatatccttcttctgcggaccttgcctataacgcgaattatgggggttaagttcgcttttattgagaatctagccagtgagctcccagattcgggcagaatttattccactcgacgtgaatggcagccgtatataggcctggacaatttgtatctgcatagacttatacaactagcttctctctggggttctattaccgactcgtgatgatcgtggctcttggaatttgcgtagagcacacttatatcccggaattgagccgagcagacgcgcgagagtaatgagcgtctcctgaagatgataaacagcgtggtgacgagaacttatcagcgaggttcaagaagctaggctgaacgatgccgtggggtaaaacccctgatgctatgaaattctgtcgatgcctatggaataaaaaaagttagagaccagggccccttgcgggatctttcagtgcccctgcagttattggcccagaaaggatccccattctctgtgatatcctgcagaatcattcctaaatgaggcagtgaacggtcatcgagagattggttgcactctggcaactaaccagggtgttgccccgggttaggtggccgaattctccagaaggtacctctaaagagaaaaagctttgtacccgaatttgtcggccttgaagataggtgttgcaaccctccgccacaaaggggtttatctcccagctggcccggcacttttgggacaaaaaaaatgtggggcagaaa

SEQ ID NO: 590136 - DNA, 260 bp, Homo sapiens
tgctcggtaccgtatctctaacattacggaggtataatcaacaggcagaagctgtacgtgtttaaagtgtgagatccaacacttttttttgtttagttttgacacggagtctcgctctgtcgctcaggctggagtgcagtggcgcaatctcggttcactgcaatctccgcctcccgagttcaagcgatcctcctgcatcagcttcctgagtagctgggattacaggtgtccactaccacacctggctaatgttagagata

SEQ ID NO: 590137 - DNA, 160 bp, Homo sapiens
  misc_feature (155)..(155): n is a, c, g, or t
tagaaaacaactgtgtttaatgacaatcctcagtttaaaaaaaaaaaagaagaagaaggtttatacacactgtacacacatttacaaatggctttggaggatagcagtctgcgaaaagggcttcaggaggaccagcctgggcaaggattgaggtntgttc

SEQ ID NO: 590138 - DNA, 1088 bp, Homo sapiens
  misc_feature (655)..(655): n is a, c, g, or t
  misc_feature (825)..(825): n is a, c, g, or t
  misc_feature (871)..(871): n is a, c, g, or t
cctgctgtggcatgaaatcgctttaagcaagaatagcgaaggaatttcgcagagctgagagatcaagcgcctgataaagaggttgtgcaatagatgatgctgtacgataagggctagggagtggaaggttatctataacaaagcaagagcactatcgacagaggaatatgaggccccgatagtacagcatacctgagaaattccgcaactgagcgaagggactggcccacaagaacacatgctttggcaaatcgtgtcctcactgtacctctgcgacgcaactccgaagaatcggcggatgcgtgccatcctagaatctcgatggaggtgctagtctagatccgtgccatgttgacgcccctagaaacgagttccgcaaacggatgtatgccaccgtattcattcagccatatcctgctctgagaatccttcccaatttgtgtaaccctttgtgctggaatgtcttccaatcaataacggacttttctgaattttaggatcatttagtcgtggaaaggcgaggttttggtcatgcacgcaccaagtaattttaagtgttggcctacttggggggggcgataccccctccgaaatttgcgtttggagacgtacgattgttacatacttcgaataaccctaagagtgcttaatcganatgagcggtcggggttgtattcgggcgaaaatattcaaaataaagtgaagagacgacaagtttgtcttctttgaaccagaattagaacgccgttatgcacttgtgacctgccgaagtctacctttttgccgatacctaccccacagggccacatctatcttcctggcaantgcggcaaggcatttggggacttccattgcattgatcctatgactngttcggtaaacatcctgtcttccaaacgatgtgccaatatataccattccatgttgggccctttctaatattacgtcttcatgcccatcgtatgtgtggcaattggctgaaaaaatgacccaccgctttgcgtagaagggggcggaaatatctggtgacagggcaggaaccagatcaacaggtttaattgaggaagaatgacgttaaggcgtctaca

SEQ ID NO: 590139 - DNA, 1476 bp, Homo sapiens
ccagtgttgcgaaacaaggggtttttccacagcgacaaattgtttgttgcacacagagggggccactaaagatgttgtgttgcgtgttgaagcaagagggtgctggaagaaaacaaccggtggaagattgttcacacaccatccttgggcaagattttattggcttgtcgttcaggcaattttccgggcccttcccgttcttttaaggggagccactcacccggagttttgttgccacgcccctggggccagatgcctctcttgggtaagtacccaacggatgaaaactttaaaattatagtcgtgagaaagatggaatccccggaagagcactgcccctcgtgcagaacgtaaccgtaggggtgttgttgtaatccaaaggccattaaatgggaacagagttcgttgtgtgtaaaggtaagaaatagtgttgaagagccaaggacgaccattgttggcgctggtgcgactaaatgaaaaggttccctgcctgcgcttttgagaatccaatgttgtgctccctgttgtggacgccaaatcgaattgtggttgagagaagggttttcttcttctcgtgaaaataagggggagttacaattagtataaagccgcccaatattagaaatgggggaaccagaatctcctggccaatcatatcaccgggaaattgtttttgtcccgtttcgccagtaaacgatactccatgatagaatgattgttaccagaagctttggaggtgggaggggtaattctgctctgatttcaccctttgaaactgctgcaccagtgaaacattacttttaggcccgtattaaagatcccccttacctttttttttttttttttttttttaaagaaaaggtattattttccccaaatgaagcaaagcaagtactggggcggagtcatcagaaataccttgggaggtggtggggaggggagtcgaaagtcttgcgttttccatcactggtgcacaaagaactttcccaggaatggccagtggcctttcgcccgtaacaaggccgcacgctcagagcagtcttccttctgggctgggtggacccggaggctccaatgaaagcctgctccgggaccgcttggctagcaaggcaccccgaggacaggacgacggcgagtatcagtcgtggcttcatacttgtgattaatgcccctcttggcttcttggcccggctccacaatccaccggagattggcccgaagcttttgctcaaatggggccatctgcttttaaaccgaaaggcttatgcctgttattaccgtccccggcgggtcccccctgcactccgacgcccgttgctaacccaccccaagccccttgcccaagccccgggccgccaacctggtctaagtcgttcgcgggcttccttttttgccccacatttccgggttccggcctttttgagggaacccttagggttaacgtggattagggacaacccttgccctttgcccccc

SEQ ID NO: 590140 - DNA, 143 bp, Homo sapiens
cccaacatgcacaggaatgctacatgatggccagctgcttccctcctggtttctcatcccagggccagctgctcagtacagcaaaggtggggcagggcatgcattttcagtcaacatccatgggggcattttcattggcattt

SEQ ID NO: 590141 - DNA, 819 bp, Homo sapiens
  misc_feature (555)..(555): n is a, c, g, or t
  misc_feature (567)..(567): n is a, c, g, or t
  misc_feature (593)..(593): n is a, c, g, or t
  misc_feature (595)..(595): n is a, c, g, or t
  misc_feature (597)..(598): n is a, c, g, or t
caggctcagagaagacagcacaggctgactggaggaaattcacaaacactgaagggcatcgtactacaagtttcttagttgttagactggtattctattcatcacactctgcttctaaaaagtaaaagcatcactttctgtgatccaggtcatttcccattcatgttatcctatttgaaccaacaactgcaaaggtgagcagcctccttttatggagcagaaggccaaagcttggaggatgtagattattgctgaaggataccagattggtggcagagtctgaattccccaggacttaaccatggtgtgtccagctcttcttacagaaactctcaccatggccaatgtcagcacaaggctgaggcccttactagagtcaggtcattgttggtgatcctttaccccaaatctcagaatctcgagatttgctcagaccctgtgacatcatagctaccctttaccttgtcgttgattcttcatttagtatttcttttctatagttaagttcttgtctctcccttaaaaaaaaagatacacacacacacacacacacanacacatatatanactataaatatattggttgtatattntngnngttacaaaggggctcaaaacacccaactatatgagcgctgtgatctattcttctgtgcatattcgtgtctgtcatatcccataaatagaacatttaggacacttcttttggcaaataactgaatattctcctggtgtgtgaaatatccgttacgggcatcacgggtgacgatgaactcttgactacctgccatattccccggttggattccttcaagaaca

SEQ ID NO: 590142 - DNA, 117 bp, Homo sapiens
ctctgaccagcaccatggcggttggcaagaacacgcgacttacgaaaggcggccaaaaggggagccaagaagaaagtagtttgatccatttcctaagaaagattggtattgtatggt

SEQ ID NO: 590143 - DNA, 484 bp, Homo sapiens
  misc_feature (37)..(37): n is a, c, g, or t
  misc_feature (472)..(472): n is a, c, g, or t
  misc_feature (476)..(476): n is a, c, g, or t
aacccaaatgtccatcattggatgaatggataaacanaatgagatagagacatacaacagaatattattcagccttagaaaggagtacaattctagctcatgctccaatgtggatgaagcccgaagacatcataagtggaataacctagacacaaaaggacaaacactgtatgattccacctttgtgtacctagaatagtcaaattcagagagacaagaagtagaacagtgattctcaggaactgtgaggaggggaaagtaggctgttatgtttaatgatttcaaagtttgggatgatggaaaagttctggatttggatagtgatgatagttgcacaagaatgtgaatgaacttcatgccactgaactctacacttaaaaatggttaagatggtaaattttatgtatattttaccacattaaaaaatgaatggggtaaaattctacccattcctatgaaaagatttcaaagntatnattagggt

SEQ ID NO: 590144 - DNA, 349 bp, Homo sapiens
gacaactagactctagtcggatgataatcttatgacctctaaccagcgtcatattactctgttgccatataattggatactactatactttgtcacaataatcctgactgtgacagaagggctcgttaactcctcatctgatgatggtatgcactcacattctgagcgtaacataattgcagtaccgagtatgacgattgtacaatcgtcggatgttcatctctacacactttactatctgtaggtatgtacattgacagcattagatcattctatattatgtcatctgatcccgacacctgatgagcataggcattgaccgtcagccttggccgtcattatcttcctg

SEQ ID NO: 590145 - DNA, 1556 bp, Homo sapiens
  misc_feature (254)..(254): n is a, c, g, or t
ctcctctagtagaagcttgggtagctcttgtggaggcagaccaagagggaatggaagtggaggagatcaccacttcgagctaacacaccaccactgtggggacagcttttgtagagagaagagtgttttcttacttgctgcatctcctgccacacacgagggtcgttcctatagagaggtttttggtgctcactttgcttgccaccagcacccaacagcgagaagtgtttggggggagcacgccaacaacaaantgccaaccttctgtgaggagtctaccagattacctctttcggtggaagtaactactggtggagagatgttgtggaaaaagtcttgtggtggtgcttcacaaagagttgggggtttctttttgtcgcgcaacatgactcttctcataagagggccctctcctctctgtggggatctcccacgaagtagagtttgtatatagaaaggtgatatagtgattgggcatcaagaccacacacacgagggggaggttccttagctgcatgtatcgtcgggcagcgcccataacacatcatcagtggggagaagatgtgtagtaaaaaattcgtcgtgcccagtagagataataggtgtccaccacaacagagccaccacatgttattatgggtcctttgccctcgtcattgctcctcccgtggggagagaatcttcttggaacacccaacacagtgggtggtatacaacgaagcagccagcgggggggttcctcctctggggaaccacacagggcgctgccacaacagatcagaaaagggtgtgctactaggagaggagagttaatttactcctccttggggatgagggtcttcgcacaacagctacaaggtgtccacacgagaatggtggtttctcctcttctcattatagagagagagtgtcgtctgtggacaatctcactttacacgggggatatgtacgcttttctctctgggcggcactaccgccaacagtgtctcaacacacaatgtgtgtgtgcctgtgtgagagagatatgtagaggcgcaaccccacaaaggcgcaccacgtgattcgcaccacacacaccctcacagcgcgcaaatctccggagagagaatgagacaccctctccaagagagagaaagaagacaccacactgtctcacacacgcacactcaagagaaggagcactcctctctgcgaacacacacccaagtgaccctcggcacaatgcgccacaagcacacccacgggtgagagaggcgcacaacacgtggggcacggaaatgaaggcacggcagagattgccaccacgggattggatcccccgaggccaaggaaatatgcggcttgaatcccaagaactctggcccccgaggcacaagatttaaaggtttgaaggaaaacattttggcttttgaaaccaaatatgagaggccactctggatattcacaagtgggtttttcggggtcccagacaaaatgctgccctcccccgaacactggccaaaccccacactttggctgacgcatgccccaattatactgagccccccacatccata

SEQ ID NO: 590146 - DNA, 176 bp, Homo sapiens
ctgtccttgctcatcacatacacatgactttatacatgcgtgaaaatgcccatccagcgcgtcttcccgagaatgaacataacagatgaaagttcatagatcaaggaagttcttttcaagtccagataccgagatcttttcagttccactaataggtttcaagaagcaggaactgg

SEQ ID NO: 590147 - DNA, 1187 bp, Homo sapiens
  misc_feature (77)..(77): n is a, c, g, or t
  misc_feature (197)..(197): n is a, c, g, or t
  misc_feature (274)..(274): n is a, c, g, or t
  misc_feature (361)..(361): n is a, c, g, or t
  misc_feature (393)..(393): n is a, c, g, or t
  misc_feature (560)..(560): n is a, c, g, or t
  misc_feature (647)..(647): n is a, c, g, or t
  misc_feature (843)..(843): n is a, c, g, or t
agggctgtggaagagaacaaggctactagagaataacagaaaaataaaccaagaaagcagaccagacaataagcganaggacagaagaacaccagccacagacggaactcaaaggtactgtgtcgctcgcaggagtgtcgcacccgctgggctcctgcctcgctgcgcccacaagttttggtgtgaacgagcaggcngtgaagtactctcccgggacgtgccttacatgaaactggtcgtcagaaaagctctgagtacacccgcgctgctgcgnaccagcatggcccgccaccgttggaccccgtgcgccctgcgggcccgtgtgtttctcgcgtcccctctccggggccccatgtggccntcgccgtaggtggcgccgtgtttaatgggcgntccccaccgccggctctcaattacaagtcaatcggttctcgtgtgggttggtgaaaagcacaaccatgtggcgtcgccgcccgttgtctcgcgtagaacaccctgtggagcaggggcccccaaagtctgtccaaaggttcgtgtggggggacgcatgccccacctgnttatatatggggctgccctcgggccgaaggcccactcactcgggtcgtgtggcagcgctgtcttgccacaagcttgagcaacacccnatggtggaagccccgcttgtgcgtgcttggccgataatccaggaaacccaacacccgggcggctggagggtgtcaacacaaagccactgcgggcaaaaagcacctgctgggcagtgtggcaccagagtgcccccaacagtggctccgccacagatcttccgacagggcgcccaaggcgaatcgttgttcgccgctncgaagcgtgcccccgccccgcaccacaataacacgaggcggtggaagcaccggcgttcgcaaaaaccaggtgtgtgtcaacaacgcccactcatacaatgtatgcaatttacagaacaggtgtgttgacagagacacccaaggctttgtgctacctccctcagatagaacaagcataaacttttttgagcacaccaccagtgtttctatctctgtttcgagcaggcacaggttttcaaataactagctatttaaaacaccatcactgtgtgagtcaggacccagggccccccaaatggtcgaccaaaatgttagaacccatacaaaaactcaacaaacataaca

SEQ ID NO: 590148 - DNA, 953 bp, Homo sapiens
aacgcagcgacacacgcggagaggagaacggaagactcagaccgggggtgacccgccggtgtgctccagcagaaacagggcccagtggaagaagaagtgccgggagccccggagttgtccacaggtgcgccggccccgaccgtgcttaaagcgggacgcgtagaatctcacagggagcgcggtgaaaaaggccaacgcgatattcagaagggtcttccagcgggtgaccgcaaaaaagtcggcatggccggaacaggcgcgtccccgcctcgctggcgtgcggccagtaaagtccggagccaagcagcttccgagcgctcccccagcggaatcatcctaaagcaaaggccccccaagaaaatttcttttttagcttgggggatctctccgatcaaaagaggactcctttttgtgcggtcgcccggcatcagcgccatgttaggggtttaacaacagaggaaacagttcccgcgaatgttagagaaaatttgataccgccctgctgaaaaggttcgcctaccacatagtccttccccacgttcggagtggtatgtcagcaaaaagaaccacagccccggggtccaacagaggaaaacccacatcaattgaggtaattctaccacaaggggtgtctacaccctcgttttaaacaagtgtacatgccagggggcaccttgtcttacaagacgctgttcaataacattccaccccccaagccgttcatcggatctctcaaatggccacaacgcgctagtgactcacacggccccggaataactgtcgtgggacccttatcaggcgacctttgcccccagggcaaaccccattggtagaggtataaaagagggtttgtggaaaataggggcagggatataactttttgatatgagaacgttagttcgttcgcaacagactctgtattctccaccaccgtccaacaaacgaacataaca

SEQ ID NO: 590149 - DNA, 894 bp, Homo sapiens
gctcactgcaacctccacctcccaaatcaagtgattctcctgcctcagcctcccgagtagctgggattacaggcatgtgccactatgcctggctaatttgtatttttagtagagacggggtaggctggtctcaaactcccaacctcaggtgatctgcccgcctctgcctttcaaaatgctggtattacaggcatgagccaccgtggccggcagtatgagatattttatcttttttttgagacggagtcttgctgtgtcgcccaggctggagtgtagtggcgcgatcttggtcactgcaagctccgcctcccaggttcaggccattctcctgcctcagcctcccgagaagctgggactacaggcgcctgccaccacgcccggctaattttttgtcttttcagtagagacggggtttcaccgcgttggccaggatggtctcgatctcctgacctcgtgatctgcctgccttggcctcccaaagtgctgggattacaggcgtgagccactgcgcccagccgagatatttgaccttttttaagtctatgttgtaaatggtgaataaatccaaacaaagttggatatatactttaatacatttactttatacgatttcggctataaccaaaatactgattagtatgtcattcctaaaagcatatccttggccgggtgggggctcatgctgtaactcccccttcgtagccagtggagctggtcgggggaggagccggataactgggcattaagacccggctcttttacacttgcgccacacggggcacattacaggcgcccgtgcacctgcggacacaagcctcgtggtagggtgaacatccttcggggacttcgaaccaggcgttttcaccacacagggcgccaacgccgctcacttga

SEQ ID NO: 590150 - DNA, 389 bp, Homo sapiens
tagtccaatgacggtctggctgtcaggtgtgaccaaggcatgtccactcgcgactgaactgacacatgggggatctctgacgaaaccaccacagggacatgtctgatgggcacagggtctcccaaacccagcggcttcggtctgtcctcagcccttgtccctgtttatctgcagccaggagacttgcaagggataggagattgacagcagcaggactcgtgcgctgtttggtgtcagcagaggatttgtgtatcacaggtcaggcttcagcgtcctctcagagtgtagtgccgggtcctggtgccacgctcgctgagcactcaggagagttcatcagcacagaatcccaccggggcctcctctttagcaggaactcacaaacagcttgg

SEQ ID NO: 590151 - DNA, 267 bp, Homo sapiens
ctctcttactcgtgttgcacgagactatggcatcctttcttccttacttttacatgtgactcctgtttgacttgatactctcatgtattgttatattcaagctacccagcggacgctacacgctgcatgactattctcgtcctaccttcctgtgcacgggatgatgatgctatattttcttctgactaccacatatttggcgagatacacttatacgcttttcagtatctaacttcttcctctctcgctatctatacgctacacttt

SEQ ID NO: 590152 - DNA, 695 bp, Homo sapiens
  misc_feature (27)..(27): n is a, c, g, or t
  misc_feature (145)..(145): n is a, c, g, or t
  misc_feature (197)..(197): n is a, c, g, or t
  misc_feature (199)..(199): n is a, c, g, or t
  misc_feature (201)..(202): n is a, c, g, or t
  misc_feature (220)..(220): n is a, c, g, or t
  misc_feature (228)..(228): n is a, c, g, or t
  misc_feature (230)..(231): n is a, c, g, or t
  misc_feature (234)..(234): n is a, c, g, or t
  misc_feature (238)..(238): n is a, c, g, or t
  misc_feature (243)..(243): n is a, c, g, or t
  misc_feature (247)..(247): n is a, c, g, or t
  misc_feature (250)..(250): n is a, c, g, or t
  misc_feature (258)..(258): n is a, c, g, or t
  misc_feature (267)..(267): n is a, c, g, or t
  misc_feature (272)..(273): n is a, c, g, or t
  misc_feature (298)..(298): n is a, c, g, or t
  misc_feature (302)..(302): n is a, c, g, or t
  misc_feature (317)..(317): n is a, c, g, or t
  misc_feature (323)..(323): n is a, c, g, or t
  misc_feature (325)..(325): n is a, c, g, or t
  misc_feature (328)..(328): n is a, c, g, or t
  misc_feature (335)..(335): n is a, c, g, or t
  misc_feature (337)..(337): n is a, c, g, or t
  misc_feature (348)..(348): n is a, c, g, or t
  misc_feature (355)..(355): n is a, c, g, or t
  misc_feature (360)..(360): n is a, c, g, or t
  misc_feature (363)..(364): n is a, c, g, or t
  misc_feature (382)..(382): n is a, c, g, or t
  misc_feature (384)..(386): n is a, c, g, or t
  misc_feature (388)..(389): n is a, c, g, or t
  misc_feature (395)..(396): n is a, c, g, or t
  misc_feature (398)..(398): n is a, c, g, or t
  misc_feature (402)..(402): n is a, c, g, or t
  misc_feature (404)..(404): n is a, c, g, or t
  misc_feature (424)..(426): n is a, c, g, or t
  misc_feature (428)..(429): n is a, c, g, or t
  misc_feature (467)..(467): n is a, c, g, or t
  misc_feature (470)..(470): n is a, c, g, or t
  misc_feature (480)..(480): n is a, c, g, or t
  misc_feature (523)..(523): n is a, c, g, or t
  misc_feature (533)..(533): n is a, c, g, or t
  misc_feature (555)..(555): n is a, c, g, or t
  misc_feature (562)..(562): n is a, c, g, or t
  misc_feature (613)..(613): n is a, c, g, or t
  misc_feature (686)..(686): n is a, c, g, or t
cctccctattaggcctggggctgttgnagtcgggtgttgtcccctctgtgctgctcctggttttgtctcctctcctatccttgagctccctgatatgcaacatggggggttatcagtaggggggggctgcctctgttggggctanggctgggggtgggggcggtgtgttgggcaccttttgcggtcagcccagccanantnnatcgccagagagaatgcnaaagtgtngnntgnatgnaattntgtnggnaaatggtnaatggtggntgggnnggtggctttttgcatgggtggtttntatnatgtgaaggggattntttatntnagnagggggnanaggggtatatnttggctnaggtnatnntgccagtcaggggaagcnannntnnagggannanagantnaaagtggctgtggtggggannnanngcctgggttgggtgttgtcaagacactgggaggtttcnatntgcggtggcnaagggctgcgggttctgccatgctgggcattggtgggtgggangggagggagnacgtggggcccgtcctctgggnagcaggnggtgggaaatgtgaatgggagaagggtggatgtgatgtaaaggaatatgangaaaaaattgggggatagggaattggagagaaaagtatataggaatggagaaagaagggagtgggagggagangaaggatga

SEQ ID NO: 590153 - DNA, 420 bp, Homo sapiens
  misc_feature (8)..(8): n is a, c, g, or t
  misc_feature (29)..(29): n is a, c, g, or t
tgaagccnaccaagcccctactccccctntgaaacccttaaaaaccaataggccccgtgttttcttcctgcctgtcaccacgatttggaattgtctgtgtttaaatggcaatgttcagggtctcccgctagaaaaccagctcccaggggcaagggagatgccacggtcacttctgtgttcttgatgcccccggcccagtgcccgacactcatgactgctcagcaaacgttggctcagtgtgtgacccggtcacgtgcctggcacataagaagcatcagataggtgtttgtgatttctgtggctgtcactgcctgagcgggcattttgagtgtaggagaaatagcagtgcctggatggtagaagcccagaggtcttgtcctagcttggcttcttcctcctgataattgaatgacttaaaaa

SEQ ID NO: 590154 - DNA, 603 bp, Homo sapiens
  misc_feature (412)..(412): n is a, c, g, or t
attgttgggtgaatggacgagacattgtcatgatctgggaggatggggagaactacagttgttcggtctagacatttcgcctagacacatttctcgcaccaaacttggcatttgaactgccagatataggccttatgagtaacttatttttcagggccctatgagaagggctttgtattacgtggttaccttgaacaactgctaggaggaccaaagattttgcaaggcttcttaaaagtgcatggtgagaacttttacatatgagaggataactattgttgactgaaaggattaactgtgttcgcttgtcaaagataaggttgatgtttcaaatcaagtagattggtatgccaggatatactcttcaggactgaatgcgataccgcccatttatgatatgactcctacaagngcgcctatagccttaagtaaaagatggatgtctgccaaagcagaagacttaaactcatggactggctcatacctgaacgttcactgattctcatcaatgggatgagtttttagcgcaaatgctgctgagggacacctcttccatgtggaggcagtaaagctattgcaagaagtgtacaccttcactgacga

SEQ ID NO: 590155 - DNA, 1057 bp, Homo sapiens
aaccagatgggagcagctgagggggccgggtggcaacgaggatgggccacagaagctggacgcggaagctgatgctgagccccgaagacgctcggagtagctacgaatcctctgtgggaggaggtgaaggctcccagaggactagtttcctcaagtttgcgctatattgtggattctggtacagtcgacgacaggcgagacagagttccgtgcaggcgtgtttggagaccaataggtgtcagaggacggtgtgctagttgtcctagtcaagctatccccgtatgtcgctccagccgtcttcacccattgtgagcaggtgctgggcgagggtgccctggaccgaggcacctagtactgggaggtggagattatcgagggctgggatcagcaatgggggtcatggccgaagacttctcccacacaaggagccctacgaccgcgagcggctgggccgcaatgacccgagtcctgcatgccatgctaggtggtaagtggacgcagattcgtccgtctggtttcatgggctggaggctcccctgtcccagcccgttctcgcccacgggtggggtctgcctggaatacgctgaccgtggcttggccttctatgctgtacgggacggcaagatgagcctcctgcggaggctgaagggctcccgagcgcgccggaggtgcgcatcaccggactgtcccattgaagcacattcgagaggccgcctgggaaagtcgagtctagaggggctctttagaccagaggactcaagggctgccttgcttcctgtgagagtgatggaagcgcaattgggagaatcgggggccaatcacgaaaagtcaggcaatataccggtgctgaggaggcagggaatccccaggggcacggggcagggacgaggtaggagcggactctggctccagcgaagggtcgcaccaatgggggccattcacatacggaggagaagggagcaacactggagaccgaacaaccaggacacaaagtagtaaagggcaccgcctgagaaagggacagactccccgtacaggaagggaggaccccgagaac

SEQ ID NO: 590156 - DNA, 123 bp, Homo sapiens
ggatcacgtcagccagcaggaggctgttcagtggtggcccaagcctccctctttccggggggtgttgatccaagccaggtgtagtgaactgatgagtccaccgatgacgcccagcatcttcac

SEQ ID NO: 590157 - DNA, 289 bp, Homo sapiens
acaggtcaacttgagagagattttgggccttcataggccaccaggaggcagcagttgggactagagagtctgacttgagtaagttttgggcccggagatgatgtcctgggacaggagttggccgtggagaggccaccgtgaggcataagctggatgtagagaggccagtgtgaggccatacctgggcctgtctaagctggtgcaagacagggaggaatctggtcttgcatcacaatggcctctctatgtccatgagtagtaaccagacaaaaggaaagaggaacaacag

SEQ ID NO: 590158 - DNA, 112 bp, Homo sapiens
caatgatgcgccatcttctcccatcagcttagcccttactagatgttggtcccaccccaggtcatctcattaacataaattcagtgtggccttgatgggatgccctactgcg

SEQ ID NO: 590159 - DNA, 710 bp, Homo sapiens
ggaagggcctgggacaacctcctgcagaacaagactgctttcaccaccaaagagaactacggcaaaggggagagggaagcacaatgggctactgcacagagaacactccatggccttcaagcacccgagccggcctcccacacactgttcaacgacaagagcagctaccgtgagctctctgagatcgctgagcaagcaaagagaagagctgagattgcaaggttgagggagctcaacacactcaagggccacgttgaatccgtggtgaagctcaagggccttgacatcgacaccatcaaccagaactacaccgtgtgaggaaattcgacattgaaccaacaaacatgacatccgtattggagcgagattggaatggagctccgctttaagatttttccggtgaatgaatgaaacaaacatggctgatctgaccagcccctagttgtaaagtgctaccaaatatatggtttcggttgtccgtcttctagagaggttttaatgttctagtggagttataccgtgtttggagcacggcgtggttgtaatcgttttcgcgttttacccagtttcccctaactagtcggtgatcttgcggaaagcaagacgagaaataatcactgcaaattttctgccccatgcttgctatcccttcacttgggtttatacaaagacaattctcgtctataaatatcaatagctggcttttctgc

SEQ ID NO: 590160 - DNA, 901 bp, Homo sapiens
  misc_feature (111)..(111): n is a, c, g, or t
  misc_feature (143)..(143): n is a, c, g, or t
  misc_feature (171)..(171): n is a, c, g, or t
  misc_feature (175)..(175): n is a, c, g, or t
  misc_feature (224)..(224): n is a, c, g, or t
  misc_feature (230)..(230): n is a, c, g, or t
  misc_feature (236)..(236): n is a, c, g, or t
  misc_feature (239)..(239): n is a, c, g, or t
  misc_feature (242)..(242): n is a, c, g, or t
  misc_feature (257)..(257): n is a, c, g, or t
  misc_feature (295)..(295): n is a, c, g, or t
  misc_feature (301)..(301): n is a, c, g, or t
  misc_feature (307)..(307): n is a, c, g, or t
  misc_feature (325)..(325): n is a, c, g, or t
  misc_feature (341)..(341): n is a, c, g, or t
  misc_feature (366)..(366): n is a, c, g, or t
  misc_feature (373)..(373): n is a, c, g, or t
  misc_feature (382)..(382): n is a, c, g, or t
  misc_feature (394)..(394): n is a, c, g, or t
  misc_feature (403)..(403): n is a, c, g, or t
  misc_feature (424)..(424): n is a, c, g, or t
  misc_feature (455)..(455): n is a, c, g, or t
  misc_feature (466)..(466): n is a, c, g, or t
  misc_feature (485)..(485): n is a, c, g, or t
  misc_feature (519)..(519): n is a, c, g, or t
  misc_feature (529)..(529): n is a, c, g, or t
  misc_feature (542)..(542): n is a, c, g, or t
  misc_feature (544)..(545): n is a, c, g, or t
  misc_feature (557)..(557): n is a, c, g, or t
  misc_feature (573)..(573): n is a, c, g, or t
  misc_feature (611)..(611): n is a, c, g, or t
  misc_feature (668)..(668): n is a, c, g, or t
  misc_feature (692)..(692): n is a, c, g, or t
  misc_feature (726)..(726): n is a, c, g, or t
  misc_feature (728)..(728): n is a, c, g, or t
  misc_feature (731)..(731): n is a, c, g, or t
  misc_feature (750)..(750): n is a, c, g, or t
  misc_feature (752)..(752): n is a, c, g, or t
  misc_feature (755)..(756): n is a, c, g, or t
  misc_feature (777)..(777): n is a, c, g, or t
  misc_feature (780)..(780): n is a, c, g, or t
  misc_feature (789)..(789): n is a, c, g, or t
  misc_feature (801)..(801): n is a, c, g, or t
  misc_feature (810)..(810): n is a, c, g, or t
  misc_feature (813)..(813): n is a, c, g, or t
  misc_feature (822)..(822): n is a, c, g, or t
  misc_feature (826)..(826): n is a, c, g, or t
  misc_feature (832)..(832): n is a, c, g, or t
  misc_feature (834)..(836): n is a, c, g, or t
  misc_feature (891)..(891): n is a, c, g, or t
ccccagcacagaggaggtggacagcaagaggggtgcggtggatactgacctttgctccggcctcgtcgtgaagacacagcgcatctccccgctgtaggcttcctcccacanaacccgtttcgggcctcagagcgtctggtganatgctgttgccgctgctgctgctgctanccangtgctgggccgtggaggtcaaaaggccccggggcgtctccctcaccaancatcanttctangangantccaaagcctttcanctgcctggacggttcggccaccatcccaatttgatcangtcaangaagantattgcgactgcaaaaanggctctgacgaaccangcacagctgcctgtcctaaaggcancttccantgcaccaanactggctaaaancccctgtanaacccctccaaccgggtcaangatggtgtttgtgactgctgcgatggaacanacgagtacaanagcggcgtcatcatgtganaaaacactgcaaagaaaaaggccgtaagaaaaanagagtccctncaacaaaaggccnanntcacccgcgaangagattccgtctgaanaaaatccttaaagaggactggaaaaagagcacggagangagaaaaaaaaaaaactcattgaactacaggctgggaagaagtctctggaagaccangtggagatgctgcggacagtgaangaggaagctgagaagccagaaagagaggccaaanancancaccagaagctgtgggaanancanntggctgctgccaaagcccaanaanagcaggagntggcggatgatnccttcaagnagntggatgatnacanggacgnannngtctcgatgactgagctgcagactcaccaagagatggaacccgctgggggtgaancattgtacaa

SEQ ID NO: 590161 - DNA, 844 bp, Homo sapiens
ggataaagtaagtgctgtctgggctaacaggatctcctcttgcagtctgcagcccaggacgctgattccagcagcgccttaccgcgcagcccgaagattcactatggtgaaaaatcgccttcaatacccctaccgccgtgcacaaaggaggaggcgcggcaagacgtggaggccctcctgagccgcacggtcagaactcagatacgtgaccggcaggagctccgagttgccaacccaggaacaaagacgggctccctctggagaagatgtatgcttacctctcttaggccctttcatccatctgtggcaaggacttacatctgttgggggagccctgcaatttaccaagtcacttacatggcccaaagagcaacaatttacctgtggacagagatgtgctttttggatttctgaggatcctgcaaaaattcccttcgtggcaggcagaccctaatttcctgcctgtgactgagggaggactgacattcgttgaggatgacaacatttgcaatccatgtgatgtgcctgtcacccagtatctctgatacgttgacgcctgccaggcattaattccatgacgtttcgacaaagggattgactgttacctggaatttgtagttggggaactgtattctgatggcccctcaataaattctatggttgatggctccaaaaaatctgggtagaggtccttgggacacctgggagtggggagatatctggctcaacttattgtggtcgagaagacctacttggtgtgggggacattcggcggtagaacctgggatttttacccaattggataaaaagaagcttcggtggagaacatttggtggtcacagtg

SEQ ID NO: 590162 - DNA, 202 bp, Homo sapiens
ccccagcacagaggaggtggacagcaagaggggtgcggtggatactgacctttgctccggcctcgtcgtgaagacacagcgcatctccccgctgtaggcttcctcccgcctcctctgtgctgtacagcacagaggaggtggacagcacagagatggacagctggacagcacagaaggggctcactcacccaccacaacacac

SEQ ID NO: 590163 - DNA, 822 bp, Homo sapiens
gaagagctgtcaaatgaaaaactttgtgctgaagcaggtttttagtatgtatatctttttgatggtatgaagaatttatttaggcttgactgttttaaaacaccataatgaatgtataattaatttatgttaaagtattaaccctttgtcacaaaggaatggtaatgtgattggctgcctgttagcccatcgactattcccgtcacggtagtccttacctctgtcggcagctcagagcctccacatttttatatttaattctcatgatcaattagccaccataatcccatggaattaggtcttgttaaaatctagtccgggcgcagtggctcacgcctgtaatcccagcactttgggaggccggggcgggtggatcgcctgaggtcaggagtttgagaccagtctggccagcgtggtgtagcccggtttctactagaaatacaaaaattagccaggcgtggtggtgcgcgtctgtagtcccagctactcgggagtctgagcataggagagtcgcttgaacctgggaggcagaggttgcggtgagccgagatcacgccactgcactccaacctgggtgacagagcgagatcctagtactgcacaagaatataaaaaaaaaaactgagaggacttcaaaggacgagccgcagcaagacaaaggcgtcccggagcatggggcccatgagtgaacaaaacgcggcataccctgaagacaagagcatgaatgggacaccagcgggggaaacactcactccggggctcaccataatagagagaacagcaataatcacagggtaacccagggatacacgcgcttaaggc

SEQ ID NO: 590164 - DNA, 240 bp, Homo sapiens
agcagggaacctcccccattcagggaagcagtgagtgaatatgggaccccgggaaccacgcttcttccacagacctttttacaaccctcgggtcaggagactgcctcatgaacccactccaccagggtcttcagtctgacacagagctacatggaatcttggcagagtagtttctcaggcgcaaacagagaccagaaagcctgggtatctaaggctctcgggtctctgtttgcgcctgag

SEQ ID NO: 590165 - DNA, 992 bp, Homo sapiens
tgactggggtcaattcaagtcatgcaggctgtgaagaaacggcggggtcgcggttcctgcggtcctgtggacttggccccagacagccggggtcgtggtgcagaacgccggtcgggaccatctgcacaggcgctcgacagctccaagatgctgcggcaagcagaaagttgaagcagaatgcggtcccaggcacaccaagttcagcatttaccctcccattccaggagaggagcagctctctgaggtggggccagcgcacaagaaatttgaggagatcccaattgcacaccattaatagcattcgcacaacaagatacagtagttccaggtagtctctgctagtaatgagccccttgccctttgcttcctgtggcgcagagggatttcggaatgccaccgaagggcacaggcatcgcagcccagacagcaggctatagcccgcagcggcgagagctaaacaaaagggcgtgatccaatccgagttgtggtgaaaggcttgggggccaggacgcttgttttgcattgcacggacttgatcatgggccggcctggaagtgatctcaaatccacagaaaaagagcccaattccaacgaaggtgccgccccaggtaagggctcggaagctgggattgggacaggcgcggcttgcacttggaactgacctcaagcctctgtcccgttggagcttgtaaatgtccctggtagagtctccgactatgcttgttgggaatccctaaggcgcaccgagagtttcgcccctaccaagtggcgtgttgactcaggtgggatgggtgccccaactagctgattcctacagaggggctagggagcgggcttcgccctcgtgagaatacatcgtccctgcaacaacgggcgctaataccaggcactccgccactgaggggcgacagcaaacaccacgcaaccgggcgaccactcaccctgtctgcaccaccaccatgagccgccttaacacaacacacgccacacaa

SEQ ID NO: 590166 - DNA, 211 bp, Homo sapiens
ctgtcaaaacgaagaagtagccaatgcctttggcttggcagatgagcttgcagcctgccaagccaaaggcattggcgacttcttcgtatatgcagcccaaggttgtagactggtactcgatgtagcccagattccacctcgtgtctgtgtgcaaggacagctgtgtaaaacgctggattgtgatcggcatcatacgactccaaacaagaag

SEQ ID NO: 590167 - DNA, 228 bp, Homo sapiens
  misc_feature (140)..(140): n is a, c, g, or t
  misc_feature (195)..(195): n is a, c, g, or t
tttttttgagatgggttctcactatattgtccaggctagagtgcagtggctattcacagatgcgaacatagtacactgcagcctccaactcctagcctcaagtgatcctcctgtctcaacctcccaagtaggattacaanatgcgccgacgatgcccagaatccagaactttgtctatcactctccccaacaacnctagatgtgaaaacagaataaacttcacccaga

SEQ ID NO: 590168 - DNA, 1497 bp, Homo sapiens
gggtggcggcgggggcggcggttgcagctacagaaggggatccggaggaagcagcgtgatggaggtggatgctgcagataagtcacccagcgtgaatggacctgacggagatgagatgggagtgttatccgatcgctctcgcatcgcccattgttcaattctcaagcatctcagacgcactggagtccgcagtgacgcatcccaggcaggggcggccgtggtgcatggtgaatatgcgggacttcgtgatattgggccaagacgaggcagggcccgcacaattatctgaagtgctgtagtgagacctcccttttgcatgcatgactgttctccgactagctcggtgcgcaatgcacgtacacgcatctatcaatcttgaccagatgcgaacatattgatctacaacccacaaggaagtgacgcaaaggtgttaacgacaagtggtggtatccaacggacgactgggaggctttcgctggggcttggcgtaatactcaacagagggcgagccatgacatgacacctctcgtgacggtccacggtttcacagtaaacgcccaggatgctgtgagaactcagtcgaagcaggcacaccgtccttttcctgaagggttgaacccgatagtgaaccaagacgaacaacatggatcgttccctggtacagacgatatggcagaagtcatggtcgagacggcctatcagatcacatctggcacgagagccaacgaagtcgctggtactcgctggagccttgaccatagacttcttggcccacatgagcgcaagcggaacactgcgatttgggagttagacacagcgtaggcccgcgaaatgaacgagcaaacaaggcaaagctggggaagacggaacacttacccaactaagtggtgcttgacacaagcccttggatttagccaccagccaccaaggctacccattccacacgacttgcttgccacaccaagacctcgcgggtccaagcgatcattcctgagaagtacggtccacggccctcctggcaagccgggacgagggttcccccatatcaacttcactgaagaacccccctcaccgagagaagggacctaatgcgccaccctgggtgcctaccctggccatacccggggcgaccctcaacccaccacgaaccaccgcttcacacgacacggacatctctacaggcagccaagcgggcaacaacaccgtagtcggcaggccacacggaccgtaacccgtgggcagccactaccccagaaaagcggtcacagacccacgacccagcctggtcgacccacgccacacggccccctaccagacccagccagcggaccccgccagcacacacacgcgcgccaccaccccaaaacgagaagccacgaacagccaccacaggacgcacgccaccaccacccgcacgcgacacaaccgtcacaacccagcttaaaacgagagcccagcgcacagaccaacgacacacaccaccgaccgcagcgcacg

SEQ ID NO: 590169 - DNA, 575 bp, Homo sapiens
cgcacgagacccagcgcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccg

SEQ ID NO: 590170 - DNA, 339 bp, Homo sapiens
gagacagagtctcgctctgtcgcacaggctacagtgcagtggcgtgatctcagctcactgccagctccacctcctgggttcctgccattctcctgcctcagcctccggagtagctgggactacaggtgcccaccaccatgcccggctaattttttgtatttttagtagagacggggtttcaccgtgttagccaggatggtcttgatctcctgaccttgtgatctgcctgtctcagcctcccaaagtgctgggattacgggcgtgagccactgcgcctggccgaaaaaagaaaatttaaatttccttaaagaatgagcaaatcctcatcacatgtcgacg

SEQ ID NO: 590171 - DNA, 265 bp, Homo sapiens
ttttcagacaagtgctattatcaatcatagcacaaaataatagatctatacagccgggatgagagaggacattctagatgcatcagaactcacataaagattgacagaagccaggtgtatagaagtgtgttgataaaggggaaaagaaaaagaaaaaattgcggcagcagtgattgcagaagccatcaaaattctccaacagaactaaacaacgatagaaccagtagagactccactcctgttatgaggtgaagcagcaccttgc

SEQ ID NO: 590172 - DNA, 1337 bp, Homo sapiens
gactggcacctcgcagcccagtacactagatgaggccgagggactcctcaggagtggggcttacggcagcttgtgctagagagaactccggttgagtggtacgaaccgtgacctatagcagggtgatgggccctcgagtgtctagggctgacgcagtgctagtagtagctagcgattccgatggagtttcgacaatgcataggttcgtaggccggaccgatactagccctataccacacgaagggatccattgtgacgccatgcagagaaccagtcttccaatatgccctacaggaccggttactatgcatgcaacacacaacgtcaatgtagggcgacatgacgtgcacggtgcatggacgtgccccgacgcaatacgcgcatgacgcataacggagtcagacattatcataccagcgtagacccgcaagggacttgtcgagagcagaacaagaatacgaaggggtacacgtgacattgtacaacatgacctacttcccacgggagttaggagtcatgactgcatgggacttgacagtaccaggagcactcagagaaccttgacactgattgaccaaaaatggaacccttatcagcgggaatgggaccccagagcagaaattacacgcgtaaaatgttgggcaaaacacatgggcgcaatggtaacggtggccatggaacccctgggttacgcacaaggatcgagtgaagagcctttcctggggacacattgaaagggtcctgacctggatggggcagggataacacatataaggtacggaatgaatggactcggatggaaggaacagcaaggcacctaataggtgatggccctaggaaaagatgtatggatgtgagggtaggaacatatgcttttccatcgaagagaacagggcacagtatgcccatagggggacgtaaatctggaacgtggagcgacagacaagcgtaccttttcgaagaggacactacaggttatcaagggggaatcggtcctatcccacgttgaaagtaaccattttccttgggatacacgtggcaaagtatccgatggatgtagggggggtatcatagtccggtggaaagatggcagtagtagagactcgaagacgtggcagtccacatgggacacgagagattcaatgtgaccagtaaatgtgtggaatggaacaatgctttaggggtaaggatgcaaaaagagggtagaggaaatgaggtgacagtttggtgaacggatcgcaaatccatgggggaagaatcatgagcaatggattgggataagacgagatgggcagagactatatgatgtataggtggagagaaacataggggtgtgt

SEQ ID NO: 590173 - DNA, 206 bp, Homo sapiens
tgagacatgtgtgtgaatggggatgttgttcacaatacaatacaggctcccccacagggtggggtgtcctgtggggaacttggtctgcttcagcccacagaggaatcaaaagatcaaaagcagtttgggaagtgccagataccggcaagtggatggagtggagaacggaaaatccagcgcggtggtggggtctggtttggcaactg

SEQ ID NO: 590174 - DNA, 139 bp, Homo sapiens
taccacatgcacagctgcgtcacttcagctctggggcatgttatgcactgcctactttagtgtggtagtatctcttgcctgcttgccttctgttagttattttattacttcctcaatttgtcagtttccactctgccct

SEQ ID NO: 590175 - DNA, 104 bp, Homo sapiens
  misc_feature (91)..(91): n is a, c, g, or t
cttaggatccctgtgcactgctcggatgggcatgtggatatgaaaaaaattttttgaaatccctgactattgctataaagttatctgtaanatacttgctattt

SEQ ID NO: 590176 - DNA, 275 bp, Homo sapiens
  misc_feature (69)..(69): n is a, c, g, or t
cagagatgatgccactgcactccagcctgggcgacagagcaagactccatctcaaaaaaaaaaaaggcngctgaaatcgggcagcgcctttcagattccgggcccaggtgatttcgtaactccggggcacccgggatacggcccttcctaggcccggccataacccttcttcctccatttagcactgggccccatgtcacttacatctccttacccagttttttacggggccgggtaagagccttcacccagggaacagtacaaccggccggggg

SEQ ID NO: 590177 - DNA, 280 bp, Homo sapiens
ttcaaagcgcacagaagtttcgtatggtgagtggatcccggtcgggcttgctgaatgaatatagagtcagcctcatattttctcatcagttcttcagctctcctccctatcgtcatcccactgtaagactgtcactgatcatgtcctcgagctgctgctttcttagctcaacgccatgctgcgtgccatcccactggttctagaccctttccaatttttctgtcattgctgttctcatctctgaaccggaagctttatttttcactttctgtgccctttg

SEQ ID NO: 590178 - DNA, 420 bp, Homo sapiens
atgatggtcttgatctcccgacctcgtgatctgcctgcccggcctcccaaagtgctgagattacaggcatgagccactgcgcccaggcctatacatttttttaaaataatggtttgtaattaataaagggagaggcctgcaaaaaaacaaaagaaaacaacaaaaaaaaaaaatgatcacaaaaaaaaacactatggtttttcggcgccgggccgtgctggccctcgagcggagaaaggctttcttaaacgaacaaacacattgcggtggtggggggggacggggcggcacccagagtagtagaaagcgatagaacaaggtgggacaacagcccggtgtctgctcagtgggagaaaacgtcgtggacatagaacgagcggggggcgtgattatccacccagcaaaaaacgccgcgcgaga

SEQ ID NO: 590179 - DNA, 208 bp, Homo sapiens
catggaccagagatctggatgttaccttcacagttcaaagaccctttcgtcaccacctggtatgacactggaatggtattcagcttcctggcacttctggtcagcacccagtgttggcacaatgatctttgaggacatggtttaggcggaccacaccgccacacggcaccccataggataggcaggacataccgcgatgtaggaagag

SEQ ID NO: 590180 - DNA, 180 bp, Homo sapiens
cccccaaaaaagaccaaaaacagcagcatcaacagaaactcaatgtaacatttatgctcaatgaaacaacaaagttggttcttcataactttacatttatcttgtcataaagataaattaagaatttagaggtttttaaatatactaatatgttcacatatgcatatatgaagttatatg

SEQ ID NO: 590181 - DNA, 211 bp, Homo sapiens
ggtcaagaccccttcctgaacccctcaaaccctccctggacccctgcgaatggaggcaagagcccacgaaagttttctcattccttcatagccaccaaagcacagaagaacctctgattgggactgccacatgtcttgcgggtgtgtacgtgtgtcgtgatgagtgaagtgacaagtctgtgtccgtggagaaagaaatccgtgacgggga

SEQ ID NO: 590182 - DNA, 168 bp, Homo sapiens
gggggggcgcccccccctttttaaattggcccccccccctttttgggggggggggttttttggggccccctttttccccctttcccctttaaaacgggggggggggggaaaaccgggttttttggggccgggggccccccaaattccttggggggtttttttttttta

SEQ ID NO: 590183 - DNA, 666 bp, Homo sapiens
aaccgccttcgtcggaagctgccttggatccgcgtctccccaaggaaaactgcgactggcgactccccaagtgctattagccgttggttaattcggggattgcacaaactaatgctggggtactaaggtcaaacgtgaacggagcacgtatattatctaggctgcaaggctttaaatagttactactacacacgtcttaacatacgcacctgctaacccgtgcgcagatgtcaaaacccatttggctaagcaactggtcaaactctaagttcaggtatgaaatgctaaaccccaatgctctgctactacctatatgtgcatgagaaactttggtaggctgacaaggatgtactggacagcgctactggtagaagccaacaattggcaacgtacatcagtgaccctatgaagaccttatggcatgctaggaagtactggtataccgccagtaaaggagactggacttaacaatgcgttgcggtaatcagcgaatgccgtttgacaataagttgtatgaccattcagatgcattcaactctaaaacatggtgaacaatgctatacaatgcttagatctgcatacataagtacctaacgtagtcaaggaatactcgcgaattgacaataaagtgagagaaagcaatcctattggccaggaggaggccct

SEQ ID NO: 590184 - DNA, 390 bp, Homo sapiens
agagctttcccgattaccgaaaactgagaaaggacaaagggggaggggcacatgtaaagaggacagcccaaccagaatagacaacgcaacacaaagaaaactagaagaaagacacaactaaggaaaaaaacacgaaaacaggaccaaggaaaaccaagaaagaggagaagaagaggaaacaaaatgatagaaacaaagaggcaaagggagaaaggaagacaaaacagagcaatggagtaaaaaccgaagagaaagagaagaacctgactgagaaaaaagacaggtaaatcgaaaaacaagcaaaaaaacagaacccgacaaatagaagagacacaaactacaccatgaaataaataagaagaaccacaagaaaggaataaacacgtcgct

SEQ ID NO: 590185 - DNA, 667 bp, Homo sapiens
  misc_feature (4)..(4): n is a, c, g, or t
  misc_feature (214)..(214): n is a, c, g, or t
  misc_feature (629)..(629): n is a, c, g, or t
  misc_feature (636)..(636): n is a, c, g, or t
  misc_feature (641)..(643): n is a, c, g, or t
ttancacagacacacaatcacacacaccctcttcttgccacagagacgcaccattacatacacagacacagacacacagagacacagacacacaaacatagacacacacacacagacacacaccagacacgcaaagacacacagacacagatacacagatacaaagacacagacatatagacacacagacatgcacagagacacatggagacanatgcaaaaatgcacagagaaagacatacagaagtgtacacacagacacatagaccacacagacacacagacatgcatgcaaacacacagacatgcagacatgcacacaaacacagacgcacgcacacagacttaggcagcccaaattcagcgcctggggcataagttcctggaggggtggccaccttcagcccccacggtaaggtcctgaggaaccttccccttagacaagggatcatggaggaggtctcttccggagcctggagggaggcctcaagtggtccttccacctcggcatcccaaagtgctaggattataagcatgagccactgcacctggccccaacatcatttattgaacagactgtcgtttccacattgtgtttcttggcatttctgtcaaaaatcagttgaccntaaatgnatggnnncacttccgggctctctaaaaaaaa

SEQ ID NO: 590186 - DNA, 274 bp, Homo sapiens
agtcacctcggccccccgtctgtacagttgcggggacttatactggggacgtaagcgatttccgggtgtagtactgttactcttatttcagcgcttatactcagtgaatcttgtctgaagctatcgagggcagactgccaagtcctggagaaatagtatatagcaagtaagtgggtaatgtttctcattgtacacaattttgagaaatgccacataattttccttagccaaatggaaacgcttgtcacccgaattctgtggccatttgtggttc

SEQ ID NO: 590187 - DNA, 642 bp, Homo sapiens
  misc_feature (4)..(4): n is a, c, g, or t
  misc_feature (189)..(189): n is a, c, g, or t
  misc_feature (604)..(604): n is a, c, g, or t
  misc_feature (611)..(611): n is a, c, g, or t
  misc_feature (616)..(618): n is a, c, g, or t
ttancacagacacacaatcacacacaccctcttcttgccacagagacgcaccattacatacacagacacagacaagacacacacacacagacacacaccagacacgcaaagacacacagacacagatacacagatacaaagacacagacatatagacacacagacatgcacagagacacatggagacanatgcaaaaatgcacagagaaagacatacagaagtgtacacacagacacatagaccacacagacacacagacatgcatgcaaacacacagacatgcagacatgcacacaaacacagacgcacgcacacagacttaggcagcccaaattcagcgcctggggcataagttcctggaggggtggccaccttcagcccccacggtaaggtcctgaggaaccttccccttagacaagggatcatggaggaggtctcttccggagcctggagggaggcctcaagtggtccttccacctcggcatcccaaagtgctaggattataagcatgagccactgcacctggccccaacatcatttattgaacagactgtcgtttccacattgtgtttcttggcatttctgtcaaaaatcagttgaccntaaatgnatggnnncacttccgggctctctaaaaaaaa

SEQ ID NO: 590188 - DNA, 743 bp, Homo sapiens
ggttctcgacctcaggtgcctggctgtgcatccaggcgtgcacgaccggtgtggcctgggctccagcctggagtgtggaccgggtcggtcggcgtgtgcctcccctgtgagggtgccctggcgggtgtgagtcccggctgggctggatgaaccgggtctctggtcggccgcgatggtccctgctgcggctcctgggtgatggcactgcccgcgcgcccgccggcgccatgggaaggagcgggcgccgctgctgtctccccgcacggtgcgcgcgacgacttgatgagcctgctcactggtgcagtccccggtccgtcgggtccccgagtgacggctggcggcactctgagagtgttggcggcggtgcccaggggcttcaccgcatgcggagcgcgcagttgtccacgtgaagcggtctgatgtgacccagccagtccctgtgcctgccggacagtgcgtgatgtcccgagggtacctacacgttcctcacgtgcttcggccgggcttcgtggctcatctggggtctcatcggtcctgctctgctggttcgtgcagcttcctgcgccgcgcctcaaactggtgccaggaggagcgactgcgcgagcagaacctgcgcgcgctagagctggagcccctcgaagtcgagggcacgctggccgggagcccccccgggcctggcgcacgcgagccaacaccagaccgatagcgcctggaggcgccggctcacgcgcactcggcatcga

SEQ ID NO: 590189 - DNA, 374 bp, Homo sapiens
acactggtggttcctcatctctgtctagctccatttcatccatttcgtggttcttatttgcctcattttgtgtaatcctaatgtatgcatgtttcttgtgagtcgtgttctagcgccacatcagtatcctcagttgaaattgggactcaggtttgggtcccttgtcggagcctgggtttgttctaaattcgcctcttttttaatgtagtctgttctcgtctccctgttatacagtcaggagtatgggacttggtacatgtggctcagtccttcagttcatcaggctttatggtcatgtatacagttagcccatttcatttaaatcctgcgagacagagcatcatagctagacattgacagagagatcggcatag

SEQ ID NO: 590190 - DNA, 449 bp, Homo sapiens
gagatggagtcttgcccctatcccccaagctggagcgcaatggtgcgatctcagctcaccgcaacctccacctcccggattcaactgattctcctgcctcagtctcccaagtagctggaattacaggcgtgtgctaccacgcccggctaattttttgtatctttagtagacatggggtttccacatggttggccagggctggtctcaaactcctgacctcaagtcatctgcctgcctcagcctcccaaagtgatgggattacagcagtgatccaccaggcccagcagttttaaacttgaacttacatctgtgcttgttaaagcacagattcctaagctccatccccagagattctgattcagtagggctggggccaggcctaatatatatatatatattttttttagacagaatctagcctgggcaacagagcgagactccctctcaat

SEQ ID NO: 590191 - DNA, 222 bp, Homo sapiens
tgcgggcagggctgagccaacaggcacgctggtaacattgaggtgggcacgggatgatctgcacagcctatgccattctcctggtgacacacggacctcccacccatcactaggattagaggccatgcgggtgcagacggagatgtgagctacgatgttccgccagaacgaattcatgtactacaagatgcgcgagctgcctgacaccagcccatgacggct

SEQ ID NO: 590192 - DNA, 246 bp, Homo sapiens
gcgttgtccagcaccctttccagctggggaatttccaacctcgggaggcccaccttgcccaaggcagaagaacataaaccctcattttcttggcccctttggtcgcttaggcttaggcccacagctgaggtttggggccattaagataccattttgtccaattgcacatgttatttctaagtgcagaaggcacagagtttcagcagacgggagttcgcccatcgtgggagtctcatcctggacaag

SEQ ID NO: 590193 - DNA, 301 bp, Homo sapiens
tcaaatggtgctggtgtgctggcttccgatccctcatagcggggatcgtctacctagatcacctccattgttgtccttgtggaagagaggaaatcactccaaaatcgtcgcaggagtactgggcctaatcgctacgtgcctctttggctatgatgcttatctcatctgtgtcgctgcggcagccaagacatacagcagcccccactgaccccgcagatggcccggtgtaggcgaacttccctcatttctctctgcaatctgcaaataactcctccattgaaataactcctccccaccccaa

SEQ ID NO: 590194 - DNA, 693 bp, Homo sapiens
  misc_feature (693)..(693): n is a, c, g, or t
gacgagtacgtggctaacctcacggagctggtgcggcagcatcaaggctgcccaggtcgccataggagaaaaagaagagaaagaaataagaagaaggcagaagatgcaggaaggacacgacgcctgccattgggccggatggggagcctctggacgagaccagccagatgagcgacctcccgagtgaaggtgtatccacgtggagagtgggatagatcctcacaggctagcagatgcccccaaagccgggcagctggaggcctggctcgagtatgaacccgtgggtatgaatgtagcgtccgaggtctgatagctgatagaaagtggctcagaagaagaggaagaggaggaggaggaaagagcagccgtctggctagcgacgagtgctcccaccctgcccgtggtagggagaagaagaagattcctacgatccgagatcagcgatgacgtcgtctgaggtggacgcgcgggacatcattgagaatgccaagcaagatgtcgatgatgaatatggctgtgtcccgaggcccttggcacgtggccgtgcagtcctactatgccgtggcccatgctgtcactgagagagtggacaagcagtcagcgcttatggtcaatggtgtcctcgaacagtacctagatcgacaggttgggagctggctgggtgtccctgtacaacaaggacctgaacggcan

SEQ ID NO: 590195 - DNA, 496 bp, Homo sapiens
aaatactggttaaagatgatgctcgttgtctagatcttgggaagaagacatcagtatgtttgcaggaggatcatgaagcacatgatcgttgcatgaaaaatgttgcttcctgcctgttcaaactgtccaattttggagggtggggtggttgcaatgcttacttaaaggatatgtagcaagccatcggaaaaacagagaaggtgaatctcggtcacagtatgatttatgcttggggacactaagccctgagtccattaaaatcaagtctgaacaaaactcaagcagtgtagtctattcttgcatgctgggttgtttcaacgtgtcttttttcttgccctgaatcccggggtatttgcaaaatggattctcctactgacatctgttgacaccctagggggacaggtctaattcaatccagctaaaggcagcaggggttcctgactaactcctctcataccaagctccccttctccatgactcccaaaaccttcacggg

SEQ ID NO: 590196 - DNA, 1171 bp, Homo sapiens
gatacgccggtgcagcggggtgggcccggggtgcctgtgtggccctgtggatggggaacctgcggtggcttcctgcggagggtttcggcagtggcatcctggtggcctggggtcgctggcctgtgtggacgtgggcctggtggcctgatggccgcgggagcttcgcggaggcaaggccggagtgatacggagtggatgcccgtcaccaagttgggccgcttgggtcaaggacttgaagatcaagttcccttggaggagatcgtatcgtcttcttcccttgcccaatttagggaatcggagaatcatttggatttcttccgttggggggcctcatcttcaaggatgaaggttttgagaagatttatgccagttgcagaaaggcgagaaccctgttgccgtgggccaagcggcaaccaagtgttccgagggggcattttgggttacgagatattcgggggggaccatacatagttggccgccatgtcggcgatcatggagagtagtaacaggtggctccaagaggggagggtagtgccaaccggacaatccggtggggggccaatacattccttgggccaaagagcttcttcacaatcggttccccctgtttgcaggccaaggagggccatacgtgggggggagaagacatatgacttcggggaacaggccccacccaacaaacgtgtgtcgccttttgcaacatgtgttgaccatgggcacggatatgcagggcactatctttgtcgcgtggagtataccagccattcaattcccctttggaaccccgagggtggagaccacttgggaccatttcggatacttcgcggacaacctttgttggcctttaagaagaggcttgcttcaattagatgcgctatggatatccgcatcgacttggatacacctttaaggcaccgtggggcttgacactttgccaaccgcttggggacaactctttccgccagtagggcaccaactttttggattgccatttttcttaaggaccctaaggagggtaaccttggacccccgggacctctggaaaggggggacttggtatttccaccaaggtttctcccctaataaggaggttcaagtttgaccacctttgttaaggagccagacacgagagttctcgtggcaggggaaatcacggtcacaagcttgtgcg

SEQ ID NO: 590197 - DNA, 1103 bp, Homo sapiens
caccaacccacaacacacagtgcaggagcaggctgggtggtgccgcgagcggacgcggcagcgcctctgtcttgctttttcttatttttcccccctttcccctttcttattcattatatctattaactatttctccccatccccaccaataagcgcaatacacccatcgaaggcgcatccacggtaaagcgaaagacggaaacacccaacacgccacaaacaaaacgaagctaaaactaaatcaatcatacaaacaagcagataaacaacaaaacatcacatatcaatacaaatcacgaccacacactcaacttatattacatacactatatactaccacaatatataatctaaattaaccacaaaaaagtcacatatacaaaataacacatataataaacacaatatacgacgacaaagcagccagagcagacaaagaagagaggaaagacgcgaagcggcggagcacgcaagaaggcgtcaacacagagcgagcgtaacacgcagctaagacctaactcgagtaccagagcacgaagcagcacagaggagggatgtacaaaacagagatcaggagcacacagagggaagagagctaagcacaccaggaagaggacccaccagctaggtctcactgaagacgcaaaaccacaacaaaaaaatcacaaacaaaaacacacacaacaacaacagaaaactacatcaacgaacaaaacaaataacaaagaacacacacatactaccaatcatacctatacgcacacataatacagaaagacacaacaacgacccaacatataagctaataactaagctagctcaggagagacgtcccacttacagagctacacgacagtggagcagacagaaataagcaacgagtaagataagaaagaacatagacacggcaacaagcagcactcgccctaaaacgcacagaagaccagccaggaaaagacaaaggagcataacgacgaaaccaactagtcagcgagcagacgtaacacgtgacaaaaatagatatagactagaacagtacaagcaacgaaacgtcaagaagaccaacgcagaccagaccacagacaatcaatagaaaacagcag

SEQ ID NO: 590198 - DNA, 426 bp, Homo sapiens
  misc_feature (1)..(1): n is a, c, g, or t
  misc_feature (61)..(61): n is a, c, g, or t
  misc_feature (87)..(87): n is a, c, g, or t
  misc_feature (94)..(94): n is a, c, g, or t
  misc_feature (109)..(109): n is a, c, g, or t
  misc_feature (122)..(122): n is a, c, g, or t
  misc_feature (129)..(129): n is a, c, g, or t
  misc_feature (139)..(139): n is a, c, g, or t
  misc_feature (177)..(177): n is a, c, g, or t
  misc_feature (189)..(189): n is a, c, g, or t
  misc_feature (193)..(193): n is a, c, g, or t
  misc_feature (226)..(226): n is a, c, g, or t
  misc_feature (228)..(228): n is a, c, g, or t
  misc_feature (244)..(244): n is a, c, g, or t
  misc_feature (255)..(255): n is a, c, g, or t
  misc_feature (257)..(257): n is a, c, g, or t
  misc_feature (266)..(267): n is a, c, g, or t
  misc_feature (271)..(271): n is a, c, g, or t
  misc_feature (285)..(286): n is a, c, g, or t
  misc_feature (289)..(289): n is a, c, g, or t
  misc_feature (303)..(303): n is a, c, g, or t
  misc_feature (305)..(305): n is a, c, g, or t
  misc_feature (312)..(312): n is a, c, g, or t
  misc_feature (407)..(407): n is a, c, g, or t
ngggataccagcattcccctcctggataccaggcagcttcagccctggcaagcacgatagnagacaatacttgttacccctcccccnccccccnccccgcgcccctccncgccacccgcccnctcggcngcccccgccnccccgcgccgtcccccccccgcccccccctcccccccngccgccgccccncgcnccccacgctccccctccctgctgcgcccccgcntnccggcgctgggccgcngcatcctgccncntcccactanntttngtcccccccccccnnccnccccgccccccccngnccccccnccccccccccccgccccgccccccccccccccccccgcccccccccccccccccccccccccccccccccccccccgcccccccccccccccgcnccaccccccccgcgcggcg

SEQ ID NO: 590199 - DNA, 738 bp, Homo sapiens
ggtggagaggtggtgtcccgcacgtgggccaggctggtctctagctcccggccctcaagtggtctgtccgcgattgggctcccaaagtgctgggattgcaggtgcgtgagcctgcacatggctccggacgaagaactcattagggagagttagtgcatgcgacggcaaacgaatgtgcagctgaaacgattattgtggcctttggaagtgtatgtgtaagaacatggttgcgtggcactctgaggtcatatctgcaaattggcagtccaattaagacaataagagcattatgtgaagagcaaggatagtaggggtgaggttaagtagacaggggtttcagagagagtcaattacctggaatcgtaaatgaacgtttggttggtattttgaagaaggtataatgggcagaatgtacatggtttatcatcgaaggttgctggttcaatgcatgtcagataagctgtgcactatctgacttccctttcattcaatgataattggacatgtcatcgtgccataggggcatggtgtcccaaccgtgtttaatgagaagggcatgtagaaccaagaaagtctgagttgtggacatgcatggacaaggaatgaggaagcggggcaggcgctgatataaaccttacaggatgccttaggggttcagtgaaatatgtgcaggagtggaaatgtggttaatagttcccattccaatgttgagagtggtgtgacccttgttgaagatgt

SEQ ID NO: 590200 - DNA, 401 bp, Homo sapiens
  misc_feature (117)..(117): n is a, c, g, or t
atgaggacagtgtgctcctgtgcggtgaataccacttgtatccaatgaacaacaggagacttgttctaaaaaaatttttttaattaaaaaataaaaaccacatttacacgagagtgnggaggagtgatcccaaccttcataggtgactctggggggttcaagtcttcagtggaaaaagtaactgtggatgtgatggaaaaaagagaactagaattagaagtggagcctgaagatgtgacagaattgtttcaatctcgtgaaaaaacttgaacagatgagaggctgctttgtatagataagcaaagaaagtggtttcctgaaatgaaatctactcctgaagatgctgtgaacattgttgaaaagacaacagacttagaatattacatcaacttagttgatcc

SEQ ID NO: 590201 - DNA, 166 bp, Homo sapiens
tgcggacctaagcaaaccccgacttaggtgatgggaggtgcaggctgatgtcgggggagctggcggtgtgcagagtgactgaaggtgcaagctgcatgtcaggtgagctgccggtgcggagagtgactgaatggtgcatggctgcatgtcggggtgtttggcttta

SEQ ID NO: 590202 - DNA, 1010 bp, Homo sapiens
  misc_feature (109)..(109): n is a, c, g, or t
  misc_feature (136)..(136): n is a, c, g, or t
  misc_feature (142)..(142): n is a, c, g, or t
  misc_feature (148)..(148): n is a, c, g, or t
  misc_feature (386)..(386): n is a, c, g, or t
gcacagttcctgtgggactggaccggtgagttttccattggaaagaagttcaggtggtcccattggttaactcagcctcaaatctcaactgtcaggccctacaaagaanatggagagcctcttctggtggatgctntgctcnctctgnagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtaggggttccccctaaacttgccctgtttatgtttnttctagctcttgttatccccttactgagcggctctactaggtggctgtgattaaatgtcccaagcaaggatagggaaggggaatggttgagcctctggagatcattgtaaccaatcctgccagacctgttctggggcagtggggagcaaacctagataaggacctgttcggggcagcagggagcacaaatctcctttaacaaccaagcagttcctcattcacatcaaacagagcgaggctgtgataacttaggaggcagcaatcctaatagtccttcagtgcattttagtctgtctccaactggacaccagataggtagtgtcaaggccagagattcggggcagtaggataaagtgttcattggcactgagtgcactttagtttttggtctgtgacctgttttccagaaatggtggccttttaggcgggagttaggcgaccaaaccagtgagagccccaatccctgcagttttgtggcttcaagtgtgggtggacagtcctaatggggatctccagctccttcccctgtgggctgtcacagacagctacccccagaagggtcaatgttgggagtggttgtggctctgagctgctctacagagcttcagtgtgagaggatcgagc

SEQ ID NO: 590203 - DNA, 242 bp, Homo sapiens
cagcaccagaggatccacacggggagaagccctacacgtgcagcgagtgtgggaaggccttcagcgaccgctcagtcctcattcagcaccacaacgtgcacaccggggagaggcctatgagttcagttagtgttggaagaccttcagccaccgttcacactgttgatcacgagcggatcacaccgaggaaagccctatgcatgtacgatgtggaggtcttgtttcagcattacacttatcag

SEQ ID NO: 590204 - DNA, 227 bp, Homo sapiens
tgattgcatatagaccatgcagaaatatcttacatcttctgttaataatatttcaatagcaactttatcaaataatatacctacttgccctgtacatatacaaaataatgcatacatgctcacacagaaaaagagtagtccttaaactcaatctatcataacggtattactatcttaacatgtctacaggcagcgtgtcacaagggttaagagacatagaaggcaat

SEQ ID NO: 590205 - DNA, 285 bp, Homo sapiens
ttgaggaagactctcgaggatccccctgctccgcccctctctgtctgggaagtgaggattgcctctgcccggccgccaccctgtctaggaagggaggacagcctctgcccagccgccaccctgtctaggaagtgaggagtgtctctgcccggccacccatcgtctgagatgtgaggagcgcctctgcctggacgccacgtctgggatgtgaggagcgcctctgcccggccgccaccctgtctgggaagtgaggagagcctctgcccggccgccaccctgtctagg

SEQ ID NO: 590206 - DNA, 1190 bp, Homo sapiens
ggccaaggaaggtaccttggctctactgccatctcttccagactccagcgccggcgcagcagggaaaggccaaggcaacatgagcggctctggagagattcatgccagtgcacagcaaggtgcacgactagatgagcctctgtatggatatctaaacgaataattcacacaacattactcaatgaatgaacggacaagggaacctgaagattgtctcaatggacgtgcgttcagggtctggttgtaggaacgatcgggtcgaacgttaccagagatgctcccctttcccatcagtcacacagtaggatgatgcgtgacgtattgaatgaaagatccatcatactcataaatggaaatatgaatgcggagccgattcgccaatgtataatacaatggactcgtccttcaacgatggtgcatggtgagtcacgtccaatatactactggcttcaattcgcttcaacgcacggagctatctcacgtgcgaactcctttcaagtccttaatgtccagcacagggcaattgcttcactgtggatacagaatacttgttcggtgtcatccactattagtggatttctccaactaggaaatatctagcgccaatggattcggcttctacacattatacacgtgcaacttactacgtagctggacattccctaaacactggtaatgtgactagtcacgttaaaacgatacaccaggacttttctatcctccgtgatatccaattggcacagcacagagcatgaatattaggctttgtagtaccaatgtgggtacatgaacgtagtccgcatggtggtgatttcccaatacttacacgaatcgtggagtcaactggatccttaatgtgagggaaactttgaagcaaagaagtcagcttgtttgcagattaaagcatggaatttgctccagactttgaccaggcgaggcgaatcattttgcggggacagaatctaacaggttgcttgaatggaacaaggcagtgggattgaagaagtggagccaaagagtataagttaaataacaacagcattaacgtgaagggaatacttaggtaaaacaagcagcatgcagaaaaccatcagagtatccgcaacgtccgccaggcgggagaaatatgccgcgccagagccgtaggaaaaccccggtcccgaggaggactggtcaaaccttcaacaaca

SEQ ID NO: 590207 - DNA, 553 bp, Homo sapiens
  misc_feature (351)..(351): n is a, c, g, or t
  misc_feature (392)..(392): n is a, c, g, or t
  misc_feature (553)..(553): n is a, c, g, or t
atatatatagtaaatatttgtgtatttttataaaaacaaggtcatatttacatagttttacaactttttgcaactttctttgtctttctgacaatttgtcgtgaatatttctccatgtcacatccatgtatcatcttaattattatcctttaacagctccctggtagtctcttttgcggatggaccatcatttaattcccttgataggcaaactcaccacttagcatgtgttgtcagtgaaccccattcattatatattactttcaaaagattttttctaattgatctttgctcttgtattttcattgggatttctatatgccatcttgattttcataagtttgtcttccnctgagggctggccactcttttttaaaaattgagatataatntatataggatagaattcacctttttaaagtgtacaattcagtggttgttagtatattcagagttgtacagccattaccactatctaattttcattttcatcaccttagaaccccatatcctgttcctccctcctcccagttctaagtggttcttttgtgcn

SEQ ID NO: 590208 - DNA, 200 bp, Homo sapiens
cagaatgattccaccgatggcttgtactgctgccatactcgcgggctcatgtgggagggcaggcagaccccaaggcagccatcacgggcaagggctggcagtttgattcacgtcagatctgtgtgtgtgtagtgtgcgtgtagtgtgtagtgtgtgcagcagatatgtaggggtgtcaactcgtcatttgcaggtgtagg

SEQ ID NO: 590209 - DNA, 339 bp, Homo sapiens
cacgagcacgcgtcatagctgtcgtaggtgcctgcggctctattcttcttccttccatgatattttttcccactattcttcaaattggttaattttttttttttaagacagagtcttgctgtgtcacgcaggctggagtgcagtggcccaatgttggctcactgcaacctccacctcccaggtacaagcattcgagtgattctcatgcctcagcctcccgagtagctgggattacaggcatgtgccaccacacctggctaataaatggtatttttagtaggacatggtttcactatttaggccatgctgatcttaaatgcctgtcctcaagtgatctgc

SEQ ID NO: 590210 - DNA, 1049 bp, Homo sapiens
  misc_feature (714)..(714): n is a, c, g, or t
ccgccgtgagtggtggcacgtgaaccttgtgagctgatccgccgattttagacgttggatgcctgagcaatgggcctcgtcactacgcggttgctaggtcggcctcccttcatcgctgtgcctgtgcccttgaatgcaagtcgactcctgtagccatccgcctgtcgtcgccggatcgccgattaatagtcgtcccttgtcgcacgcagatgtgctctcgttgtcaagcattccgttgccatcctcgaactttgcttgcagccgtggtcctatggtcttgcccactctgctggatgttgttgctgaggtcccttcgttggattctggcatcactctacccggttttgatctaggattcagctagcactgtgcgaccagacctttctactacccaccaatttgcgtgctgagtgattgcgcttgatatacgacgtgctggtatggttgaggtgtcctttccaggcagttggcggccagagcgtgcctttctcagatagtgattgtcttaggactcccccaatcttcggtccacagtcttttcgggtctcgtcttggttatgcactaattagatttttgggggatgtctatccaggacaaggaaacgctcggcatatggcaccaatggccctatgttcctggaagtggctgaattgaacatacgctctttcctatctaatgtgatacatgtgaatcgagttctacgtgatctagtncatatataatcgattcttatcatagtacccaatacttttgatagtttagacttattttgtcatccggacggataggtataggaaacggacactcacgatcccactttaaggaggtcccttgcattcgcgtaatacctgccggtggatggtgcccctgtgacatcgctaatgcatccttttggtttcctcctatttaagtacgaaggggaagtaaaagtcctccagaggcttcagtgtccgtcacttcaagtcgggtccataactccctgtgctgcgctagtcgctaagaagtttacgtacattctcaggtctcactccccttacctacgtaaacc

SEQ ID NO: 590211 - DNA, 1472 bp, Homo sapiens
  misc_feature (510)..(510): n is a, c, g, or t
ccggtatgatgtgctgttaatggacatgcttgtgtcccgagtgcctcgaatattatgaggaggagcctcccagtagacgccttggtgtggtggaaatccacccgggggatgttatactctttctctgcggtgcaaccataaagggccttggtggagttctcctgggaggatggtgtaacccctggggaactaatttctctcacggggggtttctcaaaggagcgcttgagaattgtttgatggggcgcccccctctttaataagggggccccaataaaagaggggccttttttccccctattgggggggccccggccgccccatagtggcctcaagagagtggcctccggggaagatcctacaggacacgtgtgtgggaggaaacgccacttggccccaccaactatttacatggtgtaatgccccgcaacacgcaggcgccccaaaagatgtgtggttcccctgagaagactattgtgggagagtgcccccccgccccccgactgcgcncaagacgacgggggcctcaaagagccgcaaggggggcccaaattagggggcgccgagcgcgcaacgacattgccgggttggaagattaccccacacgggtaggaccctcgagatggataacgcttttccatagtccgtgggcccccctcgggaaccactttcgacagatttctgcctcaccccctatatcacacagggagaaagctcgtctctttgtgaaaggggcgcgcagaggagagaaggacacgcgcgtttgggaaagtttctgtggggaagatctccacgagaacacacttggacgttaattgttcacataccgagatgaccccacactcacaggcggggctaataagccaagggttgggtgttctgagagctttcgggggcacttatttggggggggcgtctctcacacacaaggctcccccgggctctctcacaggttagcacaggccttggggcttccacagactctttgggcttttctggcgcacagggggtcgtccacagcttccttttcacagcccgcacccaaggtgcctctccacggggcccgttggtttttgaaaaggaaagattcgaagagcacacctgtaattgggagaagctctggtggttttgaagttcctctcttagacttcctgcgcccaagttggaacacacttgcggcaagcgcctcttcccacagcctacccccttcctgcgcttgcgcccacagagagcctctgggaaaggagaggcccgctaattgcacagggtgagcacctggggaacacggagaacccaccctgaggggtcagccctagccctcagcccacacctggggaggtttaactaacctggggagaccccccttgcccacaggctccaggtagccaaaacacaattcacaattggtttttttttttggtcccaaaattaaacctcagctagctctgccaatgtccaaaaaaaaataaaaa

SEQ ID NO: 590212 - DNA, 320 bp, Homo sapiens
ggtctctgggtctaatcccatcctgggccaatgcttaaatactatttggtggaaaataatccttggagacagatttcagctacctcccttccaggtccgattaaactgggtggtaatggtcaattggtggtaataggttctacctgtgttgaaagaaaaaaaagaaagaaagaaagaaagagaagggaaattataaggtcaagttaccagtttggaggtttggtgtattttcctggaacatacttcaggtgagaaaataaaaaaaatggttgacaaggcgtgtcagatagagatattagaggacaaagtgctgaagggta

SEQ ID NO: 590213 - DNA, 462 bp, Homo sapiens
  misc_feature (8)..(8): n is a, c, g, or t
  misc_feature (11)..(12): n is a, c, g, or t
  misc_feature (18)..(18): n is a, c, g, or t
  misc_feature (29)..(30): n is a, c, g, or t
  misc_feature (391)..(391): n is a, c, g, or t
  misc_feature (395)..(395): n is a, c, g, or t
  misc_feature (411)..(411): n is a, c, g, or t
  misc_feature (424)..(424): n is a, c, g, or t
  misc_feature (449)..(449): n is a, c, g, or t
tgcatggnatnnggacgngacgaatatannccaataaatctcatctgttagcagtgtgatctcacgtaattttttacggttaggggaacatgatcaaaagagtttggagaccactgttaggaagaaagagcccttgtctggtggttaagaaccttagaatattccctttataaaacgcaaggtcttgggctattcttttaattgatcagctgttagagacctctcgcttgtaaaatgaggatcctgaactgaaaacatgtgaattaaaatttgcccttttcatagcaagattgttaaagtgataatagtttttcattggtaagattttctcaatataaaagtaatacaaccgcactaaattatattttgaaaatgaagactaggcaaaaangggnaaaaggtggaaaaatnccgttacacccanttccaagccccttttccattcctgnattttccctttgt

SEQ ID NO: 590214 - DNA, 856 bp, Homo sapiens
  misc_feature (435)..(435): n is a, c, g, or t
  misc_feature (459)..(459): n is a, c, g, or t
  misc_feature (507)..(507): n is a, c, g, or t
  misc_feature (593)..(593): n is a, c, g, or t
  misc_feature (679)..(679): n is a, c, g, or t
  misc_feature (693)..(693): n is a, c, g, or t
  misc_feature (718)..(718): n is a, c, g, or t
  misc_feature (819)..(819): n is a, c, g, or t
tatgaacgttctatgtgctcgtcgaatggcttgggaccatgcctatgtgtactgggtctcatgattggcctgtgaaggtaggatacatcatagtcaccattataggaggattatgaagatacgagaatgagaggtagaaatgtcatcattatgagcacagggttggtaacggaatgtactgcgtacttttaccaagtacgttcttgatggctctgccgcatcatggaaccatggtacatgttctgctacacgatgtcccacattgcgtggtgtcacctgtcattacgtggcgcattcgttatttccaattccttaatctgcgtgcattctgtggttcgctgctatcgtagctgtttagaaatgatcttgaaatatcagcattgtagtgcacttatttgcacctactcttgttctgagagatgctgctcaggatgncattgtgttctactatgagctatngtatataagcctaaatgaagagcgagcatagaatgtagaggctttgantacatagagattaataagaaaggaccgcaacgatgtgaacgctaggctgaccctgaagagacacaatgaccataaataagcgggantctatgccttcacgacggacacgtgagacactctttggcccgtggggggtccaagatgtggtgttcgtcgcaaccgcaataactgngcgataggcggtanacgtgatcaagcgttctcagaaagnccgccggtacctttggaggagacgtggcggttcgacgcgggacgcactgtttgtaatttaagttgctgtccttgaaagtggtctcccagttccacagggcncccataagtgtgtggtcgccccccacttatttccctg

SEQ ID NO: 590215 - DNA, 468 bp, Homo sapiens
  misc_feature (450)..(450): n is a, c, g, or t
aactcagaacctcaggtttcctcctccgtaaaatggggctaacactgcctaacataaggtgctgctcttccatgccagtgagacaggatgtggggaaagcacctagccccttgctcaataagtagcatctgttgttattctacacacacctgcaggggtctgctatttgatactccttccttcaccacccttcactcacactttgtttttggttagagagtctccatgtccaataaagcttttaagttacacacaggtaaagtattgggcccagaagctgtatttttatttcacgggactttgatattttcaatatgcttcagtgtaacacaaagcttcctgtcaggccaagctggaatgctgccgtcttccctacatgtaaggaattacagtgctggccaacatgaggttaataccaccttacctaggcctcatgggttcatttcctcncggggtttttttccgggg

SEQ ID NO: 590216 - DNA, 235 bp, Homo sapiens
gtaacaccaaagagaaattactttttactatgaggcatcaatttacaggagagatgaaccgctcatctggagatgattagtgtcacagggtattttaagcggatactctcaacccttgagcttactaaaatagcaacaggaggtggctataaaattacattagtacagtatgtactacagttaattttatgaagttaggatgtaatattgcctcttgtagttttgtttttttttg

SEQ ID NO: 590217 - DNA, 204 bp, Homo sapiens
tcgtgcgatcgcagaattaaacatcaaagggacccagcggcatacttccattcagggacttgatacacaaaatgtatcataccaaaaatactactaatataactacggtgtccagggtgcccatgatcccctctcttcctcccgcagcgcgaaaaaaatgagttcctattttctctgggagagggggggattgattagaaaaaa

SEQ ID NO: 590218 - DNA, 1041 bp, Homo sapiens
ggaggccgcaactcaggaccgatgcctgtcaccatgtatcgaaatcagtatgacaatagatgtcactgtattggatgcccccagggcaggacttcatcaaattagaatatgcaactggaagctgttaaacaaggttcagccacagttggtctgaacatcaaaaactacatgcagtctatatgtgctcagcattgaaaagggcgcaaatcagagccttgcatgctcatcagaaacaaaacttctccatgattagaacaaccactactcgcgctactccatcaactcttgccggcgtgccctataacctgccctgcaccttgcctacgcatcttggcttaaattgctacactattctcatactcgcctgctcacgcgccgctgctatctgcgacatatcaccaagcactcactgctactctcagcacctacggaccccacactgcacatgctgctccatccgctcctatgctaatctctcctacacttgcgacagtcaacgtattctcagtaataccgatactaccaaccgcacatatgcagccgcgcagacaaccagtactgagcctgctactgagctcctccactctaatctggacataggactctcacattgcacctgtaacttacttggacgggcccaccatccaacccactatagatatctcccaaatatccctctggtgtactccaatgttcactgacacttacacccgtaaactatagtacaggcatccttggctacaggcagtccccaacctggcataccacacattacattggagaacacgcacaccccagggcatcatatccgctcccaacaaactccaacaatgcgcacttcctatcatcaaccctgtcataaaccacactacatggcagcaattcgcaaacgacacctacaactttaatttggagtagcatccgggacacgctttacacacacattcgtagaggaagccgattggaataacccaaagtgtcgtctacaaacactttggtataacactctagtcataagactttcttcaacttcacccatcg

SEQ ID NO: 590219 - DNA, 440 bp, Homo sapiens
acctacgacttcgggtcctcagaccaaccagcccaaggaacatctcatgaatttcaaatcgggaccccactggaaatcggactgtccaacccggcagccactcccagggcccctagaactctggccaaaggctctctgactgactccttcccagatcttctcagcttagcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcgga

SEQ ID NO: 590220 - DNA, 688 bp, Homo sapiens
tgtcagactcccgttatagaacgactctgtgctcctcccagttacaggtgcgtgctctgctcaaagcactgttgagaaggagatagatcactggcttataactttatggggacggtatcttttaaaataatagttaaatgttacctctgaatttacttccttgcatgtggtttgaaaaactgagtattaatatctgaggatgaccagaaatggtgagatgtatgtttggctctgcttttaactttctaaatccagtgacctctgtctctgggacttggtgtccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacaacccacctttggaaagctctgaccacttgaggcctgatctgcccatcgtgaagaagcctgtaacactcctctgcgtctatcctgtgtagcatactggcttcacatcaaatcctgattctctctaagtggcatagccatgtggaaggcaagccaaggctcacttcacagagtcaggctgctcctgtaggtcaaccagactgtagaaaggctctcatttgtcttacatgcctttaagacagct

SEQ ID NO: 590221 - DNA, 1516 bp, Homo sapiens
cgtatcccaaagtataagccgtcgagcctgcgcactctggcctgagaccctcgacccagccgagagtacaacatatctccggaaagcccggcgggcgcaaagccgagtcggattgggcataagagaccctagactgaataacggagatgtgcctgcttcagtacaagcggatcccaatcgccgatgggctcatcgatagatccttgcctggcttcgattggtgcctatgcgagaacaataaattgtctatcctaatgtcagacccatctcccttaaaaactcactctatgtgggagctctcgtgatggatattcgggccaccctctatctgtcactttgattgatatttagtcaatagactgagaggggtaagttattgcacgacccatgaatgtatatatgtcatgatgatgttgaatatggttcactatttcatatgggaccaacgcatcgcagcatctcattctgctctagaatagaatattgccatcccagtgtagcgcctacttccaccgacgcatatgggggggctttgatccgtacatagcccattgacccccgtttcgtcttcatacttttactttttaaattcctttataaatattcccgggttatacccagttgccaaggcgactggtttacaggataggtccacgacgcaacgtctttcttacaagaggtccaaggccttttttgtgttggtaactctttagtagagttactgagcgtttttcaacatgtgtgtctgttgtgtttgtcagacacacagggaagtgaaactgtgttatctaccatagtgcgggggctataaaaggtttagctttacggacatggaacaagttagcagtttaaaagagctacataatgttataaggattaaccgggtgtatacccattggatattatggcaggtggaaatactttcttaactttttgaattggttattgcggatcaagcaaagtggacgggccgacaaactctaacatcttgttttccaagagatctgccgttaattctaaaatttaacccaccattacaccgggtggaggccaacgtcactgcaaactggcgaaccgaaagagtcctatggcgccattggcttggttcgtggagggcgcaacatctaaagcgcttttggcgcctggttgccacagggccaaccgaccccctatggagccggattataaacttggccagatacggggcacgggacgcgaagacacagactccgcaagggacctgtgacacgtccctctcgtggatcacaacccctaaaacgacgcccaagatatacgctcaacaccagtttgccatgtgggggtgtaaacattaaagaaaacccgcctggggaggtcacttggacatgctcaccccgcagagaggctttgtgcgatggtgatttggacccacacgtgtgagaagagtcccccaaacgctccgacatgcttaaaggacccaatctggtgactgttattatacccttggggtgccccagtctgtggtgcaattggcccg

SEQ ID NO: 590222 - DNA, 464 bp, Homo sapiens
  misc_feature (346)..(346): n is a, c, g, or t
cccgacgatgcctgcaccagaagacctttaacacgtagccagctgttttccgctgtgaaatctattcaccttttccagggcgaatattaaactcattgactcacttctcgcttcaggctgttattttcccaaaggctagactcaaatataatgactcaaaaattatttacatcatttcattctgccaagtatcagaatctactctggacaagactccaacagggaaagccaagagttaaaacataaggagaaagaagagaagagagggcagaggaggacctgggagaagagttgtagcgccaaagcatcaagtaaactgaaacactcaacaccgtccacgcacgtnagtttactggtttaaaaaaatcaaaaatcgaagaaataacgcgcgcccaaactcgtgatggccacagattcatggcatttaaccgatgcccctctgcccgctccccgtcacacccggc

SEQ ID NO: 590223 - DNA, 180 bp, Homo sapiens
atcatcaccggacttatgacaggctgatgctcagcctttcggatactaaacataactatgctgccagatgggagacacccttccttcctgtcagtgtcttagaaatgggggtgagcaatcagcagcaacagtgtggcaagcgagagttcagtcagagtagtgtggtgagccaaaggcatg

SEQ ID NO: 590224 - DNA, 874 bp, Homo sapiens
agaacaaaaaaaaaaaaaaacaacaaaaaaaaaaaagataatagaaatacaaaacgaatcgaatgactcgagtcctgtgggttaatcggcaccgaggggatgctgggccagggataagcagccgtggtctgaagatagagcattagaggagccagagggagcggatgcggaacctgcgtggcagaggcggggcgtagcggtgcagcatgatagcaggaacatgtgatcaagtcttccataccagtggaccagtgccaaataccagacttgcacgtgccccgtacttgggccccactgtccccagaaatgcagctgctgtgatcatgggcaatatctttggaaaccttctcaagagcctgattgggaagaaggagatgcagcatccatgatggtgtggcctgagatgccagcaggaaagaccaccatcctatacaagcttgaaactgggggagatcgtcaccaccatcccataccatatgggttcaagtgtggatgacaagtgggagtatacagaacatcagcctttacagtgtgcgatgtgcgagtggccagtgacaagattcgacccctctggagacactacttccaaaacacccaaaggagtgatatcatgtggtcgaccagccactgaatcgggagcgacgtaactgaggccgggaaaagctgctgagacatgctggcggaggactggccttccgggcatgctgtactccatgtgtctaggcaaccacacagggatctgcctaattgctttaacgctgcttggatcacgtccgcctgggccttcatcccttcgacccggtactggtcttcggcaccttgctccgcgggccgctgtcacgtctgttgtgcccttctacactcattgcctctc

SEQ ID NO: 590225 - DNA, 183 bp, Homo sapiens
ggaaatctatgttcccggcccgggaccgacgagggctactaccaagtcaagatgcgcaacatccgccgcttcctgtatgacggttataagtgcaaggtgacccctgcgcctccctgggcgggagatcacccaccaggagctgtgcttggcctttccatatgcaatggctaccgtagctcgaat

SEQ ID NO: 590226 - DNA, 163 bp, Homo sapiens
ttacttgtcggtcttgcagttaagcttacttgtgttattgcactttatttcgttctacacaacaaattggtttcatttcaatttaagtaaacctttggacttctatgatactttattatagaactccgtcccagagaaactaccaggcagccactgtcgacgc

SEQ ID NO: 590227 - DNA, 773 bp, Homo sapiens
agcggctttttccaccacatgagaacacagtaagaaggtggccatctacaagacaggaagagggccctcaccacgctagctccccagtctcagactttcaggctccggaactgtgggaaaatgaatttcaagtctttaagcctcccagtctatggcattttgttaaggtagcctgagttgactaataacagtaaccatttgtagagggtttatcccacgtttacctggagtaacaaagagagatacatccctaaagaagtcattgccatgtcataggaaaatctgtaccaggaatgttccctgggcagactgttgagaaacttcagactgagatttagggagaagagaagaacctaggaataaagcccaagtcaaatctacattgtctgaatggaagattcttgaattcaagaatgagaacctcaaacagtaagcagcgaggaaaactagagagcagacgaagctcatggttaaaacccagtcttttatagctgacagatatgggtttaatctcagctttatcagtaactgcgtaactttgaacaagtaaatttacttggttttagctttcttagctctaaagttaggatataaaaacatatttcataagatcgttttaagaagtaaactactatgcatgtaaaatacatagtagagtgtccattgtagaggaacactcaatacatatttaataaagtgcttaaacattctcattatcaacctgaacaaagagcatacttgttaagtttgccagtgacagatattaaaagtgg

SEQ ID NO: 590228 - DNA, 903 bp, Homo sapiens
gaagaattttctatctttaataaactttttcttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttaggtgtattcagtagagacggagtttcaccatgatggccaggctagtctcgaactcctgacctcaagtgatccgcccgcctcggactcccaaagtgctaggattacaggcgtgagccagtggcccagcctctttacataaatatttttaagtgcatcttccccttcaggcttggtagggagtcccagtgctacaacgcatggtatgttcccacagcagatgtgtcctgaaacagtgtatagaaacctgtactgggaacctgaatgctttgggacattgcaccgggcagagtctgccagctaaaggactcctggcaacattctgtgacatatgaaactggaaacctggcatttgtcgaaaacctaattgtgcccattttctcacatttggatccatgggtataacaaagggagagggtgagataataaatgagacaagaggacaccacaggtcaccctcggcacgaaatcgaggggacaaattgcgccccacgcacgactgacacacgggacacaagagaaccccgagaaacaacgctcataatagccccgaggtaacgagaaaataccagcagaggcacaaaaattaaacacggggaaacacaagcggccaagttgacccagtgtcgggaacccaagctgaaggcaccttggccacacccaagtggggaaacaggggggcatcaccacggccaaaacgtg

SEQ ID NO: 590229 - DNA, 166 bp, Homo sapiens
ttcgcctacacaattctcggatccgtccctaacaaactaggaggcgttctggccctattactaatccatcctcatcctagcaataatcgccggtcacgagatatctcgtgaccgggcgattacatctgaatatggaaccattggttataatcgccggtcacgagat

SEQ ID NO: 590230 - DNA, 542 bp, Homo sapiens
ctgtggtcacagaaatcacgtgtaccccttcataggtagatgtaatgcacatgctcaggccttccccaggttcaatgtttggtaagtgagcttcttccagacatgcacactgtctagtcacagtatctgtggtagatcgaattgttctctcacatacgccatttacctccttgtccacagttaacactttatcttccattcccgccacacaccaatctttgtgcactgtagtgccagtgtccaaacaaagttgcatgattttgttcttcgtgactgagaaatcagtgatcccgtgtaaccgaagcccggtccagccacgccagcaggcccttgacggcgccgttgagcaccgcctccgaggtcagaaactcattggggcccttgcggaaggtgttgccatcgtaagcggtacttttccgtcggctacttatgtagttctgtacattgtggcaagattctctcagttccagatgcaagttcttcatattctcagtttcgaggccataattcagtgcacagagaatgtccacagcctcccacgt

SEQ ID NO: 590231 - DNA, 1414 bp, Homo sapiens
acccacgcgttcggccaccgttgtccgagcccgacgctatgtacaacaaaggctccgtggttctggcctacagatggcggacctgaacacctcgtgcattcctcgtgtggctagaaggaatcaaggctatgacgtcatctgcctatcatcggccatagattggcccatcaagtgcagcacttctgaggtaagcccacgcgacagaaggcactgcaaggctctggcggccaaacataggtgttcgcttagagcgcatcgtctcgcatgggcagtccgtggcacggagttctatctgtccggccatccatgatctcagcgacactagatatgtagagacacgtctaaccctccatgcgtgccaccatctcattgactcaagggactcatgactatcggacctcagcagagacgaaagatggtgaatatctgctccaagacgtgagaagagtcgcgtccccacatggtaaatgttgtctccgaccgagagacctacaagcgtcccatcggggactcgcatgccacggtctcccgcgattttgaagactcaagcctagcctaacatctacttggtactcccaccccagtagtcaccaggggtcccattgcctcctcttgtggaagggagtggcccctggaagtatctactagagcgtggttttccaatcggttgccgactatattggaccctgtgcactgggaacgtcaacggcttacatggcacccaccccggggaatttcccccgatattccaccggggtttaaaaatccccccaaagtagccctcagcgtttgacgtacgacctcgtgcgattgcaagttaaaacccctctaagtgtccaacctatttcacaaggccttaactgaagggcgcttgtggaacacgtctcattggtgcagataaagcccgcataggaaaactctatatgttgggcacgtggcccaagagcttcatccttaacatgcggacaaacgtaccaccatggggaaacgcccggcgccacacacatggatcgcccacataattcaacccccatgttaaacaatcttcttgccgacgtaattacgaacgttttcctccactaccctgtgggcgatcgccctgtatgaaaagcgtatgcagcccatcggtcaaaggaaatgttcgacgaaccgcaactaagaaccctacgtttgtacgggctcctttcaaatggttcccttggataccgaacgtcctacgcgtgggcaaggaacttggcgggttgtaaccgtggtacttggccaaattccgtggagcagaacacccgcgactatctaggttgggaccgtataacattctccagaagagagtcaactcaaaggggaggacccccaggtcattggcacacgattccctgttactccaatgggtgcacatatgagagcacttcagaag

SEQ ID NO: 590232 - DNA, 316 bp, Homo sapiens
tggggtatctcaaaagagcacaggagccaacctgaaagagctctcaaatgtccaaagctagaacaatttgagaaaccaaagaaatgataggttcgcatagcccacagaataatatatgtatatatcccttgaattcaaactggactggcagggcaaggcagggcacagcaagcacaactctccctgatagcaagcaatccaattcaaataaatgtagcacatgaaagcaaaatagcaaaataactcattaagccaatcattttactcaatcaattagtatgtcaggcaaaacatccaaactgtgagattgctaaaa

SEQ ID NO: 590233 - DNA, 365 bp, Homo sapiens
atgagagctgtttgcacacacccactacgcttaaactgtctgccttgagcggaagcacactgaaaccctcaccacaggcaggtgtcccgaccggaactttccacccaccagaagcgagagcactcttctatacatatcacccagtcgtaggagtactgatgctaaacacaaaaaggacaaagaaaattgactggctaagataaacccatgaaaaatagtatatataactgatccttttaaaaagagggattttaaaaaatattaatttgccatatttactagcacttccctaccgaatgatttgttttggaagaccttgtaaagacggacttaataattcaaatgctcataaaaaggcttggaca

SEQ ID NO: 590234 - DNA, 113 bp, Homo sapiens
catgcagttccgcaagccgttgcagcacctgcgccacccgcaatcccggcagtgatgtatcgacctcgatggcaagacactcgcgcgtgtatgtcatcgacgatgttcaagca

SEQ ID NO: 590235 - DNA, 418 bp, Homo sapiens
ggtttcatgcctcttttatgagatataaaatattaaattgcagggtgaagacactgcacattcctgattttctgccccattatacttctacacattcagtttcccttgtccctttatagcttcactactacacataagtgcccattggaaaccactttttttggatgttttttaacctcttattttagggaaattggaatagacattattcacctttcaataggagctgcaactgcctctacagtatgacaagatacttgtttggcagtgtttctcatttctttgttactacaccaagtaaagccattgagttaataatgctatgtttctatttcggttattttaagtgtaataacagtgttcttcattttatttatagctccaaaaggaattcttcatttgtctcctgatgtttatc

SEQ ID NO: 590236 - DNA, 887 bp, Homo sapiens
ggtttggattgagctttgtctttgaggactattgtctctgatgagctgagaaacaagagtccacccagcgcaagtgaagtctgtactctggtggcttccagtggtaaaaggcatgttggaggcaggtcaagtttacccatgggggaactggttccatgccaaagcgaaccaatcctgctggccagggaaagttccccaatgggagacaaagctgaggatggcttcctatggtagtctcccactagttgaatgcatttccgccgccctagaactagactacggtgctctatgacctcctggggaactgtgtgggagtggacagcatcacctgtaccaggctgctgagcttaggacatgcgctgttctccggggtggcatcctgtggatcgacagcgagcatgatggctctgcacaatcaccgggcccgggtcaccaccaggatgggcaagactccatgattcagcctcagacaacctcggtttccgctgtgctgcagacgcaggccggtcgccaggggatctgtaagacagccgggtggtgacaaagtgcagaaaagcctttctagggtcactgtcattccctggccctgttgcaaacagcgcaattccaagctcgagagcttcagactcaggaaagaacttccccttccctgtctcccatccctctgtggcaggcgcctctcagcagggcaggagaggactcagctcctgtgtatcggaggaagggggccccagtgtgtgtcgaccgatggctgtgcggcaggatgtgtcctgggacaaggccacggtataatttgacccaaggaattggaacatacacaaaacaattgggaacagaagccatctcacgagtgcattattacagcatataaaatctatacttacccc

SEQ ID NO: 590237 - DNA, 350 bp, Homo sapiens
ccaggctgggcaacacagggagaccccctttttacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccctctctcaacacacaacctaacatccccccaacaccgcagcgttcggtgaaacaagtgggattttttgggccagcaagttttccaaactgtatatgatgcatcctgtttccatgtgtaatatattttaatgataaatgtatttttaacagtga

SEQ ID NO: 590238 - DNA, 390 bp, Homo sapiens
  misc_feature (30)..(30): n is a, c, g, or t
  misc_feature (80)..(80): n is a, c, g, or t
  misc_feature (118)..(118): n is a, c, g, or t
  misc_feature (191)..(191): n is a, c, g, or t
  misc_feature (259)..(259): n is a, c, g, or t
  misc_feature (302)..(302): n is a, c, g, or t
atgggatttctccccagttcaacagatgtnacaaactcttccttccaggaagtgtggctataatgccctcagtcatgatncctcattattccccacttaatcccctttcctacctctntcaatcatagcaaggcccaggcgcagtggctcaggcctgtaatcctagcactttgggggctgaggtgggtggntcacctgaggtcaggagttcaagaccagcctggacaacatggccaaacccatttctactaaaaatacnaaaattaggcagacatggtggtgggtgcctgtaatcccagctnctcaggaggctgaggttggagaatggcatgaacccgggaggcagaggctgcagtgacctacaattggccactgcactcccagcctgag

SEQ ID NO: 590239 - DNA, 976 bp, Homo sapiens
gcagaagtgtcaccctgtgtggtgtctccctcgtgggtgctcttcccctagacctccccctcacttacataaagctcccttgaagcaatgaaatgatggtgtcccagtgtgctgcagaaacttggaatgcacaagcctcgtgtggcatgcgggatgcggaaacgacggttgctatatccatgttcctgctctctgctcatggtgtggctgtgacaaccctggcctcacttgattcatctctggttttcttgccaccctctgggagtccccatcccattttcatcctgagcccaaccaggccctgccatttggcctacttgtcccttggcacacttgtacccacaggtgaggggcaggacctgaaggtatttggcctgttcaacaatcagtcatcatgggtgttcttctgtcaactgcttgttcattgattcgcgggatgtttgccccgaatgagcaggttgaggacaagactgtgggtggcgaggccctgcctgacccatcccttaaccttactggccccagcctatgtggaggcaagtggaatatcttatattgggcgatatgggggctcggggagtgcagagaatctcttgggagatctgggtgagctcttgggtgcattctgtaacctacttgaatctcaaagcacaatgtggatacggggaccaaaggtcacggacaacatacccctaaaggacctgcgtaccgcgcacagatgctgactgaatggacgatccgcacgaataacctgaagaccatcggcactcactaacttcccagactaggcacccagcctggcaactgacggaagccacaagaaacaaacccgtccaaaacaacggcccgcaccaacgcccccgaacaggaggagggcaacaggccgcaaccgggagccgaacaggaccaaccacacccagacaaaccaaaacagaaagcaccaacgaacacagcaacaacacacacaaatacgcaaatg

SEQ ID NO: 590240 - DNA, 441 bp, Homo sapiens
tccataaggtgtgccagagacaagaagtggcatgttctgtgggaaaatggaacaacacagagttgccaaaaaccttcaagttgtaaaaaaaataaaaataaaaataaaataaaaataaaaaaagtggtatctgcaaagtgcaataaagcggagttcaataaaataagatgcctacatagacttctgttctgtgcctttttcctccattctggaaggtactttatgcttccagggacttggcttctctgggttctgagatgaatcctgtggttgctcatggacactcccatatgtagacatttaggatgtagttactggtgtttttgaaaaattcattggctagattggctagttttcatctttcaaatatttatggaagtctctacatttgatattttcctgtcatattctcttggtcttaaagatacatacatatatttc

SEQ ID NO: 590241 - DNA, 436 bp, Homo sapiens
aaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagtagtataatttaaatcgccttgaacaaaaagtttatataaaaggtaaggtaaaaggcatctctgaaattcacagaagcctaggaggactggggtaagcggaataaacctagagaagggagacatggtagggattcccctttatactgtgaagttacatgcataaaagggtcaaacctgtagatgcaaaaaacaaaaaaaaaga

SEQ ID NO: 590242 - DNA, 114 bp, Homo sapiens
actctcggcaccacctctctctctacctacccgtccccggttgctacctcttacccgtacccggttactacctacttatccatccccggccaccacctacatacccatcccctg

SEQ ID NO: 590243 - DNA, 712 bp, Homo sapiens
cgacgcgagcggccgtgtgttggcgggcagactggccgttcggaatgaagattataacaggtggaacatgccataggtgatatcatgctcggatctacaagcgttctgatccatacatctgaaggagcgggcttagttgtactgaagaggaatacttggctactgacggagactagtatgataggcatatatgtgcatatacgagcttacatcagtgaggccatgcatgtgactgttgccaatgctaaaagtatagttgctgaaggcagagtgctgacacagaatcacatgctaacttacaatgatacaatgacacattgccagtgtgacccaagctgtgtgcagatgagccttgacagaatgatgacactgatcaaaaacagagtgcatgtgttggcctgtaagagtaatttgatacatgtaggatctatagagaatgaccgcatcggtttatatggacccatatgggacctttgacactgaacgctaagctagtgcattgatataagggattccagaatcttcgattgagatgccacaagtaatgcttttatagacatcgcaatgttaactatgatgctaaacatgaccggagaaagctgatgcaacaacaatgactagcacaggcacctggccgatttcaatgttacaagggtacttgatcaggtttaagcctttaagaatctgatctgaaattcaatgtttggatttt

SEQ ID NO: 590244 - DNA, 194 bp, Homo sapiens
tgctgggattacaggcgtgagccaccatgcccggccatgacacattttttgactgagcacctaggtaataagactcttctccattgcttggactctgtcagagaaggtattgtgatgtatcactgggcctaacacctaggtgaagatactgtcttctcctgcctggacactccataaattgtatattttgatat

SEQ ID NO: 590245 - DNA, 1002 bp, Homo sapiens
ggacgcgtgggtcgctcaggtcacccagcacccttcggaacccagaaggcccgcgctcttgaaggtgatccccccttggtggaggaatggcgatggcccctgcgaggacgatggccccgcgcccgcctctccccggccggaatccctgccgtcgccttgtggtttctgtgcacgctcggcctccagggcactccagggcgggccaccgccgcgcccccttggaactgtccagcgggagccgactgcctcgtaactagattttacactgccggggttgcctggcttcgtgctggtgactacccaacgcctcggatctagcaaacggcagctagcttaccctggagtcccccaccgaatgacgccggggctgggaactgcgtagcagcgcctgcttgcaccacccaagaactgccaacttggtccgctaaatggagctagcaacgcccagacccgccggggcagggacgccagtcgccgcctgcctacctcatcaaactggcatctacggaggcagaaccttcgtgtgcgagttcagcggcccgagggagggcttcatcatgcgtacctcactgatgggaacgtgtaccgctcctatcggcatctgctggaacccatggggctttggagtggtttggggatccccaaaggcctgggcatggcatatgacgttgtaaggtaccatccccaaggaagcccctggtgctgaaggatgtggcataacacagattggggtccctactgtcggggctgtaccggatgttcaaggtcacaagggaaggacccaaccaggttgaaacgtggggcggctctcaggaagggcctaaccggtttcacctttaatgaatagcgttgaaccccccagtggaacggccacgctccatcaacggtgcgttcacccacgagaagaatggctctcaacacaagagggtgcgccgggtcttcccggagataaacgccagattaaaatctctcggccgtgcaaccacctcctgcgaaatgtcc

SEQ ID NO: 590246 - DNA, 260 bp, Homo sapiens
gtcgatgacagcaccttggcatcgttgtgcctaacctggggagacggaagaagcacgccatgggaagtgtttacactttggggacaagttctaagtatttttggagcccattaggccccttgaggttaggttgcttacttgccctttctcctgaacctgtcttccaagaatgtggatttggggaaagtggtcttaaaggattcatttagtcaccctcaaattaagatttttactccatctttctgggcctccacctccac

SEQ ID NO: 590247 - DNA, 130 bp, Homo sapiens
attttttgattgtttagcaattaaaatttatgacattttaagaacctttaaagttacttagttaagggattgaaaaccaaagttactggtttattgggggatctccttctagagtctcgacctgtgcagg

SEQ ID NO: 590248 - DNA, 314 bp, Homo sapiens
  misc_feature (287)..(287): n is a, c, g, or t
  misc_feature (304)..(304): n is a, c, g, or t
aggtataggaattctcgaaggacttgaaaacaagaatcaaacagatacctagacaccaatattcaagaagcactattcacaacaggcaaaaggtggaaacaacccaagtgcccattaatagatggagggaaaaacaaaatgtggtctatcgatatgctggaatattatctttctcttaaaagggaaagaaattctgatccatgatacaacgtggatgaaccttgaggacattatgctaaatgaaataaaccagccaccaagcctgtatgattctgcttatatgagtnccctagagtagtcaaantttttaaaca

SEQ ID NO: 590249 - DNA, 513 bp, Homo sapiens
aaaatgatgtattaatttattgatcaaaagacagggcccttttttattacccaggcaggctgacccccagcggcgcagtcaaggctaactgtaggcttaaactcccggcctcaagtgatcctcatgcctggaccatcacaacgggctgggattacaggaatgagccaccatgcctggcctgtatcatgtaattcaacacattcccatctctaagggataacgagcggcagcgcacactaaacgcagataacttaagggttgcaattaaatcgcactggccacaaatgcccaagctttcccacaatacatgaccaaatggttctgcatgagaaacacacttgcagcagcaataacaatgctgagtgaagagccttcatagacacacatagaaacatatctagctccctgtcttgaaatgcttcccttattcctgttctttccaagaggaagagctaaaaggaagctgtatgagttcgctaatgccggtataccaaattatcacaaacttcatgg

SEQ ID NO: 590250 - DNA, 1044 bp, Homo sapiens
  misc_feature (1)..(1): n is a, c, g, or t
  misc_feature (6)..(6): n is a, c, g, or t
  misc_feature (10)..(10): n is a, c, g, or t
  misc_feature (13)..(13): n is a, c, g, or t
  misc_feature (16)..(16): n is a, c, g, or t
  misc_feature (692)..(692): n is a, c, g, or t
  misc_feature (864)..(864): n is a, c, g, or t
ntactngggnggnggntttgtattggtgggggtcggccgggacgccgggccatccccgtccggggcgctgcttttcttcttccgcgtgtgtgaaggtagtcgcatttgctacgtccttactgtgtccgcaagcacccgcacaaccacacctctcgccgtccccccaacaacactaaacctaggaccgcaccagagggtcctagggggcgccctgacacagatatgtcccggagcgggtattgggagcacgagtgcaggaagtacagacaagagacgcacacattatagcgagaaagacacaacagtccccagccatgaggcagtgacacataattccagatcgctataaactttttccagcccgtggtcggagtttagattaatagtgcggcttacgtgttcgacatgctatcatgactatgagggtcatgtggagggtggttaacagtacggtggtacgggtgtgtgccatccacgacacattccaaccacctctgacagaatcataaaaaacataagcaaggcgcatgtaacgtccgatacaccacagacaaccagcacgcacccggccacccaccctcctcccaaccccacatatcgcacccacgctatcggctacggcggggtgcggagcgtagtacgcgtgcgagcgccgtggtgtggcgcgcgcatgagctgtgaggagagtcgtnggagcaggtcgagtccgatctatgtagtgtctacacacacgcagcctccatatcaccacgctcgaatgcggcacgcgcgtggtaacacgacgggcggaactaactcgtcttgtcacgcctactacccacatagagggagggggacgcgagggctagcatcgtctctcgttantatatacaaccactatccactcttcatcgccgtacctggactgaatattaaggatgagcgactgcgctctaagtggaagtgacctccacatcaatacacaaccagcgtacgcagcgacgtgtagtcgtcttgcaggatgcatcggcacgcgagattccagaatcgctgcgctcgcggagg

SEQ ID NO: 590251 - DNA, 116 bp, Homo sapiens
taaagttgggacatatgcaagacaggcaattgtaagtcagcgacccatctgtactgtgtattttattcattcatcgaggatcttttcctttatgtctttaggcatgattatagctg

SEQ ID NO: 590252 - DNA, 139 bp, Homo sapiens
ctagttattactttttttcttttttgcattgtagttttcagattggagaactaggcaaatacctctgacaagtaaattcgagtttctaggcattaatagacaatcctatctccaactttcatgtgctgctcttacagac

SEQ ID NO: 590253 - DNA, 735 bp, Homo sapiens
  misc_feature (452)..(452): n is a, c, g, or t
  misc_feature (612)..(612): n is a, c, g, or t
  misc_feature (627)..(627): n is a, c, g, or t
  misc_feature (672)..(672): n is a, c, g, or t
  misc_feature (678)..(678): n is a, c, g, or t
gagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccagtgaagcctggactctatggggcgggaccctggtgtggagcctgagcctgatgccctggagccagccccggaacccctgaacctccagccagggggctgccccggtgatgcatgccatgccccgtgggctgatgcctgccctgcccgccgatgcagccatgagctgagacggtcatcttgttccatgcctgggccactgtgatgctttattgatcgattggcaacaagctgatgggctccctgctggacacgggtccccaggccttcagccgcgtccagatctaccacaagcnccacggccaattcctttcgcgtcgtgggccggaagatgcagcccgaccagccaggtggtcatcaactgtgccatcgtccggggtgtcaagtataaccaggccacccccaacttccatcagtggcgcgacgctcgccaggtctggggcctcaacttcggcngcaggaggatgcggnccagtttgccgccggcgttgccagtgccctagaggcgttggaggnggtggncccctccactccagatttccaccggggcggcccgaacggcgctcccgagcggtgctg

SEQ ID NO: 590254 - DNA, 1011 bp, Homo sapiens
ggaaaaaaaaaaaaaaaaaaaattagccgggcgtggtggggggcgcctatagtcccagcttactccggaggcttgaggcaggagaattggcgttgaacccaggaggcagagctttgcaattgagccgagattcgcaccacttgaacttgcagccttgggcaacagagagagactccgtcttcaaaaaaaaaaaaaaaaaatgtgggggagagaatcagggtgagacttggggcgcctgtgttccccaaatttcccactaaattctgcgccctacgttgagatgtggggggttgtgccctttggagaagggctctacaaggttgggccaccattcctccaaacctctctcccttcttctccaggggccaggccacccaatttttctcatcaaggggttggcgcgcagggtggattccctctttaaagagaaacgggtgaattctcctcttttgggtgcccatattgttcctcttatacaaaggggtgtggggacaaattgagaaagaattgcggattgtgaaatacgccgccggcggtggcttccaaaacagaacaacgggggcagacgcaaagcgaaaatattcttcctgtggggggagaacctattatacggcccactatgtggggtttccacccttgtgttacccaacacctttggggctcgtggggtgcccaaccgagacatcacccaccggtgcacgaatgggtcttcttacttgcaaaccacacccccggggggggcacaaacctcgggggacgcagtttcacccaaaaaaggcaatgcctgtgattgggaaaaaacctctccagtggacaacttttcgcgacgaggcgcttaaccgtttccacacacggacgttttaatcacagtccgcatattcccacctcacacacgcggtggacgccgtgtgtgttggaaaagcggcgggtacctaatcatagaggcgcgaacaccacaagagcgcagcacgacgaagacaaaatacaaaagagaacgaaccaccaccaaac

SEQ ID NO: 590255 - DNA, 708 bp, Homo sapiens
  misc_feature (300)..(300): n is a, c, g, or t
  misc_feature (302)..(302): n is a, c, g, or t
  misc_feature (310)..(310): n is a, c, g, or t
  misc_feature (314)..(314): n is a, c, g, or t
  misc_feature (316)..(316): n is a, c, g, or t
  misc_feature (323)..(324): n is a, c, g, or t
  misc_feature (329)..(329): n is a, c, g, or t
  misc_feature (332)..(332): n is a, c, g, or t
  misc_feature (338)..(338): n is a, c, g, or t
  misc_feature (341)..(341): n is a, c, g, or t
  misc_feature (343)..(343): n is a, c, g, or t
  misc_feature (347)..(347): n is a, c, g, or t
  misc_feature (354)..(355): n is a, c, g, or t
  misc_feature (357)..(358): n is a, c, g, or t
  misc_feature (360)..(361): n is a, c, g, or t
  misc_feature (365)..(366): n is a, c, g, or t
  misc_feature (368)..(369): n is a, c, g, or t
  misc_feature (372)..(373): n is a, c, g, or t
  misc_feature (433)..(433): n is a, c, g, or t
  misc_feature (604)..(604): n is a, c, g, or t
  misc_feature (613)..(613): n is a, c, g, or t
  misc_feature (626)..(626): n is a, c, g, or t
  misc_feature (642)..(644): n is a, c, g, or t
  misc_feature (678)..(678): n is a, c, g, or t
gagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccagtgaagcctggactctatggggcgggaccctggtgtggagcctgagcctgatgccctggagccagccccggaacccctgaacctccagccagggggctgccccgggaacaaccaacccgtaggcaaaccgcccccccgccnancacccatnaccnanaccgtcnnctctnccnccccgnccncnctcntcctttnnanncnnggcnncnnccnntcgctccctgctggacacgggtccccaggccttcagccgcgtccagatctaccacaagcnccacggccaattcctttcgcgtcgtgggccggaagatgcagcccgaccagccaggtggtcatcaactgtgccatcgtccggggtgtcaagtataaccaggccacccccaacttccatcagtggcgcgacgctcgccaggtctggggcctcaacttcggcccccccgccgcngcgggcccntttgccgcgggcnggcccctgccctcccnnnttggcccgccgggggcccctcccccccccccctncccctggtcggtccgaccggccctccccgg

SEQ ID NO: 590256 - DNA, 938 bp, Homo sapiens
cgacagcaggtcaaaacaggagctgatatcgagctggcagagctgggccatggaaccggtagagaccgaaccctcagatgagaggaggggtgaaggaaagcagaacgaggcccgtcagaacggaccgaggatgaatcatatcaacaaccaagcagaatctggatggcgcaacacggcgccgaataccacgataacacgaaacatgacaagtacgcaagaagcagccagagagctcatccaggggcgggggaggaactggctggccatgggcccagtagcaccagagcaatcaaacttaaggatccagtaattctggacagattattctagaataagcaactgcataatcaaccaaaacaaaataccaaaacaacccaaaaaacaattccaaaaccccaaaaaaaaccacagacaacaaaaaacaaaacataaaaggcgggggggccgacctacagtcaaatctacagtcagagaagccagcaactacctctacgaaaaagaagaagtctactaatcgaaatccggtgaagatacctgagtaccgaatataattataagaaccaaaagtcgcgggagacgaaatcttaaaaaataaaatggcagtaatgcagggagaccaatgatcgagatagtcgcgatggcccttaaggagacgcagaatcctaatatctaatgaggcgggggtgaataaatctcttgaggcaagaaaaacaattctcccaatagaaatacggtatttaaacaagagtcaaaaggtgagcaggaaccatatagcaaatatataccaagaggacatgaatgaggaatggtgcctaaagcccaaccaaaggatacaagttgtccccgattccagagtgcaggggtaaatgtatacggattgacactatgtggccttgatatattgtaagcgaagcgattccctactttaaggggggagg

SEQ ID NO: 590257 - DNA, 388 bp, Homo sapiens
ggggcccccccccccccccaagtggttaaagggggccacgggttgggttccccccccccttcccccggggagctccagggatggggccccatttttgtttccccccccaaagagggggggtaaaagggggggccagttttttcccccccccccccttaaaaattggggagggggcccccagggggggccccccaaagggttttggggcctttttccccccccaaaaagggggcgcaaaaaaggtctttggggcccccgtttcccccccccccccccccccctaaaacaggggtttttgggcccaagggcagggggggggggggcccgggaaaaccccccgggggggggggttcccccccttgggtttttttttaaagggcccggggga

SEQ ID NO: 590258 - DNA, 810 bp, Homo sapiens
tccccttggcccttaatttttttttgggcggcgtcaggaaaaaacccggggttagggtgccccttctcttccctccccctctctacccaaaaaaccccctcccacaaggacatgacaaaacccccagaagcctggtgttgcctcaaagagaccttgggatggcaacgacaatatgtttgggatgtagatctcttcttctgtgtccccccaagacaggtctggcggaatgtgtggacaaatctcctctggctcacagcccgagatttgatggcccatagacccgctggtataccatctgattgcgggccgcctcccctaatacagcctccgccatctttcccccacgttgggtgcctctacaatacccgcttgtatccaccgccctgggatattggccccagtgtggggtccccaaaaggcgccgcctctccgcgttacttgggcccgtgggtgttcttccagaggccgtttccatggtcccagttgtgttacacagtgcgagctctcaactcttcaaaacacccgtgaaaggtggtgcgccgataggtctagaacactccgcaactgtgcctctcttgggagcgtgcccggtgtggccagcgacctccgggaaacaaatattcaaacccgggcgtggtaacccagggtttaaacaactcttcccggatataacacggcaaagaaccacatattggccacacgtgtaccacaggaatatgagaaaaccgagccccgagagaatccatccaagtgccttcctcaatgtcccaaaggaagatttccccagagcaccacagaagcaccctcatg

SEQ ID NO: 590259 - DNA, 107 bp, Homo sapiens
tctgagttccctcacagcttgggcctacagtattgtacacggacttccagtaagtatctttcccatggtgaccggctgtacatcggtctggccgggctcgccagtgt

SEQ ID NO: 590260 - DNA, 1534 bp, Homo sapiens
tgtgtgctgctgtggctgtgctgtgtgacattcactgggccactttgctgtgctgtgtgagtgtgtgctgtgctgtgctgcccctgctgcacatcacttcctcgtgctgcctcccctgttgttgatgtgactgtgtgctgaactgagtgcgctgtacgtgacatggcttgacatgcagtggctgtgacatgcagtggatgtgacatgcatgttgctgtgtgcatgtggtgtgctgtgagctgtgctcactgtgctgcctgtgggtgtgtgctgccttcccttgtgttttcccttgctttcccttgctgttcccccttgaaccctcaattgtgcttgtgtgctctctgtgcctctctgctccctgcttgtggccttgatcttgattgtctctcctgtgtgtcccctgtgctctgcccatgtgcttgctcttcttatcctttctcagtgtgagttgtgagtgtggccgatacacctaggcactttaaaggagtggctttgggcctgtcctttgtgcacggtgccgcttgaatgccctgtttcctttagtaggccaaccaggggccgtgtgtctgaagcctattccaaagagaacaaggccggctggtttgggacccctatacttatgtgtgaaggtgccatatggctttgttatggccaaggtcgtttggagggcggaccccgcggcagtggcggagccccttaggaagagcggaacgcctcccttttggaagtgcttaggccgccaggtaccttagaccatgggcgtctaccgctccgtttgtgtggtctaaagccctggccgcgttaaaccttattccttaaccccctgatgcatgctgctgcaatggcccagcttgtcgcccttggtgtgtggctccgccttcgtgccagcacttctaccgcagtctaacacagagcagatttcgcagccccctttcctactcttgctccttagggcgcctctgtcctgtggaacctccaacttacctgtcggttggaaccacctgcgcgcatttagcgtggtcgcgacagggggccccgacagctggtgctcccacacggtttcgggaagagaccgcccttgtgggtggagagatagccaacaccatccttcctacagtgctgtggttctccccttttgtgctcttctgcgtcgtgcttatctctgcgacagctcgaatagttgcgctttggtccgctgagtacgttttgccgattttgtctcctgaagtggacattgtgcgctagcgtttacattttgcagtcgccagacgttcctctgttgccccgtagcatggtaagcggccagatcgcgttgagtcgcggaccaccaccagcgggcgtttaggcggggggcacaggtggtctcgcacagggcgctggctccctccatttctatcagacgaagcccctatcgcgcgcgcgccagggacgggtatcgcaagcgtctcacaggaccatcgtgctctgtgagggagcacgtgtcgttccctctagttagtatctgtcgcgtcctcctagctgatctcgctgt

SEQ ID NO: 590261 - DNA, 153 bp, Homo sapiens
ctcgtctcatagatggatcccacctatattcccccgtgtaacccgagagactttggtttcccggtacgctgtcccggcggggtcatgggatactgacgccgccgcatcgccggaggtcacatctgcgccattatgggtgggtaccgatgctcg

SEQ ID NO: 590262 - DNA, 235 bp, Homo sapiens
  misc_feature (204)..(204): n is a, c, g, or t
  misc_feature (208)..(209): n is a, c, g, or t
  misc_feature (211)..(211): n is a, c, g, or t
  misc_feature (224)..(224): n is a, c, g, or t
tttttttgacagtttttaaaatttaaaacttcttaaattttaaattaaaaataaaacactttcactactattttctagatgaactcatttagtctcttggctaaaataccatctatatctgatgactgcccaactggtatcttcagccttcgctacccaattagtatgtcagcagcctacctggcaaatccaatcaacgctaancagnntnactacaacaaacngactctcctcc

SEQ ID NO: 590263 - DNA, 251 bp, Homo sapiens
  misc_feature (186)..(186): n is a, c, g, or t
  misc_feature (200)..(200): n is a, c, g, or t
ctaggcgggtgtccccttcctccctcaccgctccatgtgcgccctcccgaagctgcgcgctcggtcgaagagggcgaccatccccgatagaggaggtggcctagagccttcagtcactggggaaagcagggaagcagtgtgtgctctttattcactcccagcctgtcctgtggcctgtcccactgngtgccttgctgttntccctgtccacatgcatgctgtacagacaccaccattgcattttcatagtg

SEQ ID NO: 590264 - DNA, 467 bp, Homo sapiens
  misc_feature (423)..(423): n is a, c, g, or t
gttgccgtggttgtgggttgacgtggttgtgggttgacgtggttgtgggttgacgtgggtgtgtgcagtctcggtgaggcaggccacaggaagagccgccagccatgtgtgggctgcccctgatgtgcactgggacctgccttctggcctgcagcccagtcatgttggcacggcccccagccaggcctggggctgctgactggctgtctctgccccaggttctgcctcttgggagtcctggccctggtcatcagctgtggcgcctgggattggagctggctgtgtccgtggtgagtggcagagggggtgaggtccccggttgctgaacctgggcactgggggagggacgaggggaagcacactcctctcccatcccatcttccggggcactggttcccgagagcgttggggaccaacaatggncacagtccacctgtaaccccagattcaaagtcaccctcctgagt

SEQ ID NO: 590265 - DNA, 572 bp, Homo sapiens
cacagtggttcacgcctgtaatcccagcacttgggaggctgaggcaggcggatcacgaggtcaggagatcgagaccatcctggctgacacggtgaaaccccgtctctactaaaaatacaaaaaattagctgggcgtggtggcgggcacctgtagtcccagctacttgggaggctgacgccggagaatggcatgaacccaggaggcggagcttgcagtgagctgagatcgcaccattgcactccagcctaggcaacagagcaagactctgtctcaaaaaaaaaaaggagaaaaaactcaggaaagttatagggctctaccagtgtactattgggacacctcgggaggagaggaacttgtccaattttaacagtataaactttatggtttaagtagctaatatttaggccaggcgtggtgggcttaagcctgtaattccagcacttcaggaggctgaacgggtggatcaacctgaggtcaagattttgagaccagcccggccaacatggtgaaaccccgctctaccaaaaatacaaaaattagccgggcatggtagcgggtgcctgtaatccca

SEQ ID NO: 590266 - DNA, 522 bp, Homo sapiens
tgatgctgaggtgctctagatgatccctttcagaggtcatggactctggagagagaaaccagaccatgttagagggcagaaaccactccagtggtgacacactgtggagtcctggcccacagcaggacacattcattccaaaataaaaaacctagggcacaggtccattcctccttttaagaaaaaggtgggcaacggtctaagaatggggagaatgatcccctttcaagcactccgtaggttttatgggcaccaactaattggcagagtttattggaaaacggaagtaacctggtctttgtggccatttaccttacacgaaaaagaaccctaaggtcgacctacaaactacagaggtgctacgttctctttctggggttttcatttctgggtggtttgaatctggtgttatttttctactaagttaaaaaccacttgttggatttaacaggttttttgtgtatttttttttgcaagccagtgaatttggatttatctcatgggtaaagttcccaagtaaaa

SEQ ID NO: 590267 - DNA, 163 bp, Homo sapiens
atgtgaacattactcatgtcatgatcaccaaacattatttacctatgaaattgtgaagaactatacatattcagcaacatgttataatttggtcctctattaacagacccaattgccaaggagattttacacaaattcaattcacaagcatgtacacaagaga

SEQ ID NO: 590268 - DNA, 449 bp, Homo sapiens
  misc_feature (431)..(432): n is a, c, g, or t
gatgcagaatggtataatcttccaaataaccaatgcatgatattacaaaatcacacacaggtaaaagatccattcaagccaagcacgatgtacacactctgtcatcctagcaactcaagatgctgaggcaggaggatggcttgaggccaggagttcgaggctacagtgagctgtgactgtatctgtgaatagccactgcactccagcctgggaaacaaaggaatatgctgtttccaaaataatttttaaataatcacaaaatgattcctaaatgctccaaagttccctcctttctcaaatctattttctaaataaattaagaaactttcagggacaatggccactcttcatttttacttcttcccacagttctcctgaagtgtatagcagacactgatgtgtgctgcccctagtagctttcggccactttnncaggatgtgggtatttt

SEQ ID NO: 590269 - DNA, 357 bp, Homo sapiens
ctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaggaggcagagcttgcagtgagctgagatcacgccattgcactccagcctgggcaacagtgttaagactctgtctcaaatataaataaataaataaataaataaaaataaacccagatgttgccctc

SEQ ID NO: 590270 - DNA, 681 bp, Homo sapiens
  misc_feature (1)..(1): n is a, c, g, or t
  misc_feature (71)..(71): n is a, c, g, or t
  misc_feature (174)..(175): n is a, c, g, or t
  misc_feature (324)..(324): n is a, c, g, or t
  misc_feature (336)..(336): n is a, c, g, or t
  misc_feature (372)..(372): n is a, c, g, or t
nggtggcctagtcaggctcgggaccggtacatttgagggtggcaaactcacggatagtgtatgaaataganatacatactatcagcaataatgttaggtacattttttctcctcaaatacatatttggagctatcattttccttatcccttcctacttgtgcagcagttgattnnccagatattatgttgaacataatgctcagaaacatatttaacatcatagttgtatatattttaaagtagaataaataatggaagcaacttgatatacaagtttatactaaattttcaactgtgtgaagatacatttaagggcattactntgctaataatcnacacattcttttttctatttaaataaacaaatggtntgtggttcacagctttcatccagctttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaacaaaaaaaaaa

SEQ ID NO: 590271 - DNA, 173 bp, Homo sapiens
tgctcagcaagctgaccacggcgggcatcaacggccagttccgcacgccgcgccacatcatccgcctgatggtggagctgatggacccgcagcccactgatcgtatctgtgacccatcctgcggcacggcgggctttttgattgaaacctacgaccatttgctgcgccagtac

SEQ ID NO: 590272 - DNA, 101 bp, Homo sapiens
ggaattttctcactgctgtttttgtcaggtttgtcaaaaacagcagtgagaaaataattccataatcaattgtgctgggataactggctagctgtatgcag

SEQ ID NO: 590273 - DNA, 497 bp, Homo sapiens
tgattccatgagagtctgggtatacaccagatgccatccgaaccaaaatccgcgacggcatttggccgaagcacaccgtatggaaaaaagctccagacggtcgcgtccttatagatgttgaggggtattactcatgggtagagatgggggaggcgtccgcgccgtgtctgcaagtagtatcgagatcacgttccaataccagggcgtccggtgccgtgagcgtgtccagctcaagcccagcgccgctaatataaagaaggcagagttgcacaaggctgcgattgagcacgccattctcgcgggtacattcgattacgctctaacctttcctaactccaagaaggctttggctttcaagactccggaagatagccagagcctgggcgtttacttggttgagtggctggacaagaacaacggctcagctcaagtcaagcaccgccgaacactaccgggaaatgatagatggtctgctgataccaatgttcggccactta

SEQ ID NO: 590274 - DNA, 165 bp, Homo sapiens
aaggtcactgaccggtcatagtgcaagcagagatgatgggattataatggcttccgtgagcatgcgtatttctccagtccgacagctgctggagtgcctgccatggtctcgggaatcacggtggcatgctgcactgatgtgtgggtggccactccatgtcagttg

SEQ ID NO: 590275 - DNA, 949 bp, Homo sapiens
tccaaatgacttagatttaatcatcggaagcaaactaatgggaacccttacaatagagaagataattacttgtcagggtcctttgggaaaactgaccggggacagaaggggactggggggctggccccccaacctggatcccttctgaacaaagactgtccacagtggtccctgggcactcgggctcaggaaagggggagactctgctgggtcctggtgctattgaatgtatgccttgcctagcacctcactctcgggccagcatcaggagccccgctcttgcccggtctctgggtcatcgccttttctatttgtgggggcgcctgaaacagatggtcatccaattccgcagtaagcaaaaatctggccggtctcccatctggcctggtcttaataagtctggcagtcttcacaggccaatgggtctcccatatggcccagttccttcatggtccaccaaatgtaccctgtctcaccatttacaccccaggtgtctcacaggttctcctggggtggtcgctgggcccagaaggggagggtaatgtaacgacggatgggtcgctgggcccccaaaaggttcctgggaatcagcgggtaccgaaggaatggacctcatagggcctgggcaacaggccctgtatggcgccattggtcccacaccatgtcatgggcctggcgatatctccctggtacaacggcttggtgcccacacgccaatcttcggaggcacaaccccttggagacacaagcttgaggtgtccagggaaaacctttggggacacacactttggccattgggaaatcccgggaaaggttgggaatcaaattcggagaagaaatctattggcatcgcccccccggaggacaatggggcgccgggcatggggtctaggcatcagtgatgacagcaaggacttccttcaaattcttgattccacaggctgaccgg

SEQ ID NO: 590276 - DNA, 442 bp, Homo sapiens
catgcagcataatacatctcaacaaaaaatccaaaaggatcttttaaagtataaatggaatctctagtttaagatccttcagtgacttctaaccactcttagaatcaaattccttcaggaggtaccccttgccaacttctccctacctcccattaatacccctacggctataatatcctggccacagtggcctaaaaagcagtctaacagcagtgccaaattctcactttcagggtctatattgggagacagagattataaacggaaccaattttctaagtaccaaaagaaccaggtccacagaatctcactttaggaacatgtcatgagatgtggcccagggagtttcaatgtcagcaagaagctaatatgctgcaaaaaaggaaaagacttcaagtactatttacaggacgctttccagtaatgccattgggccagcggg

SEQ ID NO: 590277 - DNA, 780 bp, Homo sapiens
  misc_feature (18)..(18): n is a, c, g, or t
  misc_feature (65)..(66): n is a, c, g, or t
  misc_feature (84)..(84): n is a, c, g, or t
  misc_feature (96)..(96): n is a, c, g, or t
  misc_feature (100)..(100): n is a, c, g, or t
  misc_feature (109)..(109): n is a, c, g, or t
  misc_feature (112)..(113): n is a, c, g, or t
  misc_feature (116)..(116): n is a, c, g, or t
  misc_feature (119)..(119): n is a, c, g, or t
  misc_feature (124)..(124): n is a, c, g, or t
  misc_feature (146)..(146): n is a, c, g, or t
  misc_feature (149)..(149): n is a, c, g, or t
  misc_feature (159)..(159): n is a, c, g, or t
  misc_feature (162)..(162): n is a, c, g, or t
  misc_feature (164)..(164): n is a, c, g, or t
  misc_feature (174)..(174): n is a, c, g, or t
  misc_feature (188)..(192): n is a, c, g, or t
  misc_feature (208)..(208): n is a, c, g, or t
  misc_feature (223)..(223): n is a, c, g, or t
  misc_feature (225)..(225): n is a, c, g, or t
  misc_feature (262)..(262): n is a, c, g, or t
  misc_feature (264)..(267): n is a, c, g, or t
  misc_feature (272)..(272): n is a, c, g, or t
  misc_feature (296)..(296): n is a, c, g, or t
  misc_feature (307)..(307): n is a, c, g, or t
  misc_feature (349)..(349): n is a, c, g, or t
  misc_feature (359)..(359): n is a, c, g, or t
  misc_feature (362)..(362): n is a, c, g, or t
  misc_feature (364)..(364): n is a, c, g, or t
  misc_feature (374)..(374): n is a, c, g, or t
  misc_feature (415)..(415): n is a, c, g, or t
  misc_feature (426)..(426): n is a, c, g, or t
  misc_feature (474)..(474): n is a, c, g, or t
  misc_feature (481)..(481): n is a, c, g, or t
  misc_feature (498)..(498): n is a, c, g, or t
acccccatcttccaaatnatctctggtttcacggggaagaaaaaacctagggctgctgtgaatgnnccctctgaggtccctgantcggccccaggnaganctgtaaganatnncgnagnggggntccgtgcctgacggcgatgatnctngaggcaacgngcngngcagaaaganaagtcgaggtagtnnnnnggagttaggctttggngggatgggccagaantncaggagggtggagtattgacgattgcagagtcagggntnnnnggggnggggggtcccaagtggggaggganttggggttttnttgttagagctttcttctctcggtcactgagggcggcaaatngccgctgctnttntngtttacgctntttttgttcttgctgcttttgttgttgttcctcccgttgcngcggggctgcnttttgctcccttttccgtgtagcctgcggtgcttccatttttggtgtnaatggtngtgggatctgagttttnttgtaattgtaggtatttggattctttttcatgaactttcggaacttattacgtgttgatttgttagccgcaaaagtataaggtggcggggctggagagttctggacagtggggtcagcacctgcttccagcagcagacgaaccactgagcctcttccagctgcagctgctgcatgcaggagagtaaagccaccggagcccaagggggcactgagcagagacagaactctagggtctgcagggctgggagctagctgcagctttagcactccaacatctcca

SEQ ID NO: 590278 - DNA, 145 bp, Homo sapiens
  misc_feature (105)..(105): n is a, c, g, or t
gggacatactgcatattcatcacttggaaagcatttatagaattctcctgatacttgcctttcagcatgtcatttcattgcagattaatcacttccagtagaggntataggtggaagctcctcggctgcacagttaaatggattt

SEQ ID NO: 590279 - DNA, 153 bp, Homo sapiens
aggctctttggggggaggctcccccttgagaccagggaggtggaggctgcagtgagctgtgattgtgccactgcaactccagctgagaaacagtgagactctgtctcaaaacaaaaaacaaacaaccttgaaaagtgaggggaaaattcagat

SEQ ID NO: 590280 - DNA, 193 bp, Homo sapiens
ttccattttttaaaaaggtttttttgggggccccccggcccaacccccggtgagggttgtgtggcatgagcttgggccccgggcttcccgggggcctttgccgcaggggtttttgggcccccatccttggggttttatttgcagtgggggggacagagggccctccccccaataaacctttcctgaaagcaga

SEQ ID NO: 590281 - DNA, 763 bp, Homo sapiens
  misc_feature (97)..(97): n is a, c, g, or t
  misc_feature (160)..(160): n is a, c, g, or t
  misc_feature (163)..(163): n is a, c, g, or t
  misc_feature (168)..(168): n is a, c, g, or t
  misc_feature (170)..(170): n is a, c, g, or t
  misc_feature (178)..(178): n is a, c, g, or t
  misc_feature (183)..(183): n is a, c, g, or t
  misc_feature (190)..(190): n is a, c, g, or t
  misc_feature (200)..(201): n is a, c, g, or t
  misc_feature (208)..(208): n is a, c, g, or t
  misc_feature (229)..(229): n is a, c, g, or t
  misc_feature (232)..(232): n is a, c, g, or t
ggcgggcgcaaggtcggcgtcgcacgtgtgaaaccggggaacccatggaagccgagtccggcgacacaagttccgagggccggccaggtctacctgnccggcgggggccgcgtacgcgaaggggaggagctggtcatggacgaggaggctatgtgtctancancgagngnagactgcnccccntgtctcnagctttgacnntagtccngggatcacctgtggagacaancgngacagagcttcctcttacactttacatgtgtgtgctgggaccccaaggctgagagcgcccagagcaaacaggactgatgatgcttcggaatgcacaaatcgtgcatggggaccaagagcccgcgcaacccttcagaaggggcacgggactgaacggaacgacccgagggcaggacacgactggcaagcagggatgaaagcaacgacgccggaaacccttcaagcttgggaatgcgttgggccccatgggtggccccaacttaatgcggtgcgcactttcaaacgcgcgggaaggtttccggggcggttggctcactggggccttcgcgcgctttgaccaaggaatggcccctttgttggaccagccttggggcgcgtgggtggcgctccacggaacgcacaggggggccccaagggttgggcaagcgttggtccatgggcggcctcgcggaggcggcggcttccttgccaggcgtgcgtgggagtggtagccccccagggggcccttggggaggcccttttctcccgggga

SEQ ID NO: 590282 - DNA, 371 bp, Homo sapiens
aaaaaaatgtatttgaagcctggaatcaatatttataagatgattgtgttcctggttcatatatgctaattgataagtagtcagttacgttcaaagaacactgtccatttagggtaaataatccttcaaatgcaggaaaatatagaataaaaaacgggtttgctgtactgaaattaaaaattttttaaagaattatttttcactattcctttagtcttagctctgtaaataatttgcaaaatcacttaacagtatgaaaaaacagaacaggaccattggtgacaagtattttctctggcatattgagagataaacagattggcattatgtgtctcacataacaagcaataaagaggacagaaaacaaaaaa

SEQ ID NO: 590283 - DNA, 170 bp, Homo sapiens
  misc_feature (123)..(123): n is a, c, g, or t
aatagacaatgaccgtgtggtgtgcgcggtggcactgcgctgggaacatggcgttgacgtcagacataaggagctcatcggcaaatacgccatgagagactatgtcacaggcttccaggaggngacacacagcacaacactgcaaacaagggcatgtcggatgcacccag

SEQ ID NO: 590284 - DNA, 1109 bp, Homo sapiens
  misc_feature (124)..(124): n is a, c, g, or t
tcttctccaagaacagtctgtgcactcttggcccaaggttgggagtgcagggggtgtgactctgtggcctcgcgtgaaaccttccaacccccgcgggttataggcaattctccgtgccttcagnccttcctgtgagtatagcgtgggattgtgcagggcacgcacacaccacgctgtgggctgtgaatttatgggtgatttatacgtgtgggagacggggattttcgccgaggtgtggccaggcgtggctcgtgaaacactcctgtgaccttcatgtgaatctgtgcctgtgccttcgagcagcttcccaaaggtgtgcgtgggattatacagggcatgtgaggccactgtgacaacctggggactatagggtcatatatcgctacaagtgtgggaattggcacaattttaaaacaaactggggggaacatttttaaacaatgtggccggtgggtatacctcagtctggtgtttctcgcccagtcttcgcgaaatgtcatttccacacgcgagagaaaatatttatatttaacgagtggggtttacacgaaactttagaggggccgtgagacccatgtttgagaaacacttgtgtatagagagatccgtcgaataaagggggtgaattaatcaacgtcgggagcaacacaaagggctttattagaccacagcgcttattagaagacacccaaggtgggccactcttaaagacccagaggtttcctcaccaagtgctggtgtgcgcccccagagaacccacatgtgcgcgtactcgaggatattccaacccctgtggggagaaacccggggaggaaaacacgggcgcccagaggggacgtcactacaaaggggacccccacaaaggttcacaacaagggcccatgcaagcgtaggaacaatcaccaagcgaagacagattctcgtgggcatggtgggcacaaggggggagcccattactatccgcagaggggacaacaataagcggggacatgggctcgaaggttcacaaaagcggtctgccaagatgacagcgcccacaacgtggcgatcctctcaaagaatgtaaaatctctcgcacagaggggggccccaggggcaaaatacatccg

SEQ ID NO: 590285 - DNA, 1200 bp, Homo sapiens
cgcggaacagtgactgctgcgataatagctgaggcagtagtgcagctttcagagggtccgggctcagaggggctaatgattacggagggttctgccgcacgggactggtgccgggggcctcttgaccccggaggccatggcacgcgcagaggcaggcgttgaactcatggctattcacaggtcctccagtggcgtctctcagccaggtcgggactatctgtcacgccacgctatctcatttgcctgaagaaacaataccagctctaccgctgctcttcagcgcagcctctcctcacgcgcaatcatcaatgcaggcttcgtgctcgtgcacgacagggagtgtaccctgtgcccgttagtgtcgacgtctcactccccctgggagcctccgcgctatcaaacccccatcgcggccctaaccactcctatcgcctcgcgctcactccagcaaacacagcgcactgcctcggacagccccaatggaaaccacgccacaccgctgcacagcgctcgccagcacgcgcaaggcagcagcgagcagccccaacacggttcctccctcgcatcgcactcccctcagcaatccaagcccttccggggcaaccaaaccggtcttccccccttagtgcattcaacacccaccatgcacgtgggcaagttgggcctttctcggcgcggctccttccaatggggggcacttgcggcagcgcacgcaaacgcggttccaggcgtcttttggaccccccctttggggttcgctcattgctgttccccaagtggggcccctctcccgggcgcgcaacaaaagggttcccaaggcacacccatttcgcagcggacagctacccttatcacccttggcgccaccgggagcaagaagcgagcggaaccaacgtctaccaagggtcctcctatcccattcttcgaaacagccaattcggcatggaaccccaccgacgcaactccgcaccaaaccacacccgggctcgcagcccatcctcgcaaacaaccgcgggactcccccgatccggcacacggtcccccaatcagcaccgcacaaccacatggggccccaggccaacgaccttcgagcaaccgtacaccaaacccctcagcatcgggaacctacggggcccaacacacagcagcaatccacacaccgccagcccccggggaaacccctcggggcccttgggcaca

SEQ ID NO: 590286 - DNA, 253 bp, Homo sapiens
gaccggcccgtttatagcgggatctgccggcacaccatcatccaactcgacacgatggtgccacgttgctgacacaagcaagccgtatggaaactttctgctagctacaaagattcacacagggaaaggcacggagctctgcggcgagactgggaaggtcctcagccattcagcaccatgcggacgagctcttcatagttgatacaaccattgctgtcctcatgccctgccaccagcatctccgctttggaaa

SEQ ID NO: 590287 - DNA, 138 bp, Homo sapiens
tgtgtgatatatcgtgcctcaagctggtgccccgcggaagcgacagattgctggtggggcaaggaagccgtcgagaaatcgctgcttgaactgggccccatgagcggcgcgcaaaagcgcctgatggcctgtgtcctg

SEQ ID NO: 590288 - DNA, 352 bp, Homo sapiens
cccatacccactccacctgactaccagacaaccttagccaaaccatttacccagataaagtatacgcgatagaaattgatacctggcgcaatagatctagtaccgaatgggaaagatgacaaattataaccatgcataatatagcaaggactaacccctataccttctgcgtaatgaattaactagaaataactacgcatggagagccaaagctaataccctcgataccagacgagctacctaagaacagctgagcacacccgactatgtagcagctggttgtacacgatagaatcttagttcagctctaaatttgcccacagaaccctctaaatccccttgttatctgatg

SEQ ID NO: 590289 - DNA, 331 bp, Homo sapiens
cccagctgttctctaccagacaattgaataatatattaaaatctttgaagaagaggaagttgaatttatcagttgtgcctgtcccagtagtttgcagattgtgatcctgccaacattgttcatgactttagcaagatacttacagcctatttagatctgaacctggattagtgctatgtgatccctctgtacacttccattgttctgccgacccagagaccgactgtagtcacttattaacatcaaggctggaatcctatttgcctcattcctatctgattcatgagcacctggtttttactgatcgccttgaatcccttggtcccctggg

SEQ ID NO: 590290 - DNA, 193 bp, Homo sapiens
gacaggtcttgctctgttgcccaggctggagagcggtggtttaaccacagctcactgcagcctcgacctcccaaggtagggactgcaggtgtgtacactggggtgcaccaccacacccagctaatttttaaatttttttttgtagatattgtctcaactcgtgtttggcccagaacgtggttcttgtgaaatc

SEQ ID NO: 590291 - DNA, 436 bp, Homo sapiens
ccctccctgtccacgcatcccggccctaactttttgttttataaccattgattatactagtgcaaatttggcagaaccatagtaatatagtcttgactgggagaccgcgtcacgatggtcactagccagccttccacccaacatggagatgagctctcctgaagcatccttcgcagatggtcatccgccctttctattgtgaacctaattggagtcactgtgagttctctgtcatgttagactgaaatcttgtatctgctgctgcccattgccccatgtgtaccttcaggagtaagacagaaaagtgatccaagggccctttatctgaaatctgtggtcttatcttcctataatctctgccactgacagtcaccttcaacctcaagcagcggtcttcatgcttgtggatgggtttggagagctggtggaagggagg

SEQ ID NO: 590292 - DNA, 425 bp, Homo sapiens
atattaaaaccactaattgttggtagcctgtaaagatcttaaccatttaacaggacacacattattttcataataaatggccactggtgggacatgggactgactaattggaatagagttggaaataccaccttggaatgatgcaaccattattggataatttaatctaagaaatctatgcatgtgaattaagttaaaatagggggtttaaatccaatttataaagcattagaaggttacctaatctcttctgggttaaatgtgataggaatgtatgggaatgtgaagaaattatggaaaattaaaggactcagcctctttaggaagttggctaaaatggaaaggttatgttaaattaattaatatcttcgttaatccaagcatctaatgaccaatctggaataataagcattctgcctttgcaa

SEQ ID NO: 590293 - DNA, 904 bp, Homo sapiens
  misc_feature (366)..(366): n is a, c, g, or t
  misc_feature (419)..(419): n is a, c, g, or t
  misc_feature (440)..(440): n is a, c, g, or t
  misc_feature (708)..(708): n is a, c, g, or t
gattgtgctccgtggcgggtcaatgctccgttggctcccgataccgtggtaggcttgagccttgcttaaagcaggtagaccacaaggctccctctgtgctctgactttgcagagtgagatcgtgcgcccgatcacttccatccgctcagggtacataggcccaccggggtccatgagatgcactccaagagatgaatcgtagcgaactctggagactaggggtgtagcacaccgaggaagcatcgctcacatacgttatcgaagcgagcgcctctggctcagagcctggcgttgagctgtgttaactcgaagaagccctacaacgctgggccgcagatgggcttctgtagcgatcgcatctgtggnctttgttatctcctgtgctcgtttgacggaggcgttcgctgtccctccgaggngtgctcgtctttgtggaggcntcgtgcacccctttcggaactgccgcgacgggaacccctttgcgcaaaggaggggcgtgtcccagcgcataggtcggacaatcttgtgtctcgcttggcctagttatagcgcattggggttcgctcgccggaaagtgatctcgccgagtgagatcatactaattcttggtccctacgttatacacgcggattcacgcagtacgaggtgtcgatggagtggtaagaagggaatcagtcactaccgtacaccatacgcatgaaaggcgcnagccagggttgttccacacgaactctggaccaaaacgcacgttttgtatcctatggaggaagagttccacgccgacatgactatttaggcgtaacccctgggcgggcccggtaggttcaagtttggggcacctctgcctcgcaatttccccgcccgaaagggcgtattgggaaacgggaaggggggatgttcgtcc

SEQ ID NO: 590294 - DNA, 820 bp, Homo sapiens
  misc_feature (4)..(4): n is a, c, g, or t
  misc_feature (444)..(444): n is a, c, g, or t
gctncttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatctggtgttgagacttcggggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggttttcatgggaagncactttgacagacattattgtggcaaatgttgtctgacttactgcttcaacaaaccagaagacaagtaactgtatgagttaataaaagacatgaactagaaaaaaaaaaaaaaaaaaaaaaatggggggggcggcaaaaatttaaacaaccggtggggggggcccagaaggaaaggaaactggcaaagtcgccaaggaccgggtcaggacaggcgggtgccaccaaaaaacgcggcggccgggtttatgaaaccagaggtcggggtcacggtcacccaggcacgtctaccccccggcgcgcggggacaaaaacaaggcacaacaaagaaaggaaaagcaagacacacacataaccaaacaaaaaaaaaccacacca

SEQ ID NO: 590295 - DNA, 146 bp, Homo sapiens
gaactgctgcctatatcggggaatgtggcttgtgttcacaaggaggactcactgagatcagggacatgttgctggccaataaggtccagctgctgccctgctggtgccattgccccatgtgaagcactgtgccagaccagaacact

SEQ ID NO: 590296 - DNA, 624 bp, Homo sapiens
  misc_feature (4)..(4): n is a, c, g, or t
gctncttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatctggtgttgagacttcggggtggtgctaagaaaaggaagaagaagtcttacaccactcccaagaagagatctctcgtcacaattatgcgcattcgtcagagcagccttatgatgaatatgcatctggagtgattataacacgtgactttgactgacattattgtggcacatgatggatgacttactgcctcaacatagcataggacaagcagctcgtatgaggtaataactacaagtaccattcctacattatctttatttattaaacaaacatgtcgagcgtattgcaccagaacattttactttggacaactattgcctgctgccttaattggtgacaagttgctcccgtcctaagacttatgggattcacttgcg

SEQ ID NO: 590297 - DNA, 760 bp, Homo sapiens
  misc_feature (384)..(384): n is a, c, g, or t
gcaggacatgcaaggtccagcggtcaaactaggacgcctcgtaggctacagggagacaagactggagacccagaagcctgaaagtggttcttgaccgactttgtccactcaaattaaggcatcatgcagctggaagatggacgtactttgtctgactacaatattcaaaaggagtctactcttcatctggtgttgagacttcggggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggttttcatgggaagncactttgacagacattattgtggcaaatgttgtctgacttactgcttcaacaaaccagaagacaagtaactgtatgagttaataaaagacatgaactagaaaaaaaaaaaaaaaaaaaaaaatggggggggcggcaaaaatttaaacaaccggtggggggggcccagaaggaaaggaaactggcaaagtcgccaaggaccgggtcaggacaggcgggtgccaccaaaaaacgcggcggccgggtttatgaaaccagaggtcggggtcacggtcacccaggcacgtctaccccccggcgcgcggggacaaaaacaaggcacaacaaagaaaggaaaagcaagacacacacataaccaaacaaaaaaaaaccacacca

SEQ ID NO: 590298 - DNA, 487 bp, Homo sapiens
ttctcgacagcaacattttgggcagaggagtgtgagacatactttagaagtgcttgatgctcctggaataaatgtggcatcccaggcatagatgatcgcttagagaaggcaggccaccctgctgattagggcagagggtgaggcagtctgtgccttggaccctttggcctactctgccctttcagtgcgcgggaaaggggtcagctgtgtacattcagaccactccccgttttagaaccagaaggtggctggcattcgaagtggctgagggcacaggttttagaaggctgtagttgaatatggctcctaagggcagccccatctacaacagaaacccgatcaaatgaatctgctattgggatttctccttcctttcaatatgcaacaggcacttgaaggaaagcgggaacatcccagctactgaacctcaggagcaccacagaggccggacacaaaggggcgaggcaataacatgttgccagtcggc

SEQ ID NO: 590299 - DNA, 562 bp, Homo sapiens
  misc_feature (495)..(495): n is a, c, g, or t
acgttcccccacggtgtccagtgcagaggagacgaagcctgtcctcaccgcggctcgcggggcccaggcgggctctggaaagccggtgcggtcctgggcaggaagcccggcccgtggagcaggttttcgttctgcttcagcaataaataagggtgaccacagggacttggctttgggtttcttttccggtgaaagggtgggttttaaagtgagatacacttttccgtagaacaagtgttctatctttaaaaacccaaatggcagcaccgtggattacgggtctcagaacaactcatggcgcatcagattggactctctgattttcggtctatgggccaaatggccctttaacggcacctgaatccttggtgtactgatgccttggagctgggcacctggggagagtgtggtgtggcggttaacggttcttcctggccctggctaattacagtctcgggtgcccagcaagcccctttggcttccttccgtgacggntcacgttgtcggcctgggctcagcgtggacctgccccatgttgaagaacctggcctcaagtggactt

SEQ ID NO: 590300 - DNA, 296 bp, Homo sapiens
gaattccccccccccccccccccccccctttacagttggtgggggccatgaggtggaaagtagttttcacgggagcgaggggaaacgggggaaccgcccaaagccatcgggtgacctgtggaatgtgtgaatcccctgaaattgtttcctgctgtggtttaaacctggggggattggtagggagaacctgtccctgggttgggagtgagggtgaatgtaaaaccccacaggccataacgagacagttagtcaagactttcattttctggagaccgatctcttactcttgccaagga

SEQ ID NO: 590301 - DNA, 833 bp, Homo sapiens
agagtttgttttttttttttcaaacccatcaaaatctacttatttatgaatccaaggggtgggcagcatcactctgttctagcattcttggtgggagatggtctgggtggcctagctggggagtgagcagcagcccatccccggttcactttctctagcccatcattacctgtgaactggcagtgggggcagtcagggcaaatagaatggggctgggggtttctccttctttgcagttcatggtttggcccggctaggaattagaagacagacaccatgtcccaggacagggtaacttcttctgcatgatgtgtggtagactcccttggctggctggtgcagggatactgagaaaatacatgaacagaaacggcccaggtggaacagcacgtaacctagtgagtgactgtactcctttctaggaatgctgattcagagtgcacctcttggactaggtcccaggatcccctgtgtccctggagtagggactaactatagcacaaagtaatatgtgccaaggctattggtgaaaggttgggacttctaaaggactaagggattggtggggtatggcttaagtttggaaccaaatcctagagccagctgataatattgaataatctagagggagagaataagggatgtaccaaataagtgggggattcccgtccttatgaaggtatgcatagggtaatggaaagatggtaaagtttttcaagtttgtgccgtcagttttgtggggacatgtgtatttgcacgtggagggtttacattgcattttgtaagtccaataatgagtaactgggttagaaaaaaaagaaaaaagagacaag

SEQ ID NO: 590302 - DNA, 181 bp, Homo sapiens
gctgttctagagtatcaccctgctacgagcgcagcctgaaacatgtacaaaacaaaatgatgctttttccattttacaatctctgatttccataacaaacaaaaaaagggtgacattctttttaaagttaggtagcttcatgaaacaaagatttccatctgtaaataaatcactttcttgg

SEQ ID NO: 590303 - DNA, 850 bp, Homo sapiens
  misc_feature (6)..(6): n is a, c, g, or t
  misc_feature (84)..(84): n is a, c, g, or t
  misc_feature (93)..(93): n is a, c, g, or t
  misc_feature (140)..(140): n is a, c, g, or t
  misc_feature (192)..(192): n is a, c, g, or t
  misc_feature (197)..(197): n is a, c, g, or t
  misc_feature (201)..(201): n is a, c, g, or t
  misc_feature (211)..(211): n is a, c, g, or t
  misc_feature (226)..(226): n is a, c, g, or t
  misc_feature (256)..(256): n is a, c, g, or t
  misc_feature (258)..(258): n is a, c, g, or t
  misc_feature (273)..(273): n is a, c, g, or t
  misc_feature (295)..(295): n is a, c, g, or t
  misc_feature (323)..(323): n is a, c, g, or t
  misc_feature (342)..(342): n is a, c, g, or t
  misc_feature (471)..(471): n is a, c, g, or t
  misc_feature (475)..(475): n is a, c, g, or t
  misc_feature (479)..(479): n is a, c, g, or t
  misc_feature (488)..(488): n is a, c, g, or t
  misc_feature (529)..(529): n is a, c, g, or t
  misc_feature (532)..(532): n is a, c, g, or t
  misc_feature (540)..(540): n is a, c, g, or t
  misc_feature (547)..(547): n is a, c, g, or t
  misc_feature (636)..(637): n is a, c, g, or t
  misc_feature (810)..(810): n is a, c, g, or t
  misc_feature (812)..(813): n is a, c, g, or t
  misc_feature (839)..(839): n is a, c, g, or t
ccaatntcctgggccacctgcagcagggtgcgctccaaccccctttgaccggaactatggaccaagctgggggtgaagccatgntgtggttgncggagaagtgcgcgaggtttaccgcaagggacgggtgttcgccaatnccccagactcggcctgcgtaatcggcctgaagaagaaggcggttgccttcanccccntcantgagataaanaaagacactgatttngagcaccgtatgccacgggaatagtggtgncntgacgctgccggctnatgttgaagatgctggcacaanaccgcatcagtatggccgcctacgtgtnaggggagctggagcacgtnacccgccgcaccctgagcatggacaagggcttctgaggccagccatgcccacgcccctccccagcccccacccatgccagcgcagcgccagggctcagatggggcctgggctgttgtgtctggagcctncaancagntgggggctncgtccctgctcatcccatcccctgcctctatccctggcccnctnccaggccnccctccngctggtgtcttgagaccagcctgccaggccctccagcaggaggacagagtgccctggggcatccaccttcctgcccaggggacgtggcnntgtcggtgtttggaggctgctgcccctggctttggcgccccatgggccctcagcgtctccccatgctgggctcactacatgggccagcccttgctctacctggccggtaggctgtggcgcctaggttgtgttgagagggggatgccctggcctgcctcactgtgacctgctcntnnccacgtgcagcacctgtcactttttntagaaataaaa

SEQ ID NO: 590304 - DNA, 852 bp, Homo sapiens
tggtgctttaccccacccttggcctccccggaatgttcctagtggggcctcttttctcccttgcagcctatcacagtgaaaactcattgggggtcatcaggcagtctactaaaaatagtctcataaacactaactagggcacctcgggaagttgacaaggacccacctcctgcgtctacctcgtggacctccatgtggctgttatgttgagaggttgagctatgggggatggcctgcgacgcactcatgtgtgatcttctactactgaaatcggtcctcggaaagccgagtgctgactggcaagggataaacgcacactagtgatccgttgtgtctggagaaggcaagggtagggtcgaggacgtcagcaagagggtatgtctccccgatagcactctcgacgtaagagggagacatagggtgggcttgcgtagtgggtgcaacgtcatcaggaattgatccttcgctataggtatgcccaggtgagacgtggtaatcaaacagttgggagacgctattgatgtgctctcagattggaatcgttgatttgaagagatcaatttaagaaagggcgatgctatggatgagactgcagattcttgatgcatacaccgtgcatcttttatggaagaaggtctcgaaaggttcacgagttggacagttcaacgctaggaaattccgaggtacgatttctgaagaagcattgagcttagaggcgacacttttggttgaaaaattgccacaaacgtactaattggaaaagtatctaatatagttgaacctgggtacattaggttgggcaagggtgcgtaggtaaatactacaacctatttgaaaggtagggcttgaatg

SEQ ID NO: 590305 - DNA, 1135 bp, Homo sapiens
ttgtgtccttatggtcttttgtgctacttcgtagttgtggttgcgccctcttgtcttgcgtctgtccctccttgtgtggcgtgtgtgttgcccgacgatccttgtttgcttgacgagttttgtggggatccctggagtggtgcctcgtcctggatttcccgtgcttacactcggggtcgccttttctcttcgtctgtcccgtttcccctctggggccactatttccccctgtcgatctttgtgtttgtgagtatcccttaccctctgtgaccagcgcttttttgtttacccgtggtttcctccccatgcgttgccttgtgaggccctcccctcgcccgtgtgggtggaaaattgtgggaccccctcgcccctggggtgtaattaatcactgggctctttcgtggccttcttttgtatcccgctggtgtaaccgttggttttcccccaggagtggtcccattgcgtgccccttggccgcacccgtcgtcgcttaccccaggcgcatagcactccccgtttttgtgtgactttggtggccccccccttggctttccacggttgggcactccatctatccacgcctgcgccacacttgtggtgccctcgggttggattatgccttgggcacaaggttaccccgaggagtcttgtgtgcactagcttgaggcctacacccaccacgcccactttgctgagggcctcgggcttcgccctggaccacccaagtttgaccctcgatgttattgcccacgcgtgcctcttgtttcacactcggtaacctcgggttgaaggggattggagcgaatgtgcgaagttttcacgagggcccgctgaaagatattggctggccctctgagaaaggagttattgatggaagttgtgtgttggagatttctgtttgaaaggaagaagggtgatggaaagaaaggagaaggaaatatcctatacttatccacttccttttggccctgcacgcactgtcactgctccccggatttcaggcttcacgctttactgacacgacgtttaagcttttctggttatgagttgttttcaccttggtgatcactgtctttttccctgtgtacctgtaatatttttccatcatatttcaaagttaagtcatttacatcca

SEQ ID NO: 590306 - DNA, 220 bp, Homo sapiens
agagagagagagagagagagagagagagagagagagagagagagagagagagagagagattggtctgtcatgttcgtttgttctctctctcaagacatagggtcttgctgtattgcccaggctggtcttggactcgggcctcaggtgattctcccacctcggcctcccagggtgctggaaaggcatgagccactctgcctggcccgagaccctgtctctt

SEQ ID NO: 590307 - DNA, 337 bp, Homo sapiens
ggggtgctctagaggatccgagctccaacaagatctcagcatccctgactttgcatttaccaacctttcaagcctggtagttctgatcttcataacaataaaattaggaggctgggtcaacactggtttggttggctaaggttacctggagaccttaggacttggattataataacttgggggcatttcctcagggtattaaaggccatcctagtcttaaaggaggtaggatttcatagtaattctatttctggtatccctgatggagcctttgatggtaatccactcttaagaactatacatttgtatgataatcctctgtctcttgatgggagct

SEQ ID NO: 590308 - DNA, 833 bp, Homo sapiens
actcaccctctaggaatgggggattcatgtcttaaaagatcattacaagttcttcagtatatgctgaaatttttttctgttgcagtgctggaggtaaataccaagagaactagtgctttaaaagcaaaagctggttgttaatggagtaaggatgcttcagcgatttagggagggaacttttaaaagggggctccacatttctcctgttctccttcaacctccatttctacacaggaggtaaatgattttcatcccaatctctttacttgtcgtatttagctttgctcagacatgattacttctcctttacgatttctgttggctgctatccctctgtgttcctcctgaatctagagttatagatgtcatggcatagattagagaaaaccttaaggaagttcccaggcaagatggccgaataggaacagctcctgtctgcagctcccagtgagaacaatgcagaaggcaggtgatttctgcatttccaactgagattcccagttcatctcattgggattggttagacagtgggtgcagcccaggagggcgagcagaagcaggacggggcgctgctcacctggaaaggcacaagcagtcaggaaactccctccactagccaagggaagcgtgagggaccctgctgtgagggatggtgctatctgggccagatatatgctcagacaaaatacaagaaaaccgagcgatcaaaggcggcgggggcaacagggcacgatttggaccggtcacacgggtcccgaccagtttgggacaatggaaacgcgggccccaatgaaagaaataataaaacaggaacgtaaaacaggaaacgcaga

SEQ ID NO: 590309 - DNA, 212 bp, Homo sapiens
tatgtacacgggagaggaaggactgtcctgtttattgggagggaggagggggatgctggtgcagcctgctcagtgagtcacccagggtctgagtggctgacttgccagctctgtggccatgctgacgccagctgctggagtagttgggcagggctttggaaacaccttcccaccttgcccgggaaacaatgcatttgcaacacgggtctctc

SEQ ID NO: 590310 - DNA, 443 bp, Homo sapiens
  misc_feature (114)..(114): n is a, c, g, or t
atgctggtatgagctgggtcttaacactgtattattattcaaccatagtgagtatgagacctggagtcaattgtctcatctgattgatgaggtacagattatctgaataaaatntctgagctggttctgagtcagtaatcccaacacaaactactgctttgtactgaattctgtatgctttgcatgtccttcaataactgaagattttttctccttctttctccaggtctcagtttcataaaatctttcttatttgtggtccctgtgattccagaacgggtgctgctgtttctttcttcatcacgagtctttttggtagcttttaattccttcttctgcttctctaacttctgtttctcccgctgggcttggaattttcgaactttagttatttggtagggttatggttcccatccttgcaaaacttattcagggagtcggcc

SEQ ID NO: 590311 - DNA, 140 bp, Homo sapiens
cacaccacaccgtgctacagggggacagagctgtgaccttaaccttggaagagccccctgtgttattagcccttacaggtgcaagtgtagagagtccaaggggttaaaacacatacaggggcggaaaagacccttctcgc

SEQ ID NO: 590312 - DNA, 368 bp, Homo sapiens
ggacgccgagaggtcgtcttcggtgtgcgaactttgtgcccttcccgccggcgcgaccccaggcgcgttgtgcgcgagctgatgcgtcaaggacgagccaaagacggtgcccgacgttgccgagtgttcgaggaagagtctcgcacgttgtcgccgcattggatgactgcccatcgcagggacgcgacatgaagggggatgcgcaaccaggattagggaagccccgtataggccgctctcacaggttgcccgtagtgcacaaggttgggaggcattttctcgcccgtgcaaacatgagtgtgatgcccccttccaagattgaagaccgacagataattggctcttacaagggtggacttgttgcacac

SEQ ID NO: 590313 - DNA, 495 bp, Homo sapiens
cagaaaacttgtatatccaagaatttataactgcagacctccaacttgaccccaggcagaaatgctgtgccacagattaattcaaattccactgtgacctccctcctgcctacatctgatgccttaactcctcctttccctgtctctggacaaaattacctttagttctcagcttatatcatgctgtttattcagcccagaacccagctcttccagcaaacctgtcctatattctaggcttgggtagatgcctctctattgtggttccttaatgcccaaggtatatctctattatttcatttaccgtattgtaccataattaccattttattttataattaccttttaaaatgtctgtatctactactagactgtgaaattcctgaagtaaggactatgcctgattcagctctgtatgtgtgggacctaacactgtgcctggcacatagtgggtgctcatataatgtttgttgaatgaataaatgaacgaacagt

SEQ ID NO: 590314 - DNA, 332 bp, Homo sapiens
gttttagctcagtgttttttaaaaaaagaaactgcccccccgccaaaaattgttttctttgttgggccaacccaatccgttctccaaaaatggccggggcttataaaaagttataaatatcgggtagctctaaaacaaaccccctgacccaaagggaagtgagcttgggcttagtatttcccttggaagcccgttttgtaatccctgacttatgggccaactggggcagaaattctataaactctttgctgtttttgaaccccgccttttgtttccttttgttttgttttgtaaaaatgataaaacttccgaaaataaaatgtccgtgttta

SEQ ID NO: 590315 - DNA, 116 bp, Homo sapiens
ggacagtcatcccgggtgcgtgcgcggtaggcggcaccatctcgatcacatggaagggccccacgggccgatcttgagctcgccctggtgcaactgccccgagtcgcgcaggaaga

SEQ ID NO: 590316 - DNA, 1128 bp, Homo sapiens
caaactccaatctcccgaaatgccgatcttcccgcctcggtctccccaagtgctgggattacaggcatgagccactgccctggacctcaaatacattttggaactcagaatttaccagtatttaaagatggtgtacaggattataccatctttactctcttgagatggacgtctcgccctgtagctccaggctgagagtgcagctggcatggtctcggctcactgcaacctaccaccctcccaggttcgggcaatatcttctgcctcagcactcccaagtctgggactgcaccacatccgccaccacgcctggctaattacctattattcactggagacggcccttcagccatgtctggccaggactggtctcgcactctcttgaccttggtgatcccgtccggctcgggcatacccaaagtggaagggcgactacacgacgtgagccacccgcgccctacccagcctcagacccaacatgacacgcatcacctcccgtgaccgtccgggcacacccataaccgcaacaacgcacccaccagcactcgcgcccagaggccgcccaccgagcagcgcatgaggacgcggcacacgtcagcccagacgcgcaaacccaaacgagaagcagaagacgcaaacgccgcgggccgggccgccggacacggcgcaacaccgagtccacacacccaacacacccccacgaccaaacccacgaacccccgccccccgaccccgagacgaccgcaaccccacgcgacgcgaccaacaaacacaggcagctacacacgcccccaacaagaccaccaaccagcgcaccccccgcgcgcacccgcaccacccaagggacgaacaggcggcacacgaccaaggcgcctgaggccagcagcgcccccaccacacacgaccagcgccgacgccggccgacgccgaccacgcgcgcggccgaccacccgcccgccggcaggcggcagcccgccgcacaccgcacgccgccacgccacgcgcaccacccccccacgccccccgcaccgccacgccgacacccccccacgcccggacgcacgccggcacccgcccccaccccccccccccccccgcccaccccccgcgcccccccgcacccacgcc

SEQ ID NO: 590317 - DNA, 213 bp, Homo sapiens
tcagagctttcttcatgttgtcagcaacagagctgtctctgcaggttcgtaagcatcgcgacggtttgcatatcttccagtgctatcggctctaactgtcagagctgggtcaacgaacatacatcctggggaccatactggccatcaggagaaaggtgtaagtcagttgtatcataaaccagattgaggaggacaaacagctctgccaaagag

SEQ ID NO: 590318 - DNA, 179 bp, Homo sapiens
accatgggtccactatgaagccttttatctgagaggcgtctgtgagttgagcccctgctgggaaacgctgctgtcactcaggctgtgcatgtgaagaggtggcctgtggtgctggggacaggtctgggtagggcagacaggtggagggatggtacccacacctccagcctcaacgtcct

SEQ ID NO: 590319 - DNA, 677 bp, Homo sapiens
ggcatttgtaaaatattgaaagtggttgagatagtggtataagaaagcatttcttatgacttatttgtatcattgttttcctcatctaaaaagttgaataaaatctgttgattcagttctcctaaaaaaaaaaaaaaaaaaaaaaaaaaaaactgcggggttttttgttggggggcgggaaagaaacagcggtaatcggaaaagggggcgactggggcccatagcgggtgtgccgtggaagcccaggttttcctttggtgacaaaggggggaagactctgcccgggtcccccataataggagaggccggcataaatttccaaaaaacgccagggttacccgtggcgattaatagactccccgaaaaaaagacacaacaacaaaacaacaaataaaataggatataaacaacatagtggcacaaaaacaaagacgggagacggaagaaacagaggactacaaacaaggaggagaaaactatgacaactagatggcggcacgacgtataatagaaagcaacaagaacatcatgagagcaacgacataactaaggctaacgcaacagaccaaacaacacccaacaaacatgagtgaatagaagacagcgaaaagaacaaacagaaaaacgataaagagctcagagagccagaacagcacaacaaccgaaaagaagaagac

SEQ ID NO: 590320 - DNA, 683 bp, Homo sapiens
ccggcccttcccggggatcccccggttccctagtttctttttttaacccccaagcgcaagatggggaagaggtttttttcgcaaacccaaaaggcagtttaattctgctcctcgtgcagtttgttgcccagttctttggttcagtatcccgcccgataattgtgggggagtcgcgggcacttataggcatcaccgaaacctttcttttataacggcctctctcaattttttaagtaccagggagccattttagcccaactattctaaccactcttttaaagcccaccagcacaccgacatgcccgagcagttcaactctaagttcgcaagcaaatttaagcctttccctgtccttggagccattgaaggcaagaaaggtgccactcgcctccttggtcaagctcttgcaagcattcaactaggccgcatttttgtgtaaagtctgtttcaaaagtgggatttcgttgactttatctttttactcagcaataaagcatttgtctatatattggtgtatgatggagacctatacctgtacattttgtttctctcagggaatcctgaagccacgactgaaatgtgaggtatcgagcccatagtatggaacttcacttttacaggtaagaaaagagttttgtgtttgccttttttgtgatcttctgaataaatatgggatagttttt

SEQ ID NO: 590321 - DNA, 360 bp, Homo sapiens
agcggggaacaatcacttgagtgggatagaacacgtcaagactttgaaaaactatggaaaagggatgactgaatttggcaatatgagaaggacatgagatttcaggggccagtggaaaatgatatggttgggatgttggtcctttccaaatctcatgttgaaaggtcatccccaatgtgggagatggggcttagtggaggatatggggtcatgggggacagattctttttttttttttttttttggagagagggagtctcgctcggtcgccaaggtgggagtgagggggcgcagatctgggttcagtggaagctccacctccggggttcaggccattctcggggctaagcctccggagta

SEQ ID NO: 590322 - DNA, 935 bp, Homo sapiens
  misc_feature (12)..(12): n is a, c, g, or t
  misc_feature (25)..(25): n is a, c, g, or t
  misc_feature (27)..(27): n is a, c, g, or t
  misc_feature (49)..(49): n is a, c, g, or t
  misc_feature (86)..(86): n is a, c, g, or t
  misc_feature (98)..(98): n is a, c, g, or t
  misc_feature (104)..(104): n is a, c, g, or t
  misc_feature (110)..(110): n is a, c, g, or t
  misc_feature (116)..(116): n is a, c, g, or t
  misc_feature (154)..(154): n is a, c, g, or t
  misc_feature (165)..(165): n is a, c, g, or t
  misc_feature (215)..(215): n is a, c, g, or t
  misc_feature (231)..(231): n is a, c, g, or t
  misc_feature (244)..(244): n is a, c, g, or t
  misc_feature (250)..(250): n is a, c, g, or t
  misc_feature (266)..(266): n is a, c, g, or t
  misc_feature (273)..(273): n is a, c, g, or t
  misc_feature (279)..(279): n is a, c, g, or t
  misc_feature (294)..(294): n is a, c, g, or t
  misc_feature (298)..(298): n is a, c, g, or t
  misc_feature (315)..(315): n is a, c, g, or t
  misc_feature (322)..(322): n is a, c, g, or t
  misc_feature (338)..(338): n is a, c, g, or t
  misc_feature (359)..(359): n is a, c, g, or t
  misc_feature (381)..(381): n is a, c, g, or t
  misc_feature (408)..(408): n is a, c, g, or t
  misc_feature (417)..(417): n is a, c, g, or t
  misc_feature (420)..(420): n is a, c, g, or t
  misc_feature (424)..(424): n is a, c, g, or t
  misc_feature (469)..(470): n is a, c, g, or t
  misc_feature (473)..(473): n is a, c, g, or t
  misc_feature (480)..(480): n is a, c, g, or t
  misc_feature (483)..(483): n is a, c, g, or t
  misc_feature (485)..(485): n is a, c, g, or t
  misc_feature (487)..(488): n is a, c, g, or t
  misc_feature (491)..(491): n is a, c, g, or t
  misc_feature (494)..(494): n is a, c, g, or t
  misc_feature (504)..(504): n is a, c, g, or t
  misc_feature (513)..(513): n is a, c, g, or t
  misc_feature (518)..(518): n is a, c, g, or t
  misc_feature (557)..(557): n is a, c, g, or t
  misc_feature (590)..(590): n is a, c, g, or t
  misc_feature (621)..(621): n is a, c, g, or t
  misc_feature (627)..(627): n is a, c, g, or t
  misc_feature (640)..(640): n is a, c, g, or t
  misc_feature (651)..(651): n is a, c, g, or t
  misc_feature (680)..(681): n is a, c, g, or t
  misc_feature (700)..(700): n is a, c, g, or t
  misc_feature (785)..(785): n is a, c, g, or t
  misc_feature (916)..(916): n is a, c, g, or t
ggaattcccggnatttgaaaacagnancctcattctaccccatgtcacnagaaatgaaacaggaccctatgaatgtgaaatacggnaccgagatgttngcatgnacagtnacccantcaccctgaatgtcctctatggtccagacctccccagnatttacccttnattcacctattaccgttcaggagaaaacctctacttgatcctcttcgcgnaatctaacccaccggnagagtatttttgnacaatnaatgggaagtttcagnaatcagnacaaangctctctatcccccnaatnactacaaagcatagagngctctanactcgctctgttcgtnactcagccactggcaaggaangctccaaatccatcacagtcgnagtctctgctccttcaggaataggacntctccctcnccncaanccaatatagcagccgtgaagtcatttctgtatttcaggaagactnncanacagttnctntnannctnccncaaaccactnacaatcccnatcantccaaaattgctttttcttcaaggagatttatggaaaanactctcacaaggactcttgaatacaagttcctnataacttcaagatcataccactggactaagnactttnaaaattttaatgnacaggctgatnccttcatgaaattctagacaaagaagaannagactccatgttattggantaaataatcaaaagcataatgttttcataattttctatttgaaaatgtgctgattctttgaatgttttattctccagatttatgnactttttttcttgagcaattggtaaagtatacttttgtaaacaaaaattgaaacatttgcttttgctctctatctgagtgccccagaattgggaaactattcatgagtattcatatgtttatggtaataangttatctgcaatagttcaa

SEQ ID NO: 590323 - DNA, 250 bp, Homo sapiens
gtgaggtgtgcatgtgggtctactaagagcttctgtcccttccttcccattgcaagttgcacccagactagacagctgtagtactaggtctcttatccccgtcatcatgtgctcctatactaacgtctctcccaactttaaaacaaaaacaaacccttccctatatcttgtgtgtgtgccagccattagactgtatcgtccttgccatctcaccgttatttgaacaacaagcacgactcacgacaacctg

SEQ ID NO: 590324 - DNA, 855 bp, Homo sapiens
gtggggaggggaggatggggaagctgatatgtctgcatacgttacatacctatatataacacttgtgcgtatagccatacgacgcatagctggcagggtcatccgaagtagttactaatcgtaagagtcatatatatagcatgaatagtaaactcacgttggtggacctgcgctcctgagcccgactcgaaaattgaggcaaatggaagaagatacagctcatctgtcctaagatcagaatcagtgaagagatgatattctattgtcttagctgaaggttagtaaagtagttatctggacttattaaggcctttcctatttctgtaaccactttattattgcgggcaatcttgaccagtagggagggctatggggtgactccacttcttttcaccatgggtgtaccctgcttaggttaatgaatcatagcaagggctcatcactgccaggtgttcaggtggcgtcttggtggtagggcatgggacgacgcgaggttgactaggacaaccatatgtcagctgtaccttgtcacacatcttgaaaaataagcgacgataatagaactagtgactaatttgcccttacagttcctgcttggtcccacccactgaagtagctcactcgtagtgcgggccgtattagaggcagtggggtacgttagactcagatggcacagtattctaggtggcagtgttaggatgtccagtttacaaaaataatgaagcaattagctatgtgattggagtactgtcggggatgtgtgtgtgggggcatttttttaactggttaatggagtttacacaagaatgcctggtaggaggacctagcaggaagtccgggaattgaagtttaaga

SEQ ID NO: 590325 - DNA, 889 bp, Homo sapiens
  misc_feature (833)..(833): n is a, c, g, or t
  misc_feature (844)..(844): n is a, c, g, or t
ggtgcggtggcatgccggtcttacccttttatgattaaaaataaccaagactttgtggtacaagggtcgaggaggcctaggggatctaggaataaaatcgtggggttcaagcctattgtatctggaactttacaaagatattgctaaatgctaccacaagcagcatatgaagagacactcatttgatatggcctacaacattcaggaagcatatttaagaaaaacagtcactagctataggaaaatacataaattcataggtgagcaagaactttggatactcatcaagcatgggcataacatagggatactaagggtccaaagaacagagaatagactgaaattgcgggccaaggcacttacatgaaagcaaagctctgatagcacagaggttcctcaggtgactgaagaaataccgagacttaagggaggttttaatcaagccgaaggtacgattcaagaacttaaggctaggaaatgaggcagagcctaattaaatattaagcttagatccaagatgaccaaagaggggaaaaaaagatgcaggagaagtagatagtttgggggcatgaacaatccctagttcaagttcatctgtgggcagggggttctcacaaaatgtggtgcggcctaagaaaaagctgttaaagcgggggagaaaaacgcaaagttcagggctggaaaagtggtttaatttagtcccaaaattctagggggattctcatacagggggggttggaggcagtaagcagtagggaatgattaaaaatggaggggcgttttaatagagaggatatttaactcaagagtcaggtaggggaagggaacagggnttaataaggtnaaatgggaaaataccttaaaagctgttttaaaacccggaacattt

SEQ ID NO: 590326 - DNA, 378 bp, Homo sapiens
agcgggcggttgtgtctgggaaggacagaacatggcggcggatccgaacaagaccgaaatccagactctagcccgaggcttcgtgcaggtccaaccaactaggcctggttcgactgcggcgccaagaatccgagttgggccagcatcacgttacggtgttttcttgtgcattgactgttccggggtgcaccgatccctggtgcgtccatctgagcttcatcaggtccacagagttggattccaagtggaactggttccagcgtgaggtgtatgcaggtcggcggtgaatgccaatgcagacggcgtttttgtcgccaacatggatgcacagccaatgatgaccaactaccgaaatataatagaccgagtctgcccaga

SEQ ID NO: 590327 - DNA, 518 bp, Homo sapiens
  misc_feature (327)..(327): n is a, c, g, or t
gggaagggcccggatgctgcggccatcagcccgaaccaaagccccaccagcagcctaatttgggagggtccccctcccccctttttccgatggcccttttccggcaaagttcccccccttgctccccagcaaatctctccaggcccaaggtgcacgcctattatatcagtgaggatgaagaagaataatgtttcctcccccctttcctgtcccccccttttgtccccataccttcagaagctttttggtgaattcccaattggggcccccccccttaacctaagggccgcttccaaggaaagccccctgggggaaaaagacctaggntggggggaaccccaccagcctgtcctgcaagtgacatccctcccccccccgaaggaggggggctgccccttaaaagcctgctttgcatccctttaccccccccccaggggtttgtttccctgtttatgttcccgtggtttccccagggaaattgtccttttccttaattttttaaaaaatttgtttttcca

SEQ ID NO: 590328 - DNA, 890 bp, Homo sapiens
gaggtgatataatttatggggactgccatggatgcggctccaagggatgcagatatgacatattgcagatgccatccgcggcggccatgcccaaagctaaaggagctgaacttgatcatactgtgaaatcaagagggatgctgcacacatggctgttgctgcaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgcaggcaggcaggcaggcaggcaaggcagcaagcagagcaaagcaacgcaggaagccagcacagcaagcaggcaggcagcgcaaagcatcgcagggcaaagcagcgcagcgacagcaagcaggcagagaggaagaggaggcaagcaaagcagccatcaagaagcagcagcggcaaggagcagaagaagatcaaggacacgccgcattcaaaagaggaacaagaaaataacatgggaaaccacttacaacaacatgggagggaagaaccagggacaaattaccccgatgaacaatgaccaatatacacacaaacacattcacatgaaagaaacagttcatcacaaatcctttcacattgagacatattaatccacatcatttcaaagatacaaagattgcgatgaggccataagggacccccaaagaaagcatcccagatgaatgagtaagaacccacaaaaaaagaattgaacaaggtaatgaaccaccggaggaaagggttggtcatcatgacatatcactaaaaggaggtaaatccataggtaatacaaggaaaaaaaatacatgagacaagatggaaataaa

SEQ ID NO: 590329 - DNA, 206 bp, Homo sapiens
accattctcttaaaatccagctttcccctttccctgagagaagagcacatgttggtctcctctttagtgtgaacgcagattgccaggcccttttctcctatgcacaccatgatgactaggcaggggatctggctgcctgcatcatcctcccattgtgctgacagctggccctactttcctccccggggctccccgggatacagggc

SEQ ID NO: 590330 - DNA, 369 bp, Homo sapiens
tatatcttaaaggagtgtgaattaatgtcagtaatttatctttgaacacttgatagaattcaccagtgaagtcatctaggccagtgcttttcttttagggaaactttctgaatattaattaaatctctattatttataggtctgttcagattatctgtatcttcttgagtcggtttcagtagtttgtgtctatcttgaaatatattcttctaagttaatgtcatcaattatctgtagtatttcctcataatcctttttatttctgtaaattggtagtgatgtgccctctttcactcttgaatgaagtaatctgagtcactgcccttttttcttggtcactctaactaaagatgtgtccattttgttagg

SEQ ID NO: 590331 - DNA, 1046 bp, Homo sapiens
gaggtgatataatttatggggactgccatggatgcggctccaagggatgcagatatgacatattgcagatgccatccgcggcggccatgcccaaagctaaaggagctgaacttgatcatactgtgaaatcaagagggatgctgcacacatggctgttgctgcaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggtacgatggatggaggaggaggacggagaagaggacgaagaggaagcacgacagaagatggaggaggaagatgaggaagaggaggaagaagaggaggacggaggaggcagaagatcctcagcagtcgagggctagggagagaagtcagccatgccctctcggatgattctggaccctaacactggggagcctagttcccgtgctgtcctccccactctccgtgcgagagcgtcatcgcacgcttcactgggcttttaccctcgtccagagaagctgcgtgcgccatagggcccaagagctccgtgctgatagcccagctagactgacacgtctgaccccgagaaggtggtctctgccttcctaaaggtgtcatctgtgttcaaggacgaagctactgtgaggatggcagtgcaggatgcagtagatgccctgatgcacaaggcttacaacgtcctcgtcccttcaactccaacaccttcctcaccaggctgctcgtgcaccatggtctgctcaagagtgacgacaaggttcaaggccattgccaacctgctacggccccctgatggcgtctgaacacatggtgcccgcccggactatttccccaaggcgccttgcacccccttgctgctcggcgttcggtgacgcgagtccaacacgcgccctggcatccttgctccttcggccggccaacagcctgctgcccacgctgtcaccaggtcttagactcaccggctcctcgcgtcc

SEQ ID NO: 590332 - DNA, 857 bp, Homo sapiens
  misc_feature (434)..(434): n is a, c, g, or t
  misc_feature (523)..(523): n is a, c, g, or t
  misc_feature (783)..(783): n is a, c, g, or t
  misc_feature (839)..(839): n is a, c, g, or t
ctacttcctgtgctcttgcggagacgcgcgcgtcggagtgtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcantcacgttcagggcactcccgttaaaccatttctgcctcccttgtgcagcacaaacatgggtggacgtattgggtgaccacacgctggcnggcgtggaggaagacctcaatcaaggtgcctggcggcccacaatacttggggcgaagtttacgcctcagggggaaggagctccgggagaacggggatcaataggatcggaaacctgctggtgcccaatgagaattactgcaagtttgaggactgggctgatgcccattctggaccagatggtgatggagcagaacaagagggtgtaaagtggacgccttctaagatgatcgcccggctgggcaaggagatcaacaacccngagtccgtgtattactgggccagaagaaccacatcctgtgtttagtccgcacttanagacggctcgctgggcga

SEQ ID NO: 590333 - DNA, 861 bp, Homo sapiens
  misc_feature (396)..(396): n is a, c, g, or t
  misc_feature (403)..(403): n is a, c, g, or t
  misc_feature (410)..(410): n is a, c, g, or t
  misc_feature (426)..(426): n is a, c, g, or t
  misc_feature (430)..(430): n is a, c, g, or t
  misc_feature (445)..(445): n is a, c, g, or t
  misc_feature (477)..(477): n is a, c, g, or t
  misc_feature (527)..(527): n is a, c, g, or t
  misc_feature (787)..(787): n is a, c, g, or t
  misc_feature (843)..(843): n is a, c, g, or t
ctacttcctgtgctcttgcggagacgcgcgcgtcggagtgtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctcgccccccccccccccccccccccnccccccnccccccnttccctccgcgccccncccncccccctccccaccncccccgcccccgccccccaccattcgctaccntttgtgcagcacaaacatgggtggacgtattgggtgaccacacgctggcnggcgtggaggaagacctcaatcaaggtgcctggcggcccacaatacttggggcgaagtttacgcctcagggggaaggagctccgggagaacggggatcaataggatcggaaacctgctggtgcccaatgagaattactgcaagtttgaggactgggctgatgcccattctggaccagatggtgatggagcagaacaagagggtgtaaagtggacgccttctaagatgatcgcccggctgggcaaggagatcaacaacccngagtccgtgtattactgggccagaagaaccacatcctgtgtttagtccgcacttanagacggctcgctgggcga

SEQ ID NO: 590334 - DNA, 656 bp, Homo sapiens
  misc_feature (564)..(564): n is a, c, g, or t
gcccaagatcgctgattgcgtacactgatattgaacacctttggatagtattcctggacacagttgatccagagctgtgtggtattgcgcgcgaccttactccatgatagatgaccatcgtcatgcattgttattactagagaggcttgatccctcaaactccgaatggacttactgtgggcttatactcctatctaaatgactgtcttggcttaatcctcattgttgacctactgcgagaactctctgagctagtacacgactatactggtctcaagttactgcctacgtcacgactggattgctacatcactaccctatactaccgatgcatatgtacctgatcacagtggggctcactccgccaccgacgttgctccatatctctctcattgacacgatatcacactctgaggttcatacatctataatgaattcggattcgaggcctcaacctcgacatcattgccgggttttcctgttgcaagacagttgcacagaggctgaacacagatccaatggtgctggagtttataagtctcaggggtgtcccatgcccatgtngtcctatttgacttgatatcaatgtactgtacgagatcttctacgtttttctggctccagcgtgtaacctttctatcgccttcgtaagatcc

SEQ ID NO: 590335 - DNA, 335 bp, Homo sapiens
ataccatcatgtgatattttgtctaacagtgcctggcttatctcacataagataatggcccccagttccatccatgtggctgccaatgacaggggttttattttgttaagggcctaatcatgttacactgtgtatatataccacattttctttatccattcatctgttgtggacacttaggttgattccatattttggctatggctattgtgaatagtgctgagataaacatgagagtgtagatatctattcaatatattgatttcctgtcttatagatatatatccagtactggaattgcagggtcataagaaagttctattttctatttttta

SEQ ID NO: 590336 - DNA, 442 bp, Homo sapiens
tgtattatatatccacttttaaatatttatttaacttatagtattaataatactttatagatcttagatctataaagatctagaaaaagagatacaaagatatatagatctatacctatatcgatcgatctctcgatctctagatatattctatctaaattatatctagattagatttattcaactaataattagattaaatatattattatataatatagattaattttagttcaaacataactatgttaattaaaatataaaattattatttaaaataatcagaagaatttcttattaaagattattttcattagattaaaaatatttagagtaacaataataaaggttaaaatataagctaattataataataatctatacaatatttgtataaaattaagtaatttattttatactcaataagtatttaatttattat

SEQ ID NO: 590337 - DNA, 1299 bp, Homo sapiens
ggctggaggaaaacaacagtgacaagaacagtgggccacaggggtccccgaagaactcccacaatgccacaggaggaggcagcagagaagaggccccctggagccctgccggaactcacaacgaggactaatcataagggatcatggttgaaggagatctttgcagaggcgtacacggaggttgaacctcaagcggatgacgcgaacgaggtggcctgccagctattttatcccaagactgaatgcaagagtccatccttgtgcacatccttgacgacagtgaggcaccatggtcgttgaagaacgaaaggaggtaatcgaaacacgaaaacccggtcacaaacacagagcaccttaatgggaaaccacatgactcgggcgctgaacacaagcggattccacgcagccaattgcaccacaggattgaaagcgaaaagctctgagatacacaggctctaagaaccaacgagtcccatcagcgatccaacgaacccctcggatagaaaggaaaccaaggagaacctacattcaagaggaatctctgcagagccaagacctcggagggagatccaagcaaagatacacaggcgggcacacgggctccaaagtggcaagaacacaccaagaggagcaaccaagagaaaccctcccagacacatggcaccagaagatccccgcattgcagcggcagacaaaccccagagagagcaccgagcgataaaaccattaccatgaaaagcgtaggaaaggaaacgcaagccaaacccgttgcaagcgcctacaacttaacaagaaagcaccccaaccacttcgagcaagaaagactaaaggaagagacaagcaatggccgggcccaccggacaccacccaccagcggcaggccccaaggatgcgatcacgagaacccaaggaccaaccaaaccgagcacaggcgcgcccacacaacacaagcaccattcctgaacctcacagggaaacaaacactaaatcggagacggcccacacgaaggcaaaaacccgaaccatcaaagagagagccctacgcaggcgagtcgagagattccacgaaagcacacacgaacaaaaagacagagcacacgcgaacgccactccataacacgcagccaacactatcgggaacaagagcactggaagctacaagcgaaaaccactgccaccaaccagccgccgacaggggcgagggagacagcaccgagacgacgcctaccgagaacgacgggaatcgagcccacagaaagaaccaaaggcgacaccccgatagtgagcgcacaacataca

SEQ ID NO: 590338 - DNA, 222 bp, Homo sapiens
atcccaccatgctcacagacatgatgaaagggaatgtaaccaacgtcctcccaatgattctgatcggtggatggatcaacatgacattttcaggctttgtcacaactaaagttccatttccattgacacttcgcttcaagcctatgctccagcaaggaatagagctgctcacactagatgcatcctgggtgagttctgcatcctggtacttcctcaatgtgt

SEQ ID NO: 590339 - DNA, 1485 bp, Homo sapiens
gtagattgactttcttctaaccatccaacgaactacacttgaactcgacctattaccctatcaattgctactcattggagcctcgcattcgctacgctcctacgttactagacctcatcccttgagtgtccgacccacgatgcatgcagtcgggatcgagggcaacacttttcatagggtatactgaccacgttcttgacaataccggtgtactccgtctcaggacctcaagtgcgatttgtgtgaactagctcatgtaatgtcaatgaccctatctagcccctagtccaagtcccttcatgcacgggcgttgttgagccccctttggacgtcacgtttcgcgccctgggcatcacctcttggtatgcgcacccgggaatcattggcttgtgtgtctccctccggtcttgcacttctccctcataaaaggacttcctttggacttcttgtaaactccttctcgcttccgtcgttccactgtcgtcccattgcctgctgcctttgcttagcttacataatgttgcgcattggcgccagggagtcgcacgccgcagactagggtctgggcatctaacgtccattacacgcttgcgccatataacccaggcgtcacacatgcacttcgcacggagccccataggggagcccgtccctgggtacgcagacgctatatactccacattacgtttcctacacttattaagcacaccatatgcccaatgcggtttgcgcttttggcgctttccttaactttctaataccaaggggacccccacttcgaaatggtgttctcccatctgccacttcccacaaaacctatgtattcccttgttaactactacaatagggcgccccctgcccttcaataaaagcttcccaagttttatcccttaaggagttgccccccgctagcttacccggtacctttgcattatccccgatgccacttcacattgcaaactttggcgaggctccactcaaccttttcggtccccctaatttctaaacatgctccacaatttcccctttagaacttggccttagtgacaattccaactttaattaagcctacaacttaaaagcaagagcaacgctgggaaaaagccttacaacagcaaaaccaaacctttttctctatactcgaaaccccccagacccgggaacagagcaaaggaaagaaaaccccccacattattcctaaattaacccacaacacagaccagtaaatatccatgggaatttatctatcacaagcaatcagcccccccattgaaagaggtacatacataattctcgctaatattgtgcattaacccaaaggcagacctcttccaggacaaatcataaagtacttgctgccgcaataatttgtggtaacacccttaacacatagattccccgggggaaagaaaataggcgaacccacattcgtgggagcaacactatgaaggataatgagagctagagacagctcgatatcacatc

SEQ ID NO: 590340 - DNA, 1445 bp, Homo sapiens
tgccagccctgcctggcaggttccctgtgtcagctgtcccatccctggtctgtggatgttcatcgtccagtgctggcactgatgcctgatgtgaaacatgtgaccctgagctgaagccaatgcctgtggctgtgcagtgtgtgtgcttatgatacgcttgtgttgtgttgccaactatcctttgtgacctatgtgacttgatgcctgtacgcctctgtaaagcccaacttcctcacctttgaaacagctgcctggtatcagcattaattgaagattagtcatgtgacaggcctggtgtgctgagtccgcacatagaagaatcaaaaattgtccaaaattgtaacttgtgacgagacaatgtggtgcaagctattgtgagaactatcttgcaattgtcccatcaacctctacagctgcctcactgacaactgtgatgtgacatgacaccagtgaacagcacatggacaatgtgaaccccccaactggacccacccaaaaccttggacacgtctacaccctggaaggagcgtgcatgccagcagactgaaacgagcatccatgaactgacgaaaccaacatgctagcaaacgaacgccaattggacacgctcacatttacactaccaaatccattgaaacacgtgggccgatctcgctgctggatgctttctgcgccctctggaccatgatgacaaccaagaacattcaaggaatcgtcccacgtcactctcacgtagctcacttcatccaacgacggccaccttagactctcctaacttgggctcattttaggtcccttgtcgacatatttacgaccacatttgcacgctgaagcaacctcactgtcggagagacacacaaacacagtggacaacatcgtcaacagtgtcaacacatgtatggtccatccagtgtgtcataaatctcctcagtgtttccccatggtgaaccagacgagccgtgtgcacacgacagacagtgtgagtcaatgttacagagactacccacaatccatgcgacatgcaagctgacaacaccgcccaccaaatctctaaccactaggactgaggagaccactgcattcgccaattggcaatagccagataacacacagatcccacatcgcaccagtacaccttactagatagctagactagtcacgaacagccagcccgacgtccctactccagtacgcagcacgactacaccgggtgacagtgacacaagactttacagtggcactactacccacatagacaatgtctacgactctctccagctcagaggaactgcagcccaagcagtctatagtccagtcagagtgctcacaccataccacactagttccagctccaccctcgactctactcgagaccacaacaactgtctacactaactactactttgcacagcagcagactgccgttgctgcattagcccctgccg

SEQ ID NO: 590341 - DNA, 95 bp, Homo sapiens
  misc_feature (15)..(15): n is a, c, g, or t
  misc_feature (43)..(45): n is a, c, g, or t
  misc_feature (61)..(61): n is a, c, g, or t
  misc_feature (83)..(83): n is a, c, g, or t
gggggattgaatctnatgaaattatatgtgcatgcccttgatnnnggagatcctcatgcangatttggattgcgcttggcaangcatcagaatgg

SEQ ID NO: 590342 - DNA, 191 bp, Homo sapiens
ggcagagtgtaatactgttactctgatgagatataaataaatataattaaatacaatacctatgaaaaactgtccactaaaaaaataccaaataaatttgtagactcataggcaggagacattatacttaattttataaaaatagccgaaccttttggtaagagggaaaatcccatgatttgccataaatg

SEQ ID NO: 590343 - DNA, 112 bp, Homo sapiens
acattaggttagaagccacactccattctagctgagagttgcagatggggaataggcaggtactgagcaaagttttatttgctcactctgtcttccgcgctggagtgcaggt

SEQ ID NO: 590344 - DNA, 238 bp, Homo sapiens
cgatacacctttcctgccatgttaagcccccctccgtgggccctaaaggtccaaggatggaatttcttgtacccaaaagtattcctttttcatataagaagtgttttctctccataggatatgtttaaagtccaggcatagacattgaaacattcctgtataaggctaaaaaattaaaaaaaaaaagtacaaaaaacaacacaaaatgtaaaagtaaacactcgagactagttctctc

SEQ ID NO: 590345 - DNA, 555 bp, Homo sapiens
  misc_feature (517)..(517): n is a, c, g, or t
tgaggcacccccgtgggacaaatgggtactgcctccgtttcgcagaaaggagcctgaggccttggcgcctggaccagcacccaggtttcctgttccagcatagcatcctgggaccctctgctgccttggtccattgacccctgtctgggaaagagctgggcggcctcccctgggctgagcactgtagtgagagtccaggggctcaggtccgtccttcctgcccagctgggaaaggtcctggccctgccacccgtttagctcaggttccttccctgcttccagctcctctttcaggccatacctgagaatcctgtgtctctttggctaccaggaagctcccccagggccaaaagacagtggttttgtcctgacagttactggcccctctttccctgggctgccaggaagtgcagggcccgtttggctcagtttctccctggagtcttcctgcacattaaggcctctctgggtgtcctcctgttacacagatgaagaaactgaggcaggggaggcttangcttctggacgtttcttttcccaggggcttaagaggag

SEQ ID NO: 590346 - DNA, 430 bp, Homo sapiens
  misc_feature (51)..(51): n is a, c, g, or t
  misc_feature (112)..(112): n is a, c, g, or t
aaaatccggggggatgccccggagacaccctcggaataccttgaaatcccngcccaagcaggcagaagaaagccagatgaaccctgatgatattagcactgtggtatagtgnccaaactgactgtcattagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatgaaa

SEQ ID NO: 590347 - DNA, 259 bp, Homo sapiens
cgtggtggtggtccgtggtgggcgaggtggtcgtcgaggccgagctggtcgtgcaggccaggcaggaggctggggagcaagagggagccagaattatcaccaagggggtcaatttaaacagcatttccagcatggaggttatcagtataaccattctggattttcgacagggaagacattccactagttgagtctaccgaaccttacattttgctagagctcaagtaccagaaactttagtttcagaagtcctgaaatt

SEQ ID NO: 590348 - DNA, 901 bp, Homo sapiens
gactcagtgaaaaaaaaaaaaaaaaaaaaaaaaaggggtaatcctgtgaaattgatatgtcaaggagccttgatggtgatacccatttggcaatatatccttttttcaaacccattgtggtatgcctaaaatatatccaattttcattggccagccgtacccaataaagtctgagggggggaagaaaaaggggtctcttttcccagctttccccaaattattttcacctatatttattttcgccttctccgtggtaaggccacctttggattctcttctttggataacctggtacaccacgcacaacttcttctttcccttccgtggtccccgtcaatttcttctctaggacgctctccctggtggtaaggagatttacgagaacaagtgtggaagtgtagatctgtctcagcgagattttagggagaacagacacctgtcgacacagggaactccggggaacggtcacaccacgtggcataaattggaccaaagtgctcccttgggacagaattagatcgcggagagggacgccacggaaaacctttcttattcgcataagttcgctggcgacagccagcatgtttgttaacacgttggtggtaacaaaacccccaaattttgggggcgagaaaactcaaaggcctgtgtgcgccacaaataggatatatctatcaacacaaagaaagtggctcttcaaagccaacctgttgaaccctgtgtgtaaattctacctcaaatttttaccaaaacacaaatgttactcaaataaagaggggggggaaccccccttaagcaaagtgtgagagggctcttaaaccatagttgctcccaacgttgaaaatagtggtatggggcttggtggcacccccatccttgaaatcctccatctgtgatcctg

SEQ ID NO: 590349 - DNA, 865 bp, Homo sapiens
tggggcacccaaatgccccccgggtcaccggctctcgcgtccgggggttcgcgaccctccgcctgtgcccccgttctcccctggttgggtgccccccaccggccaccgtcaaagccgatatcgtcgtggtgctggagaggaaggtgtttgcccgccgtctcctggttcaatctcggcagatcgcgcccatgtttttacaagcctttgctggggagaccccacaatgggtcaataatggtctgcctggccacaccacctccatttgggtgtgtagacaacgctgtccaaagggcaacacaccccaggggcccactagttcagggtctggcaacaattgcaacccgcacgattctccgcggggggtgcatcgccacaaagcgcaccggggcccacaacaaagtcgccggcgggcatgcggccaaaggagctccaccagatgtggcccacgcagagggctccacaagagggccacaacggcagatattacacctcgcgtaggaatcgccgcgccgccccccgctgtcctggaaaccccaggggtgagaagcaagcgggctcctgcgccgaccgggttgggtaacacacacagggggccatcactacaagccagcacactccgcttcatacaaacgtggggtcaaggagaacacacaggtcgatgtcaccgcccccatatagatcagatagattctttaggtggacccaccttggcgtctgtatttatcggtgtgcgctggcaccgactaatgttgatagtgtttcttaaacgccgctcacctttttggcggggaccaggcttgtcccccaacgacacgctcccaatatgtcggcaacccccgtagaaaataatacaagacaaacaaac

SEQ ID NO: 590350 - DNA, 420 bp, Homo sapiens
  misc_feature (401)..(401): n is a, c, g, or t
acaataggccatctgcaggctgaggagcaaggagagccagtccaagctccaaacttgaagaattcagagtccgatgttcaagggcaggaagcattcagcatgggagaaagatgtaggctgggaggctaggccagtctctcttttcacatttttctgcctgcttacattctagccatgctggcagctgattagattgtgcccattcgggttaagggcgggtcttcctttcccagcccactgactcaaatgttaatctcctttggcagcaccctcacagacacacccaggatcaatactttgtatccttcagtccaatcaagttgacactcagtattaaccatcacagtaacgtacaaaaagcaacatatattagtaagatatctggatggcttttttaaaantttcttaaaactttgtttt

SEQ ID NO: 590351 - DNA, 1196 bp, Homo sapiens
  misc_feature (1196)..(1196): n is a, c, g, or t
atgacggccggatgtagtcgagtgcgtggagcccgaggggtcgcactggttggacctgggtatgggcgaacctgcgagtgagcttcctagcgagaaggattatcgaggcaagtgcgcatctcaggagaacccgtgggctcagcagtgcctggtgggactgggtgccagagggaccgaggtcctgcaggagtctcgtcgggacggcatactcggccgacggactaatggcagtagagagtagccacagtcaaccgaagattagagagcctggatatagtgtttcaatgggaccatttgacatgatgtcaaaagttctcgcttgggcgggacgcattctagtccttctgtactgcacttggtcgctatagttacacgctgacatccagcagtcatgcagttaggaccttgtcttttacgcatgtgtgcggacctcattatccatttacaagggcaactcgaaggttctctctagacaccgcaactctaaatggtcgccagggttgacagggcaaaggccaagtgaaccacccagtttggcacaggttcaacaaagacggacaacgcctagtggattttcataagtgtgccaactttctagatgaggcgttacatccgcgaggacacctatatcacatctgggctcaagctggtcgaggatccatggagcgtggtacacacggtgcctttcccaaaggtgaaggcgggttggagacgcaaacccggaataaattccacagttgagaggggcacatttactattactctgtggcgcaaatgacttcatacccaatccggttccctcgcggtttgaccgccaccaaggagtataacgcgcgcgtagaacaccaattacattgccgaggcccaggcccgccacataaccatgggttactctttggacataaaggatagaagcacgggggcctggccgtcgcaggcgaacaactttgttgccaaggggctaagctgccgcattctaattcacccctttggaatatgccccacgagggaggaccatctgggcggcacaattcggttgatcactgcgtaggcctttggatgcgccttaaagaaactcgctgaggttcactgaggatagggccatagggttaatcctacactgcaatgttgcaatacgatcgccttcacgcgactacataggggtcttgtcgaaatgtgcccacacccgtatgggn

SEQ ID NO: 590352 - DNA, 566 bp, Homo sapiens
cattaaaatgtgtgtgaataaaaaatacagtggatcttgaagacttagtttggaaaaaggatgtaaaaaatcccattcattttcaaattgattacatggtgaaattaaattgggttatataaataaacaagtatttggttaaaaattaaatgcaacttgtttatttttccccttttttaaatggggaaactaaaaaaattaacatatgtggcttaggccatatttctgttccccagcattgttttagattatggtaccaatatataaggcctggcataggcaaattcaaaaaagttttttattctaagggctttatggctttacccaggcttttttgctgtgagttttctattttcaaagtgttggtttgcgttatatctaagagcctagaagctgcctgatagactaactgcctctgggcccttggaaataatttatcaaggcaacatcgcctcctgtggggttttaaatttaaccatcctgtttattcttcattttgtttcagcaggtgtctgagggctgaacaaacattccttctttctttttttttttggagactctgtccc

SEQ ID NO: 590353 - DNA, 575 bp, Homo sapiens
acggtgccttcgccgaacttttgcacagcgccatgccggcgccatccttcaccctcgcccaccgctggctgtatgcacggccgtccaccagccatgaatttggcgtgctggccgacgccgacctgggcttgtacgtgtgtggcgactggtgcctgtcgggccgtgtggaaggtgcctggctcagcggccaggaagcggcgcggcggttgatcgagcatctgcaatgaaccgcatcaatcccgccaagttgctgctgtcggagtggacagcagcccgcccgcagcacaaggaaaaacatttcctggtcacccagttgctgcgcgacgaagaaggcgatgtgcaggaaatcgaactggaagcggtgatgagccatcgcgttcagcgcctgccctggcaaaccctgcaaaacgctgaagactggaaaatcggctggaaatagccattccgcaaatacctgtacaaattatttgacttgtacagcttcaaacctatgatgagattaagttgtacagaaatttatctctgtacaggaatttcaccgaggtttggccatgtccagcaccgggtaccgagct

SEQ ID NO: 590354 - DNA, 173 bp, Homo sapiens
ctatgagcggctggacagagatcacagatcaaaatatgacaagggttctgcgggaacacaggctctggcttctgatggttgttggcaacgcttaggttttgtgtcactgtgttttctctctctctctctctttttagggccgtgcctgcaccatatggaagtttccaggctag

SEQ ID NO: 590355 - DNA, 123 bp, Homo sapiens
gcggctgggaccctgtacacgtatcctgaaaacttgaggtcttcaaggctctcatcgctgctcaagtacaagcggggctcaaggtccgcgtgtcttccgaacccacccaacttccattttggc

SEQ ID NO: 590356 - DNA, 1084 bp, Homo sapiens
cgggctggactcatgtcgcgcacggtggaaccgatcctcagcaacgccatgcaggcgtcacgagtgcggacgccgtgtcagcaaaccttccgggcaaactggctaagctgcaccgctgaaagtggactacagcatggggcgcgcgacgccagagctccgtaaccccattccattacgagaaggcgtattcgctcaccgtccgcaagagtttggaagcgcgtcactcccagaggccaggacgcgaacaatggacggtacaagtctgtcgagggcgctgtaacgagccaggcgagtgccaactctggacagcattgcgtgaacaggtcccaagtcctgagagccgtctagcatccttgagcaggagatcgatgggcctgtatgatgtggcgcgtccctgagtcattgggcctgcatggatgggtgaagacccatggtaggcaaaagggatgcatagacggaggcttcgttgatggagcgtgcatcttgacgtgtcgttgccccgctaggacccattcatgcgaatatcgccgcgtatcaaaagcgcgcatgcaagggatgaaggctgggtgcatggtcgtctaggcatctatccggcagtcgataggctgcgtccgtggcaaatggcgtcaatcgtggagagagcctccgagcgattcgtgaagagactagagtgctcctcggcgcatagagccccttcatcaagcccgatcttgatgttcctggcggccgctagtcctgaagccaaacgggatcacggtacatgccttggtagtaagcccatgcaatcgtggggggcttggggacctgaagggcgaagtaagtctccccttcgttaaggaacctgttcgttcccaactcagaaggggaataggtgacaccgtccgttctggggtcataattccgccacaaaggcattgttggggtccccctagcgtgtgggggccttcccgtaactcaccttgtgtaggcttgtcaggttctttgaagccccaccagggtaaactggtgcgaatggcgcaagagaagtggttactaaggcaaatccttggacggaaaggtggaacgccaattagaaagcaccttc

SEQ ID NO: 590357 - DNA, 329 bp, Homo sapiens
gggacagtcttgctgtgtcgcccaggctggagtgcagtggcggtaatctcggctcactgcaacctccccctcccaagttcaagcaacactcctgcctcagcctccagagtagctgggatcacaggcatgcaccatcaacgcccagctaatttttttgtatttttagtagagatggggttccaccatattggcctggctggtcttgactcctgtgatcgacctgcctcagcctcccaaagtgctagattacacacgtaagccaccatgcccagcctctatatcttccaacattgttacaaaggttctggattaaggttgtctacaatctt

SEQ ID NO: 590358 - DNA, 918 bp, Homo sapiens
ctcctatctccccatatatatcccgttacgcccttcccccgccctttcttccctctacgaacacacgctaccgtcgactttacctgggatgaaaaaaagaagcaccacctaaaccagactggatggaacacttcctgccctctctcgtcaccttcctactggagcttgccgttctactacgcggactgtggcctaactattttaatactgttgccttggcaccattcctgcgatattaaagattcggactgtgtcccatttaccatacttctatatctctttatctagcaattcataacataaaacatcctgtcaccatccccttattcttaaatttccttctccttcatcacggctgactgcatctgctccatctctccaaatactaatcctcctttctatcaaccatcatatttaaccccgcatccccttcacttatcttttactcccaatcgcttatcatactcatccccctctatattattcttccccccccattataccatgcccatccccatcacttaatctctctacaccctcacactcattaccactcctttcacactccacatacctaacctcaatcttccattcccatcatcttcctcctttcctcatcttcctccgtctacccctaccccaaatatctcaatcaccccatactattgaccacttcactcgacgatacttccccgattttacctgaactcattattcactccaaaaatatacattcatctctcatctcgaaacccaacatcaagcacaattaacaaaccgacctacacctcaccctgccctccccccgttaccccaccccatcacacaacgaaaaaataaatgacatccatctccacatcaatcctacttcaccacccaccaatccctcctccccgcaccaccgcgtccctcaatcct

SEQ ID NO: 590359 - DNA, 181 bp, Homo sapiens
  misc_feature (63)..(64): n is a, c, g, or t
ctcccattctgtgcgttgtgttttaacctttctaatgtgtccattgaaacaaaaaaggctttnnttttcacaaagttcaatttatctacggttttcttttgtcacttatttgtatcatatctgagaaaccgttacctaatccaaggtcaggaggggttactcctatgttctcttttgagag

SEQ ID NO: 590360 - DNA, 296 bp, Homo sapiens
tgctgagctttactctgcactaggccatgtgtaagtgcctttacatgtacccattacttattaggaatgtttgttacatccagtcactaaacactcaagcaccaagtacttaggccagcagtagctgttacggcagtgataagacctagtttttatcctcagtaagctcagaggcacctcgtttagtctttctcccaaaaaccctctgaaatgagtattacttccactttatagatcttcaggtttaccgagggaagtaacttgtcccaaattcgtgaagccagttcagcaatcat

SEQ ID NO: 590361 - DNA, 505 bp, Homo sapiens
  misc_feature (33)..(33): n is a, c, g, or t
  misc_feature (58)..(59): n is a, c, g, or t
  misc_feature (175)..(175): n is a, c, g, or t
  misc_feature (189)..(189): n is a, c, g, or t
  misc_feature (195)..(195): n is a, c, g, or t
  misc_feature (203)..(203): n is a, c, g, or t
  misc_feature (250)..(250): n is a, c, g, or t
  misc_feature (353)..(353): n is a, c, g, or t
  misc_feature (355)..(355): n is a, c, g, or t
  misc_feature (358)..(358): n is a, c, g, or t
  misc_feature (361)..(362): n is a, c, g, or t
  misc_feature (372)..(372): n is a, c, g, or t
  misc_feature (378)..(378): n is a, c, g, or t
  misc_feature (380)..(380): n is a, c, g, or t
  misc_feature (385)..(385): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (395)..(395): n is a, c, g, or t
  misc_feature (405)..(405): n is a, c, g, or t
  misc_feature (407)..(407): n is a, c, g, or t
  misc_feature (414)..(414): n is a, c, g, or t
  misc_feature (423)..(423): n is a, c, g, or t
  misc_feature (428)..(428): n is a, c, g, or t
  misc_feature (430)..(430): n is a, c, g, or t
  misc_feature (433)..(433): n is a, c, g, or t
  misc_feature (435)..(435): n is a, c, g, or t
  misc_feature (440)..(440): n is a, c, g, or t
aaaagatgacaggacacagagccaacccacaanccaaatattcataactgtcctgaannacacagagcccaaaaaaaggggccagccaccccacccccgtaaatactctggctgtgttataaatatggcaagaaataaacatgaccaataccaatagacttcttgaggctactanaagttttgagaaanaaggtncaaaaaanaagaatgctaacacttaagcacagactagagcttgcttgggtttctncctgcattacaaggtaaaaatttgttaatgtttgtttttattcagcttgggaaagctttgtgccatgaatacgtcgcatttaataacaagcaacacacggcananagnaannactttaattnaaaaantnacatngnagnttntnatatcagacntnacaaagntttgagttnatttncntgnanaactngggtttgtctggcttttggttttctttttctttaaaaataaatgtacagtaaaactacaagcaaa

SEQ ID NO: 590362 - DNA, 930 bp, Homo sapiens
  misc_feature (930)..(930): n is a, c, g, or t
cacggtggctcacgccatgtaatcccagcaatttgggaggccaagccgtgtggatcatgaggtcaggagttcgacgtagcagctgatcaatgtggtgaaagcccgtctctactactagtgcgaaaggaagagctccctgcatgtcctgcattgttgcgcggccacatgggtgtgaaaaagggatctcagacggcccgcatggagggtgaaggtacgagcttaaagccgagtggttgtggctgcataggacctcttgctaacttgggttcaaatattggtggtgagagtatctcggccaacataaaaatccccggggggtaaactgagagagttctatgctaggccgggcgcgggtgggtcagaacctgtaagcgcagcaactagggagggccacagtgggtggcatcatgaaggttccggactccgaagttagccaagcatggtgaaaccccgtctctagttaaagataacaaaaaattacgctggcttgaatggcaatgcgcctgtaatcccagctactcgagaggttgacggcaggaggaatcgctttaaacccaggcggcagaaggttgcagttgagccaagaattcggccatgattcacaagcctcagcaactatgacgttgagactggccccaacaacaaaacaacagaaccctgcattcaaaaaatccggaggagattttcagcagggccattataatagttaacacagggattacgtgggttgcaatagcttgacacgtttgtggtgggacttcaaggcacacaagtggatggaaaaggacgccaccggccattcacatgtgagggaagccttatggccttagaagggtacggcagggcagacgaacagcgcagtgacccgccgtgtcacccatagaggcgccggaagcaaccagcgagcagtcgtgttgtagtggctaaacn

SEQ ID NO: 590363 - DNA, 345 bp, Homo sapiens
tatctgtggtaagctgacagcagttttacccaccattgcttctgcaccatcagtgcaaatgtcaaaatagtgaaaaggccaggtgcagtggctcacacctgtaatcctcagcctcccaaagtgctgggattacaggcatgagccactgcgtctggcatatcttagttttattatgcaaatagttttgaccttgcagatcctctgaaagggtctcaggaacccagacaattgtaaccagaccattctttaaggaaccactaaacagttttgtaggaggcatttctggttttcttcctttttccctttttggcatatttatttggctaacctttgtttaccacacct

SEQ ID NO: 590364 - DNA, 173 bp, Homo sapiens
ctacccacggaatactgtacggagcttgtcatcactggaaatcccatcaccatcttaccagtgagcgagatccctccaaaatcaatgtggggcgatgcatggcgcatgagtacgtctgtgtcagtccacatggctgtcttacacctaccactggatgaatggcttggggctca

SEQ ID NO: 590365 - DNA, 157 bp, Homo sapiens
tggaatagtgctgcaataaacatgggagtgcagatgtctctttgatatactgatatcctttcctctggacatatatctagtagtgagactgctggatcatatgatcaaattggctcttatccccagtgagttggccggatacgaaggctctcatcta

SEQ ID NO: 590366 - DNA, 164 bp, Homo sapiens
  misc_feature (68)..(68): n is a, c, g, or t
actctttaggatcccctcatcaaaccctgaaagcggggcctcacgatccttctgaccttttggggtgnaagcatcatcgaaaccctgtcatcgaaaccctaaatctctcattgcgtctagaatctcctatttttgaggctgatccacggctaagggtttgatga

SEQ ID NO: 590367 - DNA, 822 bp, Homo sapiens
gatgaaggtggccacactaagtgatatggtttgactgtgccccactcaaatctcatcttgaattgtagcttccacaattcccatgtgttgtgggagggacccgtgggaggtaattgaatcatgtggatgggtctttcctgtgctgttctcatggtagtgaataagtctcaagagatctggtgggtttataaggggaaacctcttttgcttgtctctcattttctctcttccctgcagccatgtaagatatgcctttcaccttctgctatgattgttaggcctccccagccacgtggaactgtgagtccattaaacttctttttctttataaattgcccagccttgggtacgtctttatcagcagcatgaaaatggactaatacactaagcaacggatttttaatgcagacaaaatagctttccattggaagaagatgcgatctgaggcttttatagctagagagaagtcaatgcatggaaacaaagcttcaaaggacagtctgactctcttgtttggggctaatgcagctggtgactttaagttgaagtcaatgcacatttaccatactaaaaattctagggcctgtaagacattatgtctaatctactctgcctatgtgctataaggggagcacatctgtttacagcatggtttactgaaattttaagtccactgttaagaacctattgcttagaacaagatgcctttcaaaatattactggtcattgacaatgcacttagtcaccccaagaactctgatggagatgtttcaaacggattatgtttccatgtctgctgatacatttaagtctgcaggccaa

SEQ ID NO: 590368 - DNA, 133 bp, Homo sapiens
acggatccctcaaacttcgacggacgcattcatatttatggtatatatgttctgtgaggttttcgtccttgtttgttggaaaaagttctttactattttagggagatcatccttggcctactgatttcaccag

SEQ ID NO: 590369 - DNA, 189 bp, Homo sapiens
tggtgatggctggagttttgtatgaattgaaaaactaaatggattatgagaaggcgaagaacaggtataaaaggactaagaattgggaggaactaaggcatctaattagagagtgtctaaggagattcagcatagttctgtcggcaaagattatttatttacttcaagagtttagagtggcagtttggg

SEQ ID NO: 590370 - DNA, 436 bp, Homo sapiens
  misc_feature (1)..(1): n is a, c, g, or t
ngactgtttctatgcatcttaaatacttgagtgctgtgaagtgtatataatgaagtagggaagaatgggctcccaaggggtttgtgatctggtggggtgttgaattaagccatacttgggagacgttccatagtgcaaggtgtccgtgtggctcaaaagtaaatcttttactccgagtactctggctgggtatactgctgccatttcaggttcagccatgtctccatttcagttcccaatatcatagttttccttgtcagggtcagaacctgtcgcgtcacttttttctcctcttcctcaaatccatttgctctcattatgtctcttgtgtccgcctttcctttccattcctccttcaggcaccctgatttctgccccaacttactacagctctgaattatggcaggtgctcctcatctggtcccggcataacttg

SEQ ID NO: 590371 - DNA, 371 bp, Homo sapiens
agcgggtcccgcgtctctgggccagctcctgccgcgtctccgccagggccccgccgggcgccgcccactttcggtttccccgcaccaccggagccgcccgcgtttgggaatcacctcaaagccccgggactgacatgggcttcagggcccgtccacagttaaggatccggttgccgagaaccgagggacacacgtgtgaacctgcacgtggtcgcccagaattacgagctgctccggtgccccttataggcaccccgcacagtgagttcgacaacgatagtataggccacgcccgagagaaatcctaccgggaagttatagcattcagcaggcactagacagtcccacgatgacgtggctggtctccgatg

SEQ ID NO: 590372 - DNA, 115 bp, Homo sapiens
tgcgggaaggaatcaggacctgatgatctgagatggaggacagaccaacgaggtgcacgaggccggcatcccgtgctggactacaagagctgatgatcgagatggatggacgagc

SEQ ID NO: 590373 - DNA, 115 bp, Homo sapiens
aatgcctctacacgctgccaggtggagcactgaaaggcagtcgttgccttccgtcaggagccctatgtctcagttcaatgtatgcttggcccagtatgttgtgctgctgaactgg

SEQ ID NO: 590374 - DNA, 175 bp, Homo sapiens
tccttcatcatacctaccccttcatcatacctaccactgtaggagatgtgcgtctgtgcgagaagctactgagggatgccgggggacaaggagctgggctgaggatgagaaacagaaggcagagacagtacaggcagcactggaggaggcccaaggggcaacaggtgtattgccc

SEQ ID NO: 590375 - DNA, 435 bp, Homo sapiens
  misc_feature (46)..(46): n is a, c, g, or t
  misc_feature (105)..(105): n is a, c, g, or t
  misc_feature (149)..(149): n is a, c, g, or t
  misc_feature (226)..(226): n is a, c, g, or t
  misc_feature (245)..(245): n is a, c, g, or t
  misc_feature (307)..(307): n is a, c, g, or t
  misc_feature (361)..(361): n is a, c, g, or t
cgtctcccaggaaaaggaaaagggttaaaatgcaccgaggctgtanctgggctacttgatcttgctgaaagtgtttctaaagatagcaccactttttttttaaancttttatatattaaaaaacgtatcatgcaccaactgtgaaatantgcccttgcgcaagaggacccggggaggggtcccgagaggttccccatgcaacactggaaatgactgttccagagancgggcagacctggcaaagnccctggcgcctgagactaccaccccactccgttcctgccagaaacgaccctcttgtgccgantgccatgcggcccctcgcagccaactcagccagtgttgggacttgcttcaaganccatgggggctggaggggggcagctgggactctggaatcttctttataataaaaagcttacggacaaaaaaaaa

SEQ ID NO: 590376 - DNA, 383 bp, Homo sapiens
tgtgttctcctctcgatgtctgacactgacaaatggctccactggaccaacaagccctccaacaagccctcctgtggccccacccagaagcgattcagcaattaagggggattttcccacacccctatgactgcattccccaaccaatcagcagcaagcacccattgccttactgcccccaccccttcctccaaactacctttgaaaaacccctaagctgccaggcgcagtggctcacacctgtaatcctagtaccttgggaggccaaggcagaggtcaggagttcaagaccagcctggtcaacatgatgaaactccatctctactaaaacacaaaaattagccaggcctgggggcgtgtgcttccagctacttgggaggccg

SEQ ID NO: 590377 - DNA, 1667 bp, Homo sapiens
agcaagaaacccaagaagaaagagaaaaaacacaaagagaaagagagagacaaggcagaagaagaaggagaaggagaagaaggctgaggacctggacttctggctgtctaccacccacagacgcggtgactcgccagagcaaccacgcaagcagaccaagagcgactacgagaacgacaacacaaggacagagagaacaagcaaaggagagagcgcgacgacgaggaagcgagcagaagcaaagaaagcagcactaccacagtaaatacaggaccagcacacaaatacaaacaagacacgcagacaacacgacagggacataacacacacaagtaagaggacagaacaacaaccgcacggcacaacacaacaagaacacagagaaggacaacgagagaaacacacacgccaaccaccagacaaaaaacacaacaagaacacacaagcaaaaacagaagcgagcacgacagaggacgagaagagaagaggcagcagaagacgagagcaacagagacagacaagcacagagaggaacgaaaagcacagaggggagaagacagaaggaaaaacagaggagcgcagatgacaagggcaaggagcgcggacgacgacaacagcagaagacagaggggcagcagagcgaggacggacgagagatacgagggcaggcaggcacaggacacgcagaacacagaaagcaaaaacaacaataggcaaaaagcaaaagaaaacgagaggacagaagccaaagaccgccaacaacaaaaagaaaagacaagcagcgaagcacaaacgagaaagcaaaaaacaacacacagaacgaggcacagacgaacagcaagacccgaatacaacaaccaccaaaaaagaaaacaagaacgagacagacagccacccgacggcagcccacgcaagagacaaagcgacgacgccgacacaccaaaacaacacgaagaaagaccacaacaaaacgaacgaagacacacgagaaccgacacgaacgacgagcagcagcgcagagaccgaagagccaaaacaaacaaacaagaaacaacacacaggaaaaaagaagaagaggagggaggagaggaggacggaaggaaggggcggagacgcagtgagagaaaaagggacagcaaaaagggacggaaaagcgaaaggagccaacaagagacaggaacagacgagagaaaggaaaggagaaggaggcgcacagagcgagagacaaggagcaagagaagacgaagcgcggagcaagccgcagcgagcaccgacagcgcaacagggggggggaacgcagaaggcagagacgcagacgagacgagacgaaaggaagccaaacgaaagcaagtcacgagccaggagcacagacagcaagagaagagagcgaagcagcaaaagagagagcaatagcgaggagcgagagagggagcgagagcacagcacccgggcaaaaggacgacagatagacggagagagcaactgaggaagcaagaacaggaccgagaacggagacaggacaagtacgagagactcacgcacgcaggagacgagaacaacccagaccgaggaagacaagagcaaggaccaacaaacgaacgaggagcaacccgagcgaagagggacagcagacgaacagatgcaaagaagacgaaagcaaagaccaa

SEQ ID NO: 590378 - DNA, 196 bp, Homo sapiens
tagccctagattatagttcacagtaaatactgtacgaataggctttcttagattgcatcacttctttttagaactttagatcctccaggacagtctcccgtatgatctttcaaatttcttgtttttttttgggtctgtttggttttttcctctcctaatttctgacttagttttctattctacttctaggagattt

SEQ ID NO: 590379 - DNA, 144 bp, Homo sapiens
ttattacataaatggcttttccaagagtcaggcaataacaaatgcaatgtgaggatgtggaagaaagagatccctcatacactgtttgtgggaatgtaattagtacaaccactgagaaaaaacggtttggaagttcttcagaaa

SEQ ID NO: 590380 - DNA, 501 bp, Homo sapiens
gggttcagtggacacaagggtgggtgtctctccacctcctcacatatgctaacaggaagcagaacattcaggtgcctttgcagaaagagatggcagagtgtcttgaagtcagaaaggggaggagtgaagaaatcctgcatctcagtccctcaaaaaaaaggtggctcaggcttttcaagctgtgagagacacatccgaggcctgggcactgtcgctggacgcagcctgagagtagctccctccttttccacctgagctcttcctcctaaacatcacagtagcgaccacagttccgatgaccacaatggctaggaaagccaggccagcaacaatgcccacgatggggatggtggactgggaagatggttcccatctcagggtgaggggcttcggcagcccctcatgctgtacatggcatgtgtatctctgcccttctccagaaggaccaccacagcttgccacttctggaaggttctatctcctgcgggtctggtctccaca

SEQ ID NO: 590381 - DNA, 877 bp, Homo sapiens
  misc_feature (1)..(1): n is a, c, g, or t
  misc_feature (414)..(414): n is a, c, g, or t
naaactggttgtgcgtttgggcccgtaaacacgctcgcgttttcatgggaaatctggtcgtgagtcgtttcacggacccagaacgcgggcgctacagctggcgctttcggagcagttgggccacccactaggtcccggcctcttcttagggttacaacagccgcgttctcggtgggagcgcccccccacagggttactccgccactgcagcccacagggggaaatctacacagttgcgacgcggcatttgtgcagtcaccaaaacactggtgtagcccacagtcctatgcggcgccgtatacaagtgcgcagcgctccaacccaggcgctactcttactcgggggtcttcctccgaacaacgaggagcacccaccccaccagcgctggggcgaagaaaacacggccctcccacngtctgtggagagaacacccggacggtggataatgccgccctcacgcgccaccactatggtggtcggcgcctcaccccacccggcgggcgcccgtcgagcggcagagagccaccccacacgccgaagacaaggaggaggcgccgcgacaccccacgactgcggacagtggatagaaaagtcgagagacccgccgccacacgggcataacaccccctccgccaggcgtgtcacaaatctcgcatagacgccgcccacactgcatccgctgctgtgcgccctaggccacacggcccgtccctccggaatctcgcccctcgccgccccaggagggagaagctccacgccccgccaccacaccggtggtgagggacaccctccgcctccggttcacatctggaagggaaaattaatttttaacccgttcgggaaaaaaaaaatcatacaccctgctccaaacaaaaca

SEQ ID NO: 590382 - DNA, 247 bp, Homo sapiens
ttattagtcctgatacctgaattattaaccatgatatctgagactcaaaactagtcagtgaattatttgaaaagtgtgtgcacctgcaacatcactttaagtcatttagtatcggccttctcaaacagctttcatccctcctggttaacagaaatgcgattgtcagatatcacatttcctttttaaaacttaatttatttaaacccaacaaatcatttgggctcatctcactcatctgtcaaacatc

SEQ ID NO: 590383 - DNA, 129 bp, Homo sapiens
gtgaagataaagtaagtgctgtttggctacaggatctctcttgcagttgcagccaggcgtgattccagcagcgcttacccggagcccgaagattcactatggtgaaatcgccttcaatacccctacccc

SEQ ID NO: 590384 - DNA, 347 bp, Homo sapiens
ggtcctccaaatctaccaggccatctccccagtttcccagttcttcctgtgtgcgggcgagagtggttgggccctcgggaacccactcagagcgagtctaaatttacggagggactctctgttagcagcatgagggcccgtcgttagacctatagaggtatctccgttgattcaagccagaaagtcctgagagcggatcggggcgcatctgcggatcggtcactttttcctcctctctgagtctcttaccccccaccacagcgacggcccagccgccacgatgccctggtctcgcctcctccatgctctcaacacgcccctaccttgcggcccagccccggctcccc

SEQ ID NO: 590385 - DNA, 244 bp, Homo sapiens
  misc_feature (213)..(213): n is a, c, g, or t
atatttatttttggtagatatgggtcttgtatgtgcccaggtggtgtccaactcctgggcaaccttgcttgcgctcccaaagtgctggcctcccaaaatacgggcgtgagtcaccgtatttttttttttttttggaaacagagtctcattctgtggcccaggttgaagtgcaggggcaaaatctaacctaattgtaacctccacctcccaggntacaagcaattcttggggcctacagcctccc

SEQ ID NO: 590386 - DNA, 384 bp, Homo sapiens
gggaatctaagttagtgcattttgaactgtcgcctgtgtgtgaggtgctgcaggaaattctagtttgataaggggatgccgagggaatttcctggcatggatgctgcttgcttactgcttataagttaatgtgtcaagatagggaccggttgctacaaaagaaatgtaagctggaaaaggaaaatgctaatttgacttccagactggccctggcccaatgccaggcctatgtcttgactgatcaagctcaaagctagtaatgcttcctccatagtctggtgggtgtaaatatatatagacatagctcttcttctccctttcccactgcgatttgcttattatgtctgtattgccatatacttggaataaaggtgtttaccctta

SEQ ID NO: 590387 - DNA, 817 bp, Homo sapiens
  misc_feature (349)..(349): n is a, c, g, or t
  misc_feature (378)..(378): n is a, c, g, or t
  misc_feature (404)..(404): n is a, c, g, or t
  misc_feature (435)..(435): n is a, c, g, or t
  misc_feature (588)..(588): n is a, c, g, or t
  misc_feature (599)..(599): n is a, c, g, or t
  misc_feature (601)..(601): n is a, c, g, or t
  misc_feature (605)..(605): n is a, c, g, or t
  misc_feature (607)..(607): n is a, c, g, or t
  misc_feature (626)..(628): n is a, c, g, or t
ctgctccctcttcagggggaggctttggagtttggagcttgcgtctgagtggcgtggaatatgcatctcctgcgggctgtttctgctcagctgagtctggtggtgctggagaaatactgtctgctttgaataccctagagacctctccaagcccagcattgttgatgtatttgggagctgactgcaccatcagaaaaatcttctagaaggaggcagtagagaaggggtgattttggtagctccagaaggggctccagcatctggagaaagaattctaggaagaggattccatgtcatccgcctttaagtctcggaagtaagcatgaagaatcccagtggtgaggagganaggctgaggagtcagaaaaagctcctacnagaagatggaacagctcctacaaagnggtggctgtgggtagaagcagccgcctgggncagttttcaggctttggagaaggaaagcagcttctctgttgaggaatattctgcaagtaggtgatcactttgaaagctggttactatccttccttctaggcctgtcggtggggaaggagggcagccgtgtttgctctgctcccatgaggcaanttcggtcaccnanacananaaacagcttcttatgtagnnngcaggggaattagcctagttttcggatattcacccagtattctagctttttaaagaacagcctgaagaggctgggtgcagtggctcatgtgtgtaacctcagcactatgggaggttgaggcgggaggactgcctgagcccaggagtttgagaccagcctggtcaatgtagtgagacccccatctctaca

SEQ ID NO: 590388 - DNA, 720 bp, Homo sapiens
gggcaccataccataccatggcaggcaggcagaagagagttttcattttagctctcttccactaacttgtggactttgggcaagacattaactaccctgggacttagtgttctcatccctaaagaagggtttagtctgtggtctccaagatgatttctagcattactgttctgattctagataagaggtagagtagagaggatactatgaaaaagaaccacaagataggacagggattttgcaaagaagaaatgagtgggtataagacactggtagaaggagaaaggaatcagagtccagagcttgagctcacattcaggggagttaaaggatgataaaaatgagtcgtgcatctgcatgtggtttttcgatttttatggtgattcatttttctgtattacagttttacatttaaagaaatgccttggtgtgcagatgtctgagtgtctgtatgcttggctgagagattcttggattcacttaactagagaaagaaaaacatgtttggatcgttgattattcttgcgctcctaatatttagacaactttggttcccaccctttcctaaagacttgggaaactaatggaagccagttacccatctttgacaaacattcgcagaggaacagaggcaccatgaaatgttgacccattctttgcaggaagactctcagaatctaggaaccatgccatattccaggtttaaaagacctggcaatg

SEQ ID NO: 590389 - DNA, 132 bp, Homo sapiens
catgtcgggttacccaaggtcttagccgggagttaacattgcagcgagctgtgattgtgccatggtattccagcctggtgtgacagagcaagaccccatctctaaaaacaaacaggctaagggacccttgtg

SEQ ID NO: 590390 - DNA, 555 bp, Homo sapiens
ctgccgtatgaacttaggattcaaatgacaaagcacagctgtgccttatagttccttgtggcatctgatgacctgatgtcttcttgattggccttgtagcaatatgtggttgctcagcttcagtgaaaaatatattgccttttcccccatatatatgcaatagcacacaccctttctgctttcaccaaggttgcccttgataataaacggatgtaatcctgcataagacctgggtctgaatgtcttcttaggaacacatttgtcagtgctgacctcgagagcttgctccactcgaccgaagggcaggagcctcagcctacaactatgttccagcacttgccacagaacactttgtggtggggcagaaccaggaggaagcaacatccaccccagccagaccctctgattccagttgggtggctcgatttctccccgttagggagagggcaagaaaatacgctttaatttaaaaggctgtcataaaaataggaacatacactcttccttcagctgacccaactcaattcctgtgctgagactaattcaccaggacat

SEQ ID NO: 590391 - DNA, 396 bp, Homo sapiens
tttaaagacaggggcctcattccctggttggctcagggctggaagtacagtgggcatggatcttgggctcactggcagcttcggacctccccggggctcagggtgattcctccccacctcagcctccccaagcaactgggaactaccccagctagtcctacccatgaccggttagttttttgtatttttaatagagacatggttcaccacattgccccaggctagtcctgaactcccggactcaagcagtccacccacctaggcctcctaaagtgctagaattacaggcgtgagccactgtgcccagcctgttacatctacattagatatatacatatataattattatatattttatatatgtaattatttcctaatgaaataacagacaacatt

SEQ ID NO: 590392 - DNA, 118 bp, Homo sapiens
ggaggtacaggatccaggaaaagtgtttgatgaagctaggactgaggcgcagcgagtaagcagcagttcgtggtgaaggtaggaaaagagtccaggagccagtgcgattagggttagt

SEQ ID NO: 590393 - DNA, 334 bp, Homo sapiens
cgttctaaatgcattcaaaatgacctgaatttccacaaatatctgcttaagattcatgtcattgttctaaacctctgtgtttacagggcttactgtttctgggtccggaactgaatggtgatctgctgtgaagtcagtgttcatgtaaccttattatggtcatgtaatcttattaggggatgatatccatctgtgcgtacgctccaggcatgctttaaaaggatgatcttggctcacaaacacactgacacggatggccactgatctgtggatgacagatgtttactgcaggctcatgaaacaaatccatggagtttgtaatcttttcattcaa

SEQ ID NO: 590394 - DNA, 197 bp, Homo sapiens
gaggatccccgaggtgccttagaagtgctatgttgcacactctgtctccttaacttatcacagtgcaagctttgagcagcatgcatgacagccaccggaaatcttcagagcagatgaggtctcacaatcaatggccgctagtgaggagccacacttacacgctgcactgacaatgtcacagctcgcttctgcctgtg

SEQ ID NO: 590395 - DNA, 270 bp, Homo sapiens
ggccgctcccatcccggcagccctgggtgctgctcgccccaccctcgcttatttgtagattcaaaacgatgtttttttttgtgcttttaaaagtagggagttcaccagtaacagccaggtgaagcgaacctgctgggtgatttgtttgcgctctgttttatggggcattcctgcgaaatgtgtcagcttttgtgtgaaatgcagccccagctcatgtggaccaaagtagaaaacccaatcccagagaaataaaaacatggttcagagaga

SEQ ID NO: 590396 - DNA, 144 bp, Homo sapiens
cggtactctaagatccggcgagcgcatggctgcacggtggatgctgctgctgtgcttgctgaggcgggtggtcggtgctgggcaggcgatggagaaggtgacaggcggcaacctcttgtccatgctgctgatctgctgcgcctt

SEQ ID NO: 590397 - DNA, 813 bp, Homo sapiens
  misc_feature (813)..(813): n is a, c, g, or t
tctctaattaccccgctacagatcaataatggtggactttgaaaagctggatgactacacctctgcctttcaaggtcatgatgttggattctgccgcctgagtaccaccagagggatagctggggcggagggatttgctcgcgttgaccgagattatgtgctgaaatctgcacagctggcaaaagctggagggtgcaaacatttcaacttgctatcctataaaggaggtgataaatcaaccactttttttatatctacgagttacgggagacgttgaagccaaggttgaagaattaaaattagatcgttactctagatttaggcctgaacctctgggccctgataggccatacattctcccaggtaaatgggtggatagaaacgtctttggcttcttaccagactcttgggcccgagggcattgtgggccctgtggctacccgggttccagcatgctgaaccaacgttgggggtaccgtaaccaagccagatggaactgctgggaaacaaggccctccttggacatggggaaagcgctaggctctctaagcccatagctcattcggagaatgggtgttaatcggcaacccttatagccatcaccaattgggtatttccaggtttaaaagagttacaacgtctcagcttcggtggttactatccggagcatacttgcaaaaggaatgatgcgcttccatagaagctgaagccgattgactagagaccttgaggacttggcaaataaagcctggggcattatcatcttgcccacagtggggggggggcccaaactcgttttttttgggaacctcn

SEQ ID NO: 590398 - DNA, 150 bp, Homo sapiens
catgggatggaggacccggaggctcttctagactaaaacgtggtacaaactggcatactaacattgagattcccgagattgagatcgcgaaatgagtgcaatagaaaatttcgcctaataagtaactgatgcacagctgatgtgctttgt

SEQ ID NO: 590399 - DNA, 203 bp, Homo sapiens
gaaacctaattacgcaagtcactgagcccccaacatgccctgtgatgcctggcactgatgccccggccaagggtcactcagagagagcccaccgttacctaagcttcagtggagtcatctcttgtgaatcaacttcataaccccaacccagggcgatgcctagaaacatcttctcaatgaaagagcaggagccaacccacccc

SEQ ID NO: 590400 - DNA, 189 bp, Homo sapiens
cctgccatatgtaaaccctgtctccgctagagatgaacaatcggccaggcatggtggcacacacctgtagtcccggctgattgggaggctgaggcaggagaatcgcttgaactggggaaggggaggttgaagtgggcctagatcacatcactgcactccagcctgggtaacagagcaagactctgtctc

SEQ ID NO: 590401 - DNA, 319 bp, Homo sapiens
ccccctttttttagccctttttgggccatatttcctggggcggcgccccttttaagggggaacctttaggtggggttccctttttgggggaaaaagcctttaggagaccccgtaccccttggggccctttcctccccggccctgtggggtgttttttttttggcgggggcccggttttccccctgggggaaaaattggggcggttttttttttttgggggggcggccccttgaattttttgggggttttgtggggccttggggggttacccccccctggttttttttttcggccttttttcctttaatttttttttgga

SEQ ID NO: 590402 - DNA, 174 bp, Homo sapiens
ttcaattgaccaagaaagaaattgacgtgatttccattcctagcgagtgactcttctggatacatgaacctaactccaaagttatcataccaaagtgtccgaaaaaccaggcattctgctttggctttgcatttgatgaaacagcttcgaacgaagttgtctacaggttcacag

SEQ ID NO: 590403 - DNA, 1752 bp, Homo sapiens
  misc_feature (200)..(200): n is a, c, g, or t
  misc_feature (932)..(932): n is a, c, g, or t
  misc_feature (1033)..(1033): n is a, c, g, or t
  misc_feature (1264)..(1264): n is a, c, g, or t
tcgttcgtcgtgatgttgtggctgtgtccacttgagtgatggcatggttgtgtgtgtgatgtgatgccatgtagtgaggtgcgtggtcgttggactggcaggcgctgtgttttgttgtgagtgatcgtgccggatcagtggatggttgccccgcctagtttgagcaactccccgcttgttgtgttggcaaccacaccacnacggtgctggtgggggccgcacccttttatgaaatctctgctggggggccgcccaccaccagggggtgtgcccgacacaagagaaagcaacagcgtcggtgtggttttgatgaccgccgcccccccccctggttgattgtagttagccgcgccggtcgcctcattaagggtttggccgagggccgcccccttggtgcgttggccgcaggagagtttctcgcgcccacccagcatgggggtgctcccctcgcgctcctgcttgtgtgtgagatgcgcccctctgaggcgccgccgcccaaaggttgtttcgttttgtgtggagcaaccccgccccggtttgttgtgagtaggccgcgctgtttctcggtgggagagtctctctcgctccctcccgcgggtgatccccccccgcggctgcactatggcggggcgcccacacgagtgttttcctctctgcggagaggccccccctgtggggagttgatgtccgccaccgaagtcgtctacgccgcgtcttcttgtatgaagagacactctattgttggttcgtctcccctcctccccgagaggggtgcgccaaccacagccgcgtctctggtcttcgtcgcggggcgcgacaccgactctctgctacggcgacgtctgtagtaatgtcggcgccactccttctctcccccctcgccccctcagcaggatgtgtgctgttctctggtggtgtgtgtgtgtcgtacncgctgcgtgggggagacacaacacacacacggcccctctgctgtgaagcgaagcaggtgttttagagtgcgccgctgctgagagagtagttcccccctccncccacactgctggagacactcttctgcagagaggcgcgctctctgatgatagaaaagactctctcaccccacagagagtatagaaagaaactctggcgtgtcacacagagagatgtcgtggcgccccacacacagagagtgtagtattgatagcgcgctctgtgttgtggcgcgctctcacacagattgtgtctctcgtgtgtcgtcacaccccacgtagtgtctcccccncccgacatactctctctccgcgcgccccgcgagtgtgtgtgataataaagagggacacacagagagaagtattctccccctctctccccgcggtcacacacacacccacccgcacacaacacactctgcgtgggcacacacacgctgtgagagagagagaggtgtgagagagcgccccacacacactcacacgtggtcccacacacagagagagagaagaggtggataaatattgtcttggccgtgaagctctgtgttgatgcacaccgcgagaaagtagaccaccacccagtggagaggctttgtggtgaaaaccacactccaccccgcgctggtgacaacttgtctttggggtccctcttgtctcccacagaaaaaatcgcgccgaatatgttcccgcccctaaaaatccacagcaccccccgggcccccccccccccccctttttagaagccccccttgtgaaaaatttttttccccccgttata

SEQ ID NO: 590404 - DNA, 291 bp, Homo sapiens
  misc_feature (46)..(46): n is a, c, g, or t
  misc_feature (54)..(54): n is a, c, g, or t
  misc_feature (117)..(117): n is a, c, g, or t
  misc_feature (125)..(125): n is a, c, g, or t
  misc_feature (130)..(130): n is a, c, g, or t
  misc_feature (151)..(151): n is a, c, g, or t
  misc_feature (245)..(245): n is a, c, g, or t
ctgggactataggcacacgccactttgcccagccctggctaatttntgtatttnttttttagagacggggttttttgctgtattgcctaagctggtctcaaagtaatcctccctggnctcaattnacccncctgcctggcctcccaaagtnctgggattacaagtgcatgctgctgcacccaacctatatttttaaaaggctgcttaaaagaatggttaagcaggccaggcatgatggctcacanctgtaagcacagcacgttgggaggccaggcaggcggatcaattgag

SEQ ID NO: 590405 - DNA, 151 bp, Homo sapiens
aactcttcttgtggtgaaggaaatcacctgcccaccaccccctgttatctacaatggggcacacaccgggagttccttagaagattttccatatggaaccacggtcacttacacatgtaaccctgggccagaaagaggagtggaattcagc

SEQ ID NO: 590406 - DNA, 101 bp, Homo sapiens
atccccgagtgtattccacctccacacgcattaatagtcccatttttcatctatgaccatttgtagctttgcccattgtcttattagtgcacatgggctag

SEQ ID NO: 590407 - DNA, 692 bp, Homo sapiens
  misc_feature (521)..(521): n is a, c, g, or t
atcttcctaatcaagaagatgtcgtgcagctgggagagctagactaagatgctcatgatgcagaagctactcaaatgcagccggcttgtcctggttattgccctcatgctggctctggaatcctcagatcaaggttatcctacgcagagcgccaggtaccaatgggtgcgctgcagtccagacagtaactgtgcaaactgccttggagaaaagggaccactgctcgaactactttcaggcgagtccaacaagatcccgcgtgtgaggactgacctttctccaaagacgagaatgcaggacttgaatcgaatctttccactctatgaggactactctggatcaggcttctgctcctgctccggatctgcatcaggatctgtgagtgccttcctaacgcaaatggaccaggattaccaactagtagacgaaagtgatgctttccatgacaaccttaggtgtcttgacaggtatctgacctcagacaggcaggactagggtcaacatggattagaagaggattntatgttgtaccatggttatatgagtactcttggacaaaggatttatagacattttaacatctgctaaagagcttaagtctatcatcctatgattctcatgaatcttacggatatgctttatgctgtatcgactatagtcctgaatccctgattatggcacacgtcatcaca

SEQ ID NO: 590408 - DNA, 117 bp, Homo sapiens
ctcccagcgcgtctattcgctgacacaccagatgccgattcagttcacctgaacatctggcttacttcctggcgcggtgatgaagtcaccgtcgcgtccgaaagtgtcacgcgtcgt

SEQ ID NO: 590409 - DNA, 570 bp, Homo sapiens
atggccttgccctttgttttactgatggccctggtggtgctcaactgcaagtcaatctgttctctgggctgtgatctgcctcagacccacagcctgagtaacaggaggactttgatgataatggcacaaatgggaagaatctctcctttctcctgcctgaaggacagacatgactttggatttcctcaggaggagtttgatggcaaccagttccagaaggctcaagccatctctgtcctccatgagatgatccagcagaccttcaatctcttcagcacaaaggactcatctgctacttgggatgagacacttctagacaaattctacactgaactttaccagcagctgaatgacctggaagcctgtatgatgcaggaggttggagtggaagacactcctctgatgaatgtggactctatcctgactgtgagaaaatactttcaaagaatcaccctctatctgacagagaagaaatacagcccttgtgcatgggaggttgtcagagcagaaatcatgagatccttctctttatcagcaaacttgcaagaaagattaaggaggaaggaatga

SEQ ID NO: 590410 - DNA, 1470 bp, Homo sapiens
  misc_feature (1108)..(1108): n is a, c, g, or t
agcggattagacgctgtccggtttcgcttacgcgcgcttgcgccgttccgagttgtctcgtgtgttgccctgcgaagtgtgcgagtgtgtcggctccataagggagccgagccgtcgtcagctcgtctcgcgttcgacatctggcatcagtgattctaatccttatccgggaccctctgtcgagccagctgagtgaacgaatcgtgcgtcccgagaatctatagaacgatcgccgaggagggactcgctcggagcgtcctgtgtgccgtcggagcggtggacgcgaggagggattgcgctgcacgatcaggtcaccgggatatgatgaaacactttgatagacgtcggcgtctgaatgcgggtcggcgcagatcgtctatctgcggaatgcatttggcccctgcaagtcgcgcatcgggataccctcggaatggacaggcaatcgctgacatctcacgcttggggttgatcggtgaattgtcggatctggttgaacactcgaattcaaacccgattgacactgagtaacacatcgggaacggttttttctaaccaaattatagtgcaatatgggcaccgttaaccaccaagtattatctgggtggaccaaattcttatattgaaagatatgttgtaaccattattgagaggagcgtacaccatttccaaattcggagaggagaacagcttaatgaacacgcaaaaccaaataatgaatcgcggagggactagacgcacgggttataaataattccccttttgttgtgcgttacacccctggtggaagtcttggtccaccgttatatctaaccaattctaggacgccaattccgatttccgctttggttcatttacaactttatttcaacgacaaacggagcaatacagcacgacgctttgtacaaatcctcgtaatatttctagcggactcgggacacacaaagcgcaggtaggaattattcgcccatggtgaatttgggtgcccaacgtggcgttggtctggtggcatcccgttaccttttggtgatatgctaataaggcccgttggtgtctacaggggtacagtagaggcgcatttgccgtcggccacaaaccccaccccgccgtntactccaatttgataattctactacagcgcgtcaacacatcgggctggcacgttggaggtatcatcactacgttacaggacctgttgcaggcacacaccttacatctctggtttttcatcgcgtcccattagcacactggctgggtgggctgaccgtgttagtgtcgtttggcgtaacttctacggtgccggaccttcctgtgtttcacctccctaggtgtaggacccttgggttctggtttccatagccccattttgcgttccattgtcgccaggcacccccaattccacacgccagtgtgtgacactgtggtcacactcaatctccacacttgtgggccagcgctggcacttgttgtaca

SEQ ID NO: 590411 - DNA, 269 bp, Homo sapiens
gcctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaccac

SEQ ID NO: 590412 - DNA, 401 bp, Homo sapiens
tcttctgcctcgctccgcctgcctgctgctgggtgctgtacgactctggtaaatagcaccattgtgatatgcaggatgatgatcctgcatgttaatgtggtttaatggagagggcggcgaagaggacccgcaggctgcaagggagcaacagcgatggtgagaaggcaaccaaagtgcaggacatcaaatacaacctgaaagaggcgattgaaaccattgtggccgccatgagcaacctggtgccccccgtggagctggccaaccccgagaaccagttcagagtggactacattctgagtgtgatgaacgtgcctgactttgacttccctcccgaattctatgagcatgccaaggctctgtgggaggatgaaggagtgcgtgcctgctacgaacgctccaac

SEQ ID NO: 590413 - DNA, 1081 bp, Homo sapiens
cgtgggagggaggaggaggggaggagagacgcaggaggagcagtcgaggcaaaacagaagagagaaagcaacaaacagactcacgtttgttcctcttttagtatgtattttctgtgtttttctcataatatttgtaggtctctctcctgtggtattacatgatagctttttttctttacagacacaccttttttaacgtgttgttcctctttggcggggtgtgtttctgcgcggcctcctctaatttctgctggtcgcaggctatctttttagcccccttggggggcgtgtgatgccttttgcccacagttgccgtgttgttttctcccccgcttgtgggcccacaatttgtcgcagcgggtgtacctctgcggttccccccaaggggggcccctcttcggctgtggcgcccacaactgtgcgccccctgtttttcattccccgccggtgggtgcctttttgccccggccccctggggtgaaatgcggttcccccctgttgtgtttcccccccaggggggggggacaattttgtgttgggccggccgcgcatgttggggggatcacaccggtcggtccccctccctgctagtttttgtgggcaagaccccccctttggcttttcaattactgtggcggtgtctttatatggaaggcaacacctcacttggccccgcgccccgcggggcggtgcccccctcgcttttcccccgccctctctcggggcgcggcttgtgccgccgctgcctcgttctcttgccccccgctcccccaagggtcttccggcccctccctgtgcccccacacctgggttatcccccgccctctttgttttctcaggcactccccccaggttttccccgcggttgcggtggggccacagaaccctcgctcgatatccccgccgctctctctgtgtgacccttgggcgcccgcggaggctccctgtggaacacccgggggccgggagattctcccttcgagccgcccgcattctccccgccgctctcccctcccgcgcgctcggcgccccggaggggggaggccccctctctgtcttgacaaataacaagaacagcatc

SEQ ID NO: 590414 - DNA, 446 bp, Homo sapiens
tagaggatcccgtgatgtatcgccaacaccacgttcccaagtcttcaacctgtacagaacgatgggctgcgcactgcccgtgtagacgctgtgggagagatcgggggattatcacagggaaaactcaactataaatttctgcaggcccggttgaggagcactaccagaacatctgacagcccaagccaaccctctcctggtgctgcctggggaggcaaatcatgctcactccggcggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttgggcgataacatca

SEQ ID NO: 590415 - DNA, 205 bp, Homo sapiens
  misc_feature (10)..(10): n is a, c, g, or t
  misc_feature (12)..(12): n is a, c, g, or t
  misc_feature (28)..(28): n is a, c, g, or t
  misc_feature (97)..(97): n is a, c, g, or t
  misc_feature (159)..(159): n is a, c, g, or t
atcttcgtcnanatcacgggcgttagtngaaccctaatctttcgggtatgacggcagttgttaaattcgttgactacggaaactatgacggggtgcntctgagcactatcaagcccattcaaacagaggcctgggaggaagaaggcacctacgatcacnctctggagttccgttggggaggtgatggccagccttgacgatccac

SEQ ID NO: 590416 - DNA, 152 bp, Homo sapiens
gcaagcactataccacatggagatgacacctgtgagaagccttgagactatttgaagagagaaatgctgggcctagtctccgggtgctccagcccccaagtgttccactctccatctcccccactcttgaataaacaactggcactgaagat

SEQ ID NO: 590417 - DNA, 710 bp, Homo sapiens
  misc_feature (16)..(16): n is a, c, g, or t
  misc_feature (252)..(252): n is a, c, g, or t
  misc_feature (343)..(343): n is a, c, g, or t
  misc_feature (363)..(363): n is a, c, g, or t
  misc_feature (401)..(401): n is a, c, g, or t
  misc_feature (409)..(409): n is a, c, g, or t
  misc_feature (413)..(413): n is a, c, g, or t
  misc_feature (427)..(427): n is a, c, g, or t
  misc_feature (449)..(449): n is a, c, g, or t
  misc_feature (487)..(487): n is a, c, g, or t
  misc_feature (508)..(508): n is a, c, g, or t
  misc_feature (645)..(645): n is a, c, g, or t
  misc_feature (673)..(673): n is a, c, g, or t
tccaagaaggggaganagggagacgcgggcggagagaccgacccgaggcgggggcgcggggcaggggcggcgcgaggacctgacagcgtgtcccgcggcggggcgggggctcggccgcgcgcccgcgggggaggccgccgctagagggcacttcaggagggacagccctcccggcaccccggggcccgagctccagccccggcctcgcggcccgcggcccgcggcccgggcggcccgagccccctccccggncgcgcggctctccgccttccccgccccggctggcgcgcggcccggcccggccgagcactgtcccggccccgaggggggcagagctcgggcnaaaacccgccctccagcganctcatttccctaaaaacgggggggggagtcggaagaanggagggangganaaaaaaaaaaaaanaaaaagaaggaaagggaaaagnaaaaggctggagcccgaggacgagcgcggagccgcggnaccaaacggggggcgggaganaggaaggaaggaggcgagcagagggaaggggaagaggtcggggagcgagggcgggagcggtcgcggtcgcgatcgagcaagccagcgggcgagaggacgccctcccctggcctccagtgcgccgcttccctcgccgncgccccgccagcatgcccggcgtggccncctgccgctgctgctcgggctgctgctgctcccgcgt

SEQ ID NO: 590418 - DNA, 544 bp, Homo sapiens
atccacgttcggcctctcacggtgatggtactcatcttgcccacctgcaaggcgtggaaagcctgctacctaagtcagactatggcttttctttacagtagaaaaaaaaccaaaaaaaaaggccttaccttttttccccccttttaataaaaccagactttctttcactgggaaaattttggttccctgaagttaattactacccctgttggagagcccttacacccaaacattttttggtgtgtgaaacatgactttacctataaactgaacacagttgccctgttatctccgaggcaccatgatatatatagttaaaatctgatggtatgaccccaaatcccccttctctctgtcctcacactcccctgctagttttctacccttatattttggcaaaaggtcaaaagaagaacaggtcctaaaacttacaccattggattttcctcttggctacggctatttggaaagggccctctgcatagcctgttttcacattcccttggcaatgcttaatatccttacactgtgggcgtgatgatct

SEQ ID NO: 590419 - DNA, 1222 bp, Homo sapiens
  misc_feature (23)..(23): n is a, c, g, or t
  misc_feature (27)..(27): n is a, c, g, or t
gtacgcgctaggcggaccgcgangggnagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggcgtccaaggccagcggctgggcaccttctgtagtgaaggcaatgtcggtaccgaccaaaagtagggtccccctcgcgcgtctctatcaagacactcctgcacgatgcaca

SEQ ID NO: 590420 - DNA, 247 bp, Homo sapiens
gcctcactgagtgggtataactattaaaaacattattacaaacttcctaggctgtgacgagtactttgtagatatggtcgttacttggaaagtctgtctgggtggcccagctcggctcgaataaggaggcttagagctgtgcctaggactccagctcatgcgccgaataataggtatcttgttcccatgtctttgtggttcgtagagatatagtctacggtcggcgaacatcatacacgaggctgca

SEQ ID NO: 590421 - DNA, 749 bp, Homo sapiens
ccaacgtgcctggaagagttgagctcctgggaagagcatatgggaaggccaaaatgcgttgtgtgacaagaatggtgtcccccggttctatatccgcatcctggctgaacctagaggactatacttaatgagctattgggaagataaggaagggaagaatgaagatgaaaaatgaggaaatggccagggctctgatgcatcttgcgtgatgaagatcacggaaagtaaaagcgatgatatacagagtcaccagtatcacaaggctaaaatgagagaaggccacgagacagtctgctgggatgaagatgcatgagaaaaatgatggaggatatcagaatggcatcgttcgatcatgcagtgatgagtgatgagtgacgggaaataaaagatgatagagaaaatattcatattgaagaaagaaaatcaaggagagcataccatttctaggaggagaagccagcaaaagataaaacatcaacaaaacgatggtcatgaagaacgaaaagaagcgacaatcaagaaagaattccgaaggcactgaagtgacaaggaacatgggacacacaagagtacacacaaagtcacatgacgaggaaataccccagaagccatcacagatgaaagcgaacatgaccagcggaaacaagaacaccagacagccatggacctacagcaagcaattcccaggcaaacacaggcacccacaaccaaagacgactgaagagcgcaaaaaaggcaaagacacgaag

SEQ ID NO: 590422 - DNA, 214 bp, Homo sapiens
tcagacacattagctaccttagatggcggtgccacaaagactagtgcaagctctccagcgacctgaaggcgggccttggcaggagttcagcagcatatggcagtactgcaggtccagccgacccaggcagtcacggtaggcaccccgggtggcgagggagagctggccctcgtcactccgtgcccgctcgatcttgggccggaatattacgatg

SEQ ID NO: 590423 - DNA, 356 bp, Homo sapiens
  misc_feature (9)..(9): n is a, c, g, or t
  misc_feature (72)..(72): n is a, c, g, or t
  misc_feature (165)..(165): n is a, c, g, or t
  misc_feature (193)..(194): n is a, c, g, or t
  misc_feature (275)..(275): n is a, c, g, or t
  misc_feature (345)..(345): n is a, c, g, or t
cttttcttntttttttgagacagagtctcactctgttgcaaaggctggagtgcaatggcgtgatcttggttnactgcaacctccaccccctggattcaagcaattgtcgtgcctcagcctcctgagtagctgggattatagctacgaccaccgtgcccagctaanttttgtatttttagtaaagatggtgttnnactacgttggccaggctggtctcgaactcctgacctcacgtgattggctgccttggcctcccaaagtgctgggattacagntgtgagccactgtgcccagaccagaacttattttcaatttaaacttccttgaagtcttggtactcatggntttaaaaaaaa

SEQ ID NO: 590424 - DNA, 639 bp, Homo sapiens
tgcagtggctcgtgctataattccagcacttgggaggctgaggcaggtggatcacctgaggtcaggagttgagtctagcctggccaacgtgctgaaaccccgtctgtactaaaaatacaaaaaaattagccaggcatggtggcaggcacctgtaatcccagctactcgggaggctgaggcaggagaatcacttgaacctgggaggtggaggttgcagtgagctgagatcatgccatgtgcatgcctggacaatgagagcataagtctgtctcaaaaaaaaaaaaagggggcttacccttataatccagatttcacctctaggattcctttaccccaaaaaaaaaaaagaagaaaaaaacaaaaaacttgtgggggggcgcgccgtgcggaccccgggaaaagaagtttcaaaaacaccttgcggtgggggggcgccgggaccccatagaggtgagacggcaccaacggggccaaaagcgggccccgagagagaaaccgggggcaggggccgtgtcgcgcttgttctcccacaaaaaaaaagagcgggggaacacggggggctggggaaccaaccccagggcgctgggagggacagaggcttacacacaggggccccaggacaaaaatgacgggggggga

SEQ ID NO: 590425 - DNA, 771 bp, Homo sapiens
gagtgcggggtcggccgggtgctagtgccgggggccgaggcctgaggccggggcgggatccagagcgggagccggctgcgggatcttgggactcggagcgggatccggagcgggacccaggagccaggcgcggggccatggcgaggcgcgggccagggtggcggcgcttctgctcgctcgtgctgctggcgggcgcggcgcagggcttggactctacttcacgccggggacaagacctgcatacctggcctctgcgcgggcggacgggctggctccgctgggggcgcaagacacatacccccggacctcaatgagtacctgtacaccagcggatcttgccaagagctgggacctgggacgcacatgtcggatggcgtgtcaacgtaatgacaggcatcaacccgggaacagcagcaacagtaccacccaataactcgcggcctccttgctagggcccaaggcccatgcacccaagcaggctactggccggcatccggattcaacgagtcaagaggaacgggaagccggtgggcccctccacagcgccgtccagatggtcccgggggcaaggacaaccgtacaatccggagttggaggaggaaaacggcattgggatcccgtcgtgcgaacacgggcgggctacagtcgaccatcgtaccaggcggtaggggaagaaagagcaggcaaccaagagccacggggaatcccacttggacggaggaaccatggcagcaggacgaaacaagaggccaaggagccaaggggaaaagg

SEQ ID NO: 590426 - DNA, 451 bp, Homo sapiens
agcctcccgagtagctgagactacaggcatgcaccaccatgcctggctaatttttgcatttttggtggagacagggtttcaccatgttggccaggctggcctgaactcctgaccttaagtgatccactcgcctaggccttccaaagtgctgggattacaggcgtgagccacctcacccagcctggagtgtctcatcttccaccactaaatgaaacgatggaccctgaacagaaaaaggaacagtggtggaagaactagcaaagcccacagccttgagtttggccgtaagtatcaaggttaatctctcagttatggcagttgtcccatgaccgtgtaagatgccaggttaggggacactgggaatagagcattgggaaaccttcccactgtctttgcaacttttctgtaagtttaaagttctcccataataaaaagctaacttgaatccaaa

SEQ ID NO: 590427 - DNA, 206 bp, Homo sapiens
tagtcttcattcttcagcccagccagccagcttccctctcggaccacagttagggcattagaatctccagcagacagctggtagtaggaggcttcaatgctctagtcctcagagagaggtgacaaacatttacaaatatctacacatgagatagcggggcccataggaaatcaacatgctgaatataagtaacagcaaggaaaaaa

SEQ ID NO: 590428 - DNA, 446 bp, Homo sapiens
tggctggttgtaatgcaaggaagggacaaagatgaaatggaaacatgttccttttttggtcatgatatcactcctcagcttatccccaaatcacctgtttctggcccagcttattccagggctcaagcctactaaagaaccaagaaaaattctgtaatacaataaaattcgtctccaccctttttaatggtttaaaggatcaattcttctccaagcccatcactgaccttcctgctgaacttcaactggatgcaaaacaaacccacaaattctattttagagaattatggaagtcaaatgacgtatgtattcaggtcacagaaaatgtatgatgcatggtgccatttaaaaaaatatttgctctgtgaagatctgctttctgcattatggaagaaaagcaattcatatttttcaacggcttgcattaaaatcctacactgtgtaaa

SEQ ID NO: 590429 - DNA, 223 bp, Homo sapiens
tgcatgcatcgggtactggaggataccatctaaagtcgaccaggctccagcttaacgatatatggaggtcagcacggtgctcacgtgtcgaccggaacttgtacagggaggccatgcaccgcagagatgaatacacgtcgaccaggctccagccaaacgagatcgggacgtcagcacggtgctcacgtatccccacaacttgtccacgaacgcctgcaccgca

SEQ ID NO: 590430 - DNA, 475 bp, Homo sapiens
cacagggtcttccttactctccctcattatatttgtatgtcctttctttggcatgagaaccttggcttccaaaaaaagccacacatttactcatttgctcaattctgtaacacatatcacatagtttcaggattgctttggtcagaccactaaagtggacaattgtttgctgtcctttcatccacatgcaccactttgccaagacagagggcctaagagtcaaatactatgttcaaaatttacttggattggtcctcccttctctccttcttatcattcatgtcttccttcttcattcctgtgctcatgtattcgtttgaaatctactgaggtttattgtttcaggttgtttttggttatagctccctctccttcacgttcttgtttaattttattttttaatatgtagaaggttaacttgctttcaaaaatcaaaattactcaaaaactcaactcccattttccttccaccctg

SEQ ID NO: 590431 - DNA, 145 bp, Homo sapiens
gagctcggtgatcacccacctccgctctcacagtgcgggattacaggcgtgagccaccgtgcctggccagcttttgtttttaaataaatttagtgtccatataagagtgattggggtaaatcctttattttcctagactataaaa

SEQ ID NO: 590432 - DNA, 799 bp, Homo sapiens
  misc_feature (425)..(425): n is a, c, g, or t
  misc_feature (447)..(447): n is a, c, g, or t
  misc_feature (714)..(714): n is a, c, g, or t
caggaggcagaggtagcagtgagctgagactgtgccactgcagtccagcctgggtgacagagccagacactgtctcggggaaaaaaaaaaaaaaaaaaaaaagacccttccttataaattggcaaaaaaaccaaatcttcataaccttcattaaattactatagggaattccccaaccaattaattatcgggggaccctgtggacagggttaattccttttctcatagggccaaggtatccttctcacttcccattgtggtctctggaccagtgggacgattggacggggaaaaagtgtgtattgtgggtgggtccaatttctaatgtggtgcacgagatatattatcaacaatattaagaatatcacacggggtatatctcacctgtggccccttggaacacggggtgtgttctatacacactntgtggcacgcgtatatcttganaggtgtgagatttcccccagacaatactcaaacaccctcagggggcacacaactttacagattatattattccagggcgtgtaaaatctccccaaaaaagagagagcgagaagaagaaagagagtgggagtggtggaatgtggtggtgagtgagtagtgtgagtgtgaggtgagtgagtatatgtgtggggggagaggttgtaggggtggagaaaaaatagtggttgggtaaaacacaaaacagagaaaaaatcacatataattatnttttcggggcggggggaggaaatactatatgtgggtacaacacaaagagcaaagtgggggggggaaataggataatattaaaaat

SEQ ID NO: 590433 - DNA, 204 bp, Homo sapiens
  misc_feature (125)..(125): n is a, c, g, or t
  misc_feature (133)..(133): n is a, c, g, or t
  misc_feature (198)..(198): n is a, c, g, or t
gccagctgtaaagcacataaggggaactttgtgatgcaaacacaagtatcaacagctgaattgatcaagcagaaaaaagaatatcagagcttgaagactgtcttgccaaaataaggcaggcaganaagattanagaaaaaaagaatgaaaaggaatgaacaaaacctcaaagaactgtggaactacgtaaaagaccanacccat

SEQ ID NO: 590434 - DNA, 250 bp, Homo sapiens
aattttttttggtttaccaagaagggaaacaaaaaaaaaaagggaggtggggtacctataagggccaaccaaaaaaaaaagaataaacctttgacctttggttccccacctaaaggaataacaagaatttcccaatttggggtttaagtaatttccccttccccaattttttggaagaatttaccaacatttcccggaaccatttctttttaaagtttttaacccggggtttttaaaaaaaaaggtttta

SEQ ID NO: 590435 - DNA, 487 bp, Homo sapiens
  misc_feature (15)..(15): n is a, c, g, or t
  misc_feature (47)..(47): n is a, c, g, or t
cccccccccttgggnaactttttttttaaacaagggggggcccccgnaaccagggtgttttcccttcccccttcccgggggggaatttcccaaaaacagggtcccccccccccggtggggaaggggtttttttccccccccctttccctgggggggggggggagtgggggggggggggaaaaattaaaaaccccccccccccggggggggtccgggggggcttttttttttttttaaaagctcccccggggcaaaaggggggggggggggggggggtttttttttttttcccttggggggggggggttggccccccccccccccgggggggggcttttctttttcccggggttttttgggggggggggggggggccccccccccccggggttttttggtttgccaggggggtttggggggggccccctttttttttttttccgggccccccgggggggttttgggcccccccccccccctgggggga

SEQ ID NO: 590436 - DNA, 152 bp, Homo sapiens
ctcgaggccaagcattctgatgttggagcggcctgagctggaattagaaccccagctgcatgcagtggctcatgcctgtaatcccagcactttgggaggccgaggtgggcggatcacctgaggtcaggagtttgagactaccctggccaaca

SEQ ID NO: 590437 - DNA, 123 bp, Homo sapiens
cgtcacctgtcctcaagctcctggatgtctgctgcatcttcttcttctccgcctgcaggtgtggagcgctcctcctcctcctccagcctggctctaggtcatggcagatctcttctaattcct

SEQ ID NO: 590438 - DNA, 237 bp, Homo sapiens
  misc_feature (116)..(116): n is a, c, g, or t
tgtggtccgaaagacaacaacatggacaagatgtcactggcagaagtacccaaccagagagatgtgtctggcaatgttcatgctggtgaacatgtgggaaaacacccaatgtccanaataatgtgcctcattggcttggaattcatatccaaaatgtattaatgcacctacttggatacacatgaacagtgctgaacttgcttgccctcagtggagctcagtccttgttgggcgtga

SEQ ID NO: 590439 - DNA, 614 bp, Homo sapiens
gacctgactctctgaggctcatttggcagttgttgaagatgtccccgcagttttcaatcatgtctgaaccaatcatgagctccttgtgactggagcagcgtggtccagattgcgatattcactgctgtacagtgattggagagatggatctgtctttggtaaaggatcagcctatagattcttgtgctgttggagtatcacccccatgatgggctgtcctggagcggtgtcctacatggaactgcaagactgtgcccttcccctcctgaaagatgtcatcgttagacagataacagaagacgtgtgccttctaagacctggatgtggccatgtctctggtgggctccatgccaagacagggcaaggcatggagagaaaagcatttactgaagagcaggatgtgacaaatcttcaaatcccagggtgcagccttagataaatacgccaagaagtcagtcaaggttattagtcggtgggtaatccaagcaatagcatctggctgactgcttgcaagtcatggtccatccatcccctaaggatgaacttcatgttgcttgacctcgttggatcacaagcgagctaaacgctcaaagttgctcttaaacttggtgtga

SEQ ID NO: 590440 - DNA, 363 bp, Homo sapiens
  misc_feature (363)..(363): n is a, c, g, or t
gtaatcttagccttccaaagtgatgggaatataggcctgagctactgcgcctgcacgatattcgttatcttactccattttaactaatatgcatgtgagcgagactagactttttatattcctaacattgtatttcatagaacagacgttataaatagctttcttttatgcatcatggatcatgctttatgatgccattttattgatgaaattgatactaatatttctagagacagggtctaacttagtgtccaatgtatggtgcacatggacaaacatggctgactacaagtctaatctactgggttcaatgattccttccatgctaacccatggtgctgggacttcaactgtggcaccatn

SEQ ID NO: 590441 - DNA, 175 bp, Homo sapiens
  misc_feature (15)..(15): n is a, c, g, or t
  misc_feature (96)..(96): n is a, c, g, or t
gggagctccaacttngcagccagagaaagccatgttggcagcttatcaggaggcatggtggtagactaccctaacagtgccaaagcaaagaaattntacctctgcttgttttctgggccttcgacctttataccagagggctgagtgaaaatcaggatgaagttgaacccaggcg

SEQ ID NO: 590442 - DNA, 137 bp, Homo sapiens
  misc_feature (109)..(109): n is a, c, g, or t
gttttgcggtgcctttcctgtagtcaaaacaaagattccagcaaagcgcaggtaaaattctctcctctcttaaaaaattgggccaggcacggtggctcacccctatcancacagcactttgggaggctgagttgggt

SEQ ID NO: 590443 - DNA, 971 bp, Homo sapiens
actgcgaagtatctcgctgaccctgcccgcccgactagcggagattgagtgcgagacgactgaggcggatagcgggtaaggatgcccagggcgcgctgcggagtggtctactgctgactgtccgtcaggactcgcctgtggcgtccctgctcgcctcccagtccacgaatatctcagggaatgaagtccatcgtggctcggtgacacttatgcatgaacaaatctgtagtcagccatggaggaaaacagctggatccatgactttaagtcccacgtgatgtgtctgaaacgacatagcattttagacaacaaccttcgcacgtgttgaccattgcctgtgcgatatccaagggctatctttgtgtgatagcttttgaggcgagaaaccggcaaggcgtttaatgacgaggacctactaatcgcatgactgatagctgggtcattcctggttcgggtgcctttccccccttgtggggaaaccttccattttcgccaattgaggaattccagggaaaacccttcatttccggacagtcacaggaaatgcataagtggttacgcagtccccgtttagattagattatacggatccaatagggaaaacggccagacataggggaagccgggcgtttggagaataacggcggaagagagaatccctcggatcaaagaagctttgtgtgaatcaccacgggcggtaacgtcgaggatggtaggagcctttaaattttaccgcgtaattctttggagacggccttttgttaaattataatccctcccgtgcataaaaaagggttgtcctctgcggactaaaacgcccaaaagaagtacgccggacccttcacgggtttgcgacgggctcaaccctttgggtactgggaaagaacgtgacccaagggaaggagtccttctgtccttcctggcatggaccaggtggggtcccttgtgtacccaatgccccgcaaagaagc

SEQ ID NO: 590444 - DNA, 628 bp, Homo sapiens
gacaatgtagtatataatacatataacatacgaaatacgtgttttagtttttgttttagttttttgagatggagtttcgctcttgttgcctgggctggggtgcaatggtgtgatctcagctcattgcagcctccgcctcctgagttcaagcgattctcctgcctcagcctcccaagtagctgggattacaggtgcccgccaccacacccagcaaattttttgtatttttattagagatgaggtttcattatggtggccaggctggtctcaaactcctgacctcaggtgatccactcgcctcggactcccaaagtgctgggattacaggcatgagctaccgcgcccagcccacaaaatatgtgttaatcaactgtttatgttatcaccaaggcttctggctagcagtaggctactagtagttgagtaaaggggagtcacaaagttatacatggatttatgactgtgcatagggcagtgacccaatcctgcattgttcagaggtcaatactgtgtgtgtgtgtagtgtgtagtgtgtgtgtagtgtgtagtgagcagacacgaaacgaatatagagcaaaggagagtgatgaaaaaataaaatatacaagggtagatctaataacgaaga

SEQ ID NO: 590445 - DNA, 291 bp, Homo sapiens
  misc_feature (1)..(1): n is a, c, g, or t
ntctcaacagttcggatccagatttcatgtatgaactggatagagagatgatctaccaacagaatccgtaggagacaacttgctttctttggagtgactgcaaaggacatctgaaaatctgggagtctttcacatgatgtccttggataatgcagggtgcttcaaccgtcaaacgtgggaacatgtgggatacagtactgtgaagacgctaagcgaaatatagccaaactaatgcatgctgtgatcatcgtggtggaacaaggagaatgtggaattacgttggggttcgtt

SEQ ID NO: 590446 - DNA, 118 bp, Homo sapiens
gtgggataatctattttaatgaaactcattatatatatatttacaaaaagaataaaggaaaaagactccctccaaaatagatatttctgcttaataaaaagtacaactgagcactgtg

SEQ ID NO: 590447 - DNA, 321 bp, Homo sapiens
  misc_feature (72)..(72): n is a, c, g, or t
  misc_feature (75)..(75): n is a, c, g, or t
cctgtttgcattacaccaaagtgtattttcaccagctaaaggaagcttttcttttttttattttctgtaganggnctcactctgttgcccaggctggagggcggtgttgtgatctcagctctctgcaacctccacctcccgggttcaagcaattcttgtgcctcagcctcccaagcagctgggattacaggcatgcgccaccacacccagctaatttttgtatttttagtagagatggggtttcaccatgttggtcaggctggtcttgaactcctgggttccagagacctgacctccagtgattcgcccacctcggcctcc

SEQ ID NO: 590448 - DNA, 624 bp, Homo sapiens
  misc_feature (450)..(450): n is a, c, g, or t
cggctccttttcctccccggagttcatccgccacccccgggtttctgatgacatctttgaggggaaaccacaagtcccccctggttcctgtcccccggtcacaacccccctttttgtttattgccccgcccgccccgcggttcttgggtgtctctcccccggcggcaaatttgggaatactggtggcccccctcgaggtgggcaccactactccagacgattctccacgcccgaagttcttcgccgcggtatcaatgcccttcttccccccatcgcgccccctctttaaattatggcagggggccacccttcgacgacaactggcgggccgccagcgcagcataatgatgaggccctggtaacgaggatgttctctatcctgagtgagcgcgtggctttgtgtgccgtcccgctcgatctcctgtctgctcttctcactctcgtgagcgnctcatcagctcccgatagaacgatgctcctatgtcttgagtaggatagcgagcgcgcccgagagggcgcctctcggtgtgcgaaagaaatacttcttcttctcttgaccccaccatctcatagggttctcccacaaaaaaatgtcactccccccgccacaaatgacaaaaaaca

SEQ ID NO: 590449 - DNA, 150 bp, Homo sapiens
ggccaccttactaccagacaaccttagccaaaccatttaccaattaaggtttaggcgatagacattgacacctggcgcattagttttggtcccgcaggggaaggttgaaaaattttacccaagttaatttgggcgggctctaccctatat

SEQ ID NO: 590450 - DNA, 410 bp, Homo sapiens
ctagatgatcccctgcttgtcctgcctcgggttggagcgattctcctgcctcagtcctactgagtggccaggattacacggtgtccatcgccacgcccggctaattttttatattttcagcagagatagggtttcgctatgttggccaggctggtcttgaactcgtcctcatgtgaaccacctggcgtcagcctcccaaagtgctgggatcacaggcgtgagccaccacaactggccacactttgaatggatcttttagatgtgtctgatttcataaccacatacatcgatcatttcgaaaatattgtttcaccaagttatgcacgtcttccaagtgttgacacccttcattatataatatcctaaaaaaagcacatttgttttctgacctcatcagaaaagtccttaga

SEQ ID NO: 590451 - DNA, 969 bp, Homo sapiens
gcacctttcctcgaccctggacgtctaacttccggaggcccacatcttgcccactccgtcgcgccgtggctatgctgcgggatttcagcagatcgggagccctcaatggacatggcaactacaggcgtgcggccggtcggtgcggtcgcccgaaatggagctggtcccggatatggggagggttcgaagaaaacatccagggcgagcaggcttcatactgtgattgacatggagaactatgtgatgataccatcagagctcttagcgtacgaggatatgggtgagctggcgatcagcgccgtgcgcgaggaagaagttcacggcatgtatgccagcatgatgctagcatgcttgctgaagagcgaggatggagaagttccttgcgcatcgcatcgggctttaagggacagctgagccgggcgagtgtgggtagagatcatgaatgtggctatggcctggggaaaagggacaatcactccaaggggtccattcagacgtgtgtaatcgcctctaacaatcgaagctatcccatcaatgaccctcttatctttcgattgtgggacagccgtgcatcagagtgctgaaacgcgagtgggtccttgggaggtccactagatcgccctatccaaggatggtcatcgttccccccaggaaaaattcgcacggtgaaactcctaatggacctctcgatgcttgttctttcactctgggttgctattcctagctccattgggatggaaggacgtcatgacactattatccgggagggcaccctgatgggcacaagccaattggacacctgcttcggctactggctggaagtctcatccttcattacttctttgctttcctggcaacgccagttccctgcgaatgtgtgcagctggctttgctcttggcgattgttgctgtcttcctttgttccgtcccgcctcttacctctgttgggggtcccgcctgcacgtcgtc

SEQ ID NO: 590452 - DNA, 170 bp, Homo sapiens
  misc_feature (103)..(103): n is a, c, g, or t
  misc_feature (132)..(132): n is a, c, g, or t
  misc_feature (143)..(143): n is a, c, g, or t
ccaggcctgaggaaggcctcgggcgcgcggaacagacgggcaggcggggggcgcacaagcccagggcacgatggcagcagcgctggattccgtctgggcgctnctcggccccgtatccgtccgtgaggccgncgctgccaggnctagaggagacatgttgagaccgtgcg

SEQ ID NO: 590453 - DNA, 409 bp, Homo sapiens
gtggtgactctgaggatcccgagtgcaggtgcgtcgtccactgagctgtcttacgtctagatgtatagacgcatggggtcagctctctaggtttccttggaggagcaggaggacttccttatcagacagcctgacttcggttgcagagcgcatgcattttgaccacagtgtttcagctcttcccttttctcttgttccatttaggtggcttcccacacttctgactcggacgttccttccggtgtcactgaggtggtcgtgacgctctttgactctgatcccatcactgtgacggtccctgtagaagtctccaggaagaaccctaaatttatggagaccgtggcggagatgggcgccgcgaggcgtccagtgcggtaacgcacctgcaacgcacctgcactgggtaccg

SEQ ID NO: 590454 - DNA, 128 bp, Homo sapiens
cccgaccatgcctgcaccagcagcgtctgatatttgccggcaaacagctgtaggatggccgcactctctcagactacaacgagtgccagaaagagtccaccctgcacctggcgttgcgcctgcgaggt

SEQ ID NO: 590455 - DNA, 371 bp, Homo sapiens
aaaaaaaaaaaagatgaaaaaagttcctgtggatgttttgtgtagtatcttggcatttgtattgatagttaaaattcacttccaaatcaaataaaacccatgtgctagatttgatgtgtgcccaatcaaccttgttcaaattgggcacacatcaaatctagcatcatgggtgttttatttgatgtgtgcccaatttgaacaagggttgattgacacctgtaaaatttgttgaaacgttcctcttaaaaggaaatatagtaatcttatgtatttttttttgtgaagtgtttttctagcatttataagtgaaagctggcaggggtggtagttgggctcataatttattaaagtggtaatttagcaaaaaaaaa

SEQ ID NO: 590456 - DNA, 150 bp, Homo sapiens
cggcacacttgtcaattctacacacacacaaaaccctgttggcacttgattgagattgcattgaatttatataaactgttggggattgacatcttaataatattgagtcttctggcctataacaggtctgtcttcctaggattatgtttg

SEQ ID NO: 590457 - DNA, 878 bp, Homo sapiens
ggttccagtgccagaccaaggagaactattggcaagtggcggggaggacctagagaccagcgaagggagaagttgggaagctacgttctgttggccaccagacttgcatttcagcctctgtcataatgctctgccctccctcccccgaaggtctctgctggatgatgaccgttctcccctgtcccctccccgcttcctgacctctgatgaggttgggaagtgaccatttgtatgtctgggccctgccaaggccgtactgggtagtggtcagagggaggccgggctgcattcctgcacccgcatcgctttccccctgggtcatgctgtgctgcgttttgtgccgtacggttcagccaagtcccccctgcttgtgttccatgtgcttgcgacctctgtctcatctttcctcccgttcctctgtccccgtctcctctcccactgtacttggggacgtcagttcaggagtatggggccccttctctgtgagtccaggcgtgtccctgtctctcccttactgtcccttcagcctgggctgatcagttgcccgcctctgtggcttgatgcggttccccatgctctgtcctctgtcccccgaacgtgtctctatgcgtcaatttgggcttgcttccaggctcccaggtttgtctgctcgagtctcgttaaccaaaccgagtggcgtcttaccgatactaacggccgagtgcagtccgacgacctgagtcgccctaggtcagaactctggggaaggatacaggagccccgacccttcacttgagttctctggattggttctcagtgccttaaaaggaaacccggtgcttgtgtgtgttgtgggcgggaaggaaggaccctgggtcccagccctctttttccttccc

SEQ ID NO: 590458 - DNA, 816 bp, Homo sapiens
  misc_feature (188)..(188): n is a, c, g, or t
  misc_feature (307)..(307): n is a, c, g, or t
  misc_feature (394)..(394): n is a, c, g, or t
  misc_feature (582)..(582): n is a, c, g, or t
  misc_feature (660)..(660): n is a, c, g, or t
  misc_feature (701)..(701): n is a, c, g, or t
ggtggaatgggtggttcaagaaaatgcgagactgagagtgagtggtgagatcagcatgattatgatgtgagtaagattgtagaataatttgaacctaaggaggtgaaacactcaagagaaaaattgtggactctcgcacggtggaacctgctctcacaaaggttgatcttgcatgaacctgtgttccnggcgagtgtagaaagcagagcctactgtatggaacctctggagaatcatggtgcatcgcacatcggactccgagtgcttcacgagtcgatcagccatcgggtagactgcctgcatcggnagagatctatatcgcctccaagtgctcgcacttgtcggcccaggcgcatgtattggtctcccatgagcactatccgcaatagggacntcctaggcagggcgactagcgaaggcccaattgcgaagtcgacctagggagaaagaggccaaatgcctaggtcgccattcgctagtcccaacttggaaatcgggagaggccgacgtggacgtcattcaagtccccacgggcattgctccgaacccgatagagatacgcgcactcattgtcgagacctntgtgggcaccatctcttctagtcgacattgcacttggggcgcttccgttgagaccggggaccaactagcgcccaaacntccaaacgcgcaaacgaaccgttgagcgtgcgcgattcganggtcgttcgctattgctccttgaaagcgtgagtcccccaatggcgggctctcgagctccgtttgggcaccccccccggtttaggaaatccaatttcccctcaacgacggatctca

SEQ ID NO: 590459 - DNA, 922 bp, Homo sapiens
  misc_feature (4)..(4): n is a, c, g, or t
  misc_feature (80)..(80): n is a, c, g, or t
  misc_feature (83)..(83): n is a, c, g, or t
  misc_feature (115)..(115): n is a, c, g, or t
  misc_feature (120)..(120): n is a, c, g, or t
  misc_feature (256)..(256): n is a, c, g, or t
  misc_feature (271)..(271): n is a, c, g, or t
  misc_feature (290)..(290): n is a, c, g, or t
  misc_feature (296)..(296): n is a, c, g, or t
  misc_feature (322)..(322): n is a, c, g, or t
  misc_feature (725)..(725): n is a, c, g, or t
  misc_feature (732)..(732): n is a, c, g, or t
  misc_feature (737)..(737): n is a, c, g, or t
  misc_feature (739)..(739): n is a, c, g, or t
  misc_feature (742)..(742): n is a, c, g, or t
  misc_feature (750)..(750): n is a, c, g, or t
  misc_feature (757)..(757): n is a, c, g, or t
  misc_feature (780)..(780): n is a, c, g, or t
  misc_feature (798)..(798): n is a, c, g, or t
  misc_feature (810)..(810): n is a, c, g, or t
  misc_feature (823)..(823): n is a, c, g, or t
  misc_feature (842)..(842): n is a, c, g, or t
  misc_feature (870)..(870): n is a, c, g, or t
tttnccctgtcccacgatttggctattgtattgagctgctgacccttcttctttgtcccaggtgggtcttgggtgcctcnacnctccctcctcacctggctatgaaatatttcanccaanggggttttgcatttttggggagagtccccttagcgcagctccctgctttagatgctgtgtagggccatagcattgtccacagctccccaagctgggtggcttctccccgctgaattggggcctgcaggcaggtgcnccaggctgctagcanccttgggccactctgtttnctcgcncccccagcagctggggcatgggtaanttagcgctttgcgcgcgcatgttaatttattgcagttttttcaagggtcaactgaattgcgcgccacttcgctgggtaagaagcatgatgctgcgcttttaatttcagcgtgctaagatgcgctggcagcttgcccctagctggttgcctgctgtagtgcgctgctgggagctgtcagctcatttaaatgtgggtctgcagaaggctttaggtctgcgccccaacccccttacctttcacagaggaacctttcatcaggataaatgattattgctgccctgtgggtcttgctcaatactgttcatacctggagagagaaggtattgaaacatctcgctttatgtgtgactttcccaaatttttaaaaattgtttatggtttaggccccttaaatactgtgtancaggatnaagtntnccnttaccagntgggtcnccttggatgggtctgtcaacatntaagcctcagttccctcncctgtaaaaatnagggtagtccctncctcataagggatattgtnaggatggaaagcgaaagtgtgagaaatncctcccaatgcctgtacatagtgggtgctaaataaacccctttttgtttgca

SEQ ID NO: 590460 - DNA, 233 bp, Homo sapiens
gtttagcttagagcatgttctaacccaatgcaaggaagctaagaaccttgtaaaaaaggtagaggaattgctaactagaataaccagtttagagaagaacataaattaccctattggagcttaaacacgcagcatgagaacttcgtgaagcatacacaaagtatcaatagccaaatccatcaagtggaagaaaggtattatatatggaggtcacccaatgaataaatgtgaag

SEQ ID NO: 590461 - DNA, 107 bp, Homo sapiens
taagggttttttggctgtaagtttttttaatggcaaagaattcttttccatttttcttgggggggtttcccctttcccgacccaattccccttttaactgggattcg

SEQ ID NO: 590462 - DNA, 956 bp, Homo sapiens
cggtgacggggtcaccacattgtgcccatctacgaggggtatgccctcccccatgccatcctgcgtctggacctggttggccggggacctgactgattaactcatgaagatcctccaccgaggcgcggatacggttcaccaccacggctgagcgggaaatcgtgctgtgacaattccatggagaacggctgtgatattgtcgcccctgggactttcgacgcaagagattggccacggtgtgcttccagcctccttcccgtggagaaaggagtctacgagcttgcttgagggcgaggtcactcaccatttgggcaatgcagcggttccgctgccctgaggccacctcttcccagccctttcctttccgtgggggcattggaggttcctgtgggcatccacgaaaagctactcgtttcacgctccatcagtgaactgttgtgccgtgttgcaccctcccgccaaggacgtgtacgcgccaaccacagtggctggtctggcggggaccacatattgtacccttggcattggctgaacgggggtatggccagacatggagatcacggccgtggacccagaacaacatgaagactcaccgatcatttgtccttcatgagcgcatgtcacccggtgggctcgggcggcaccaatgcgggccacgatggtccacttccagcagaatgtgcatcagcaggcaggagtatggagaggcagggccctcaatcgtcaccgcaagtggcctccagcggaccaagactagcgtgggtcaccctttggccaaacctacggggcggaaccagagacagcgcggcccatgggacatggcggcggacgcgcaggcgcagggtcacacggacggcggcgacacgtgggggaaccagaaaggggcgagaaggcagtggttacgccacagagcgggagcgacaacgccttgaagcccacaggacgcgcaaaaactc

SEQ ID NO: 590463 - DNA, 1098 bp, Homo sapiens
tttaaaaggaaaaaaaaaaaaaaaaacaaacccacatgatttcaagggagtctgggcatccctgaaatccttctcccctgccaggtgcctgtcacctgtcttcactgcctcctttcccctgtcatgctcatcagcttatggcttctgtctaagcacctgaacagaggactgaaacctccactgcaggctgggtttaaggtcttgaatcatgtaagaatcttgcacagcactgctaatgtaaattccagtttgttttcccctctaggacaaacatttaccaaaattatgcaacttttttgggtggggacagagagattgtcctgtgatttctacccatttccctgaggcctgtggaaataaccctttattgtccttaaagttataccagaaaatacgaataacggttaataccaaatcttgaacacaacaaacacacacaacacacacaaaaaaaaaaacacaaaaacaaaaaaacaacaaaaaaagggggggccgccgccacaaaaaaacaccccccccgagggcgccccacaaacttcagccacccacccacatattctgtaaacaaagggggccccccaaaggagaggggcccaaaacaaaacacgcacaggcaaggaggcccgcccgaaaaaacaaccacccggcagatgagaacaaaacctgtacacggtgacaacccttgggaaaagaagcccccacccactctgcgcgggcgggacccaccacaatgttgggcgcaccacatcccctccacaaaatatatatccaccacctccaggacgacaaaacacacacacctcccggcgcctctatcactggcgcctacaccaccccagcacatatgccctcgccagtccaaaaaacctgtgccaccaccgccggactacatatcctgaacaaccactatttatacccacgatacttgtctctatcaaacaaaacccgtaccatcaactcaactccaatcccacccacccaaccacccaactcaccacacccacatccctcaacctcatcccaactccactaactcatcacctccctcaactaccacccctacaactcacacactcctcccacactcaacccacacac

SEQ ID NO: 590464 - DNA, 898 bp, Homo sapiens
agcggatctttgatgagggcagagctcacgttgcattgaagactaaacctcggtgaggctcgaggcgctgtctgtatccttccgctccctgctcggcggatccagccatcgagttgcaagatgcagaggcccggtagaacgacaagcctcccgaaaagcccaggtcagagagccaaagccgtcacgtgacgcctccaagacccaggctgcccgagtcgactctccgcgagacgctagccaatgtgccgcaaagacggcaggacagatgcgtcgaattgacgctgggaggaagcactgcagtcgtagagcgcgcctgagagccagcctcggagctagtgatgcagatgcggctgtgcagaagagcacacctgtgcgtagatgctgacgaaactgaggttggcaaagaacgcagctaaatgagaatgccatgggtgattcacgcggacattgtggttctacttggttgggccctgaaaagcaaggtagatacaaagcttggacatcggcacttagagggcaaggggcagtgcgtatcctaacagtctaacctcaacgtgaccactgtaaagacgcaaagctaggagacatagcgaagtctttgactgggagccgtcaggaacagaattctggcgaggctgtatagatagtgtggtccgcttgtaacaaagctttgcaatccaacgtagatgctttaacaattccatagccttggggcatgatagtcaaggaacgcgacgttgtgtggtccaatgccaagaccctggacttcgatgttagatgcgcacagaaccgagtgatgcacgatgcgccatacagtggcaaggcattcatgcctgcagggttatacaaatttgatttgcctcgaagaaaaacttgaacatgggagtggaaaacacct

SEQ ID NO: 590465 - DNA, 943 bp, Homo sapiens
gcagaggtggcggcggcggatgggtgccccgaacgttggcccctgcctgggagccctttctcaatggaccaccgctatctctacattcaacgaactggtccttcttgcgagggctgcaggcgctgcatccccggagtcggatgggcgaggactggcttcatccactgcctccaactgagaacgagccagacttgcgcccaggtgtttgcttctggcttgcacggagctggcagggctgggagccaagatgacgatcccatagaggaacataagaagcgatgcgtccggtgtgcgctttcctttctgtcaagaacgcagttgggaagaattgagcccttggtgaattgcttggaaactggacagcatgaaagatgccaggacacaaaattgcatgggggaaaccaataactaacgaacgaaaagaaatttagaggaaagctgcgaaagaaatgttgcgccgctgccatcgagcagttggtctgacatggattgaggcctctggccggagctgcctggtcccagagtgggtgagccagcttacccagggtttattccctggtgccaccatgctcttcctgtgggccccttaatcaatgtcttaggaagaggagatcaacacttttcaaatttagatgttttcaagctgtgctcttggttgggtcttgaaagtggcaccagaggtgcttcttgcctgtgcagtggggtgctgctggtaacgagtggctgttcttctctctctctctctttatgggggcctcatttgtgctgttttgattccgggcttaccaggtgacacgtgcggggcgaccagcgggtgccctttggaaagtgacggttggtcggtggcgcagccttccactgagtgggctggccctgtttacgggacacctgatggctctgaggccggacgaggggcctctggccggccccaaagggggggttc

SEQ ID NO: 590466 - DNA, 270 bp, Homo sapiens
tgcttacttacagtgtggggactgtgatgagcggccctggtccagaactctaccagcgccgaggtgttcaaggatcctgaggaagcccatgagtgttgagatgaacgtgaatgtgctggactttgtagcactttctgcccatgtctgcatactgtgtgcccaagaacaaggtaccaggtgacgctatgaggattatgtcgaaggacttcgggtgtttgacaaggaaggaaatggcaccgtcatgggtgctgaaatccggcatgttcttgt

SEQ ID NO: 590467 - DNA, 743 bp, Homo sapiens
  misc_feature (1)..(1): n is a, c, g, or t
  misc_feature (94)..(95): n is a, c, g, or t
  misc_feature (98)..(98): n is a, c, g, or t
  misc_feature (134)..(134): n is a, c, g, or t
  misc_feature (143)..(143): n is a, c, g, or t
  misc_feature (146)..(146): n is a, c, g, or t
  misc_feature (148)..(148): n is a, c, g, or t
  misc_feature (152)..(156): n is a, c, g, or t
  misc_feature (159)..(159): n is a, c, g, or t
  misc_feature (161)..(166): n is a, c, g, or t
  misc_feature (168)..(169): n is a, c, g, or t
  misc_feature (179)..(179): n is a, c, g, or t
  misc_feature (185)..(185): n is a, c, g, or t
  misc_feature (187)..(187): n is a, c, g, or t
  misc_feature (190)..(190): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (203)..(203): n is a, c, g, or t
  misc_feature (212)..(212): n is a, c, g, or t
  misc_feature (217)..(217): n is a, c, g, or t
  misc_feature (242)..(244): n is a, c, g, or t
  misc_feature (249)..(249): n is a, c, g, or t
  misc_feature (253)..(253): n is a, c, g, or t
  misc_feature (268)..(268): n is a, c, g, or t
  misc_feature (272)..(272): n is a, c, g, or t
  misc_feature (302)..(302): n is a, c, g, or t
  misc_feature (313)..(313): n is a, c, g, or t
  misc_feature (317)..(317): n is a, c, g, or t
  misc_feature (326)..(326): n is a, c, g, or t
  misc_feature (331)..(331): n is a, c, g, or t
  misc_feature (339)..(339): n is a, c, g, or t
  misc_feature (344)..(344): n is a, c, g, or t
  misc_feature (355)..(355): n is a, c, g, or t
  misc_feature (359)..(360): n is a, c, g, or t
  misc_feature (370)..(370): n is a, c, g, or t
  misc_feature (383)..(383): n is a, c, g, or t
  misc_feature (401)..(401): n is a, c, g, or t
  misc_feature (419)..(419): n is a, c, g, or t
  misc_feature (465)..(465): n is a, c, g, or t
  misc_feature (472)..(472): n is a, c, g, or t
  misc_feature (490)..(490): n is a, c, g, or t
  misc_feature (499)..(499): n is a, c, g, or t
  misc_feature (550)..(550): n is a, c, g, or t
  misc_feature (610)..(610): n is a, c, g, or t
  misc_feature (638)..(638): n is a, c, g, or t
  misc_feature (653)..(653): n is a, c, g, or t
  misc_feature (683)..(683): n is a, c, g, or t
nagggggcgccgagcgatggcagcagcgggcggcccgcgtagacctcgggcgctggggcctctgcgggggcagccggggacagcgaggccgggnngtnggagggtcccagctggcgcaggcaggctgccaggtngcccagcangtngnatcnnnnnttngnnnnnntnntctcgcagcnggccangnatntntttatnttntntatatattntttgnatctggcgcggtattttctcagaannntgggntttnttctgatcgcggccnttancttcacgctacgcaggctccgcagtttttnatggtcatctncatntttttcgcnttctncagcttcnatttnttgtactcttntggnngggatatgtnggatgtccaggtnagctgctacccagactcngggtctcgggccttcgcncccgacttacctcttttcttagggcgtccaggatgagggtttttancttagcnatagctctcgttatatangcactcggngccgcttctccatgaccggcttggaggactgcgggtcgggcaccggctgantcccgcgtccctcccgccccccggtcgcccccctcacgcccggacgggaccccaccttgnagtgctcggccgcgctccggggcttgtntggagtccggctggngctggccggcgctcctgccatcggcgaggngctcggtttccccggcgtgtctgcggccatggtgcgcccgcgcctccccgtgccgggtgg

SEQ ID NO: 590468 - DNA, 150 bp, Homo sapiens
cctaacaggctgagtctagtatataatctactgccatccatagggatatgtacaatggactcgggtacggcatatcgtagtttttgtacagcggcggttgacgacatgatgtgatgaccgcgctattgactaccgatcagctcgctcatc

SEQ ID NO: 590469 - DNA, 80 bp, Homo sapiens
ccactaacataaatgcccaagacgggaaaatttttctcttcttaccctttactcccagggtacccttctgtcgtcttctc

SEQ ID NO: 590470 - DNA, 297 bp, Homo sapiens
gcaggcttgactctatagcatcactaggctcgtggaacaatgggacaatgtaatgagctgaatgcccactggttgtgacctggacaaacccttcacgtgaggctatatgatcaaacagcaaactgtttatcataaatgcagaatgtgggcaaactcacttctgcttcagccgccagaaggttcgctgagggcaatcactccctggcgccatgctctttgaggttatctactgagacatctagagcctactgttcaaagaatgcaatcttgtgagcctgctgtgaatcaagctgctga

SEQ ID NO: 590471 - DNA, 137 bp, Homo sapiens
cccttttaaaaaaaccccttgggaaattttttgcctgggggtttttaaaaaaccaagggttttttttttttggccgcccaatccttttcccccctttataaaaaaattccccccaggcctttttgggggaaagtcca

SEQ ID NO: 590472 - DNA, 303 bp, Homo sapiens
ccatatgacatggtgcctcccattaccttcctccatgagtaaacgctttttgaggccctccccagaagcagatggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcaccccctttcaaaattcctttagttatccccattttccccccctgatattagaaaaaagagagtaataaacatttctgaaccgaata

SEQ ID NO: 590473 - DNA, 1080 bp, Homo sapiens
cgactctggaggaagactggagcctgtggcgcgggtgcatggcccgtcccctggttccccggcggagctcggagggcgcggactggtgctgcgggggccccgggaggtcgaaaagtaagcatggggaagagctgcaaggtggtcagtgtgtggcctaggcgtcatagtgggccaaaacattcaattcgctggcagcaagcttgtctagtaatggggaactcaatgtaagtggggttcgggagcatgatcagagacgcatggaggacatctacggatggtgcgtcgctcattgaagacgagtacacaggagtggagttgctggagatagctgggatagctgttttcttcatagacactcgctggggggggaatcctggacgtatgtgggcccggaaactgcaccacggacaacgttgccatttcatctttttgactgacttggttattgagccttgacggctctccttggggatcccttaatttagaccgaccaaagccattaaagccaaggagaggcaagttccatcctttactcctaaagactggatagttggggaaagccctggtccttcggatcacgtgaaacagggcgaacgccaatgttggaaccaataggactttcacaaacaatggggaccccataggcaaaggagtaacggtgtttgctacctcggattacctgattggcggtttgccccctatgggtgactaaaccccattaaaggatggatcggtaaccttaattaagccaaaggggggaaaggtcctaatggggaaggttgcctcggatttgggttaaaggaaagctacgaccaaccggtaaagtatgggtagggggcacttaccggaatggttccaacccctttgggggaggaccggcctaacattggttttcccaccgcgcaacaggaactaacgccggtttcgggaaaagaaaggcctattcggattttggccgtggaaacgcgcgggatacggctaacaaatcggattgggcgggtcaagtgggaaaccttcttggaggccccagtgtccatttccatccttcatttccgaccattaggtgtggatttgttcccg

SEQ ID NO: 590474 - DNA, 343 bp, Homo sapiens
tccgtcaatcacctgacaccctcactcctcatcctggacaccctcactcaacctggacaccctcactcctcaccctgacaccctcactcctcagcctggataccctcactcagccgaggatagccgtcactcctcatgcctggatacctccatctgcacgcatgtagaccctcactcaccctggacgcgttcactcaccctgacgccctcactcaccctggacgaccctcactcaccctggataccctcactcctcatcctggacaccctcactcaccctggataccctcactcctcaccctggacactctcactcaccctgataccctcaatcctcaccctg

SEQ ID NO: 590475 - DNA, 178 bp, Homo sapiens
actgcgaaccggttcttgctgcatcataacatggtgaaaggcaaagaggatgagagaaagacaaagatggggccagactcattcttttatttttttggtttttttggaaatggaatcacactctataagccgggttgaagtgcagctgaccacaaattcggttcattgaaaccttgtg

SEQ ID NO: 590476 - DNA, 512 bp, Homo sapiens
  misc_feature (248)..(248): n is a, c, g, or t
  misc_feature (353)..(353): n is a, c, g, or t
  misc_feature (460)..(460): n is a, c, g, or t
  misc_feature (465)..(465): n is a, c, g, or t
caatatgctgaaaaactactcttcttcttagtcatgttttcacctgaagtttgtgacacaggttgtttaattttctgtatatatatccaatattatagtatgatagactttactttccataaaccttgccttgcagctaactttactggaatgcatttattctgtgaagttgaaaatatcctattgaaaaatgcagctctctgccatgcattgaggaattcgaaagctgtgacagaaaattgtgccanggcataggaatcacagttatgaaacgtcagcagggagctaggagtcaccctttcccactgagactcgggctgcagctgccacgtggcgggcttatgctccggagncccatcaggcccagcgtgactaggttggcctccctagcaggaaagttgcccagttagtgacagagtcgttgtcctctcctgctatgcctggacccctcgtcttcggnttcanccctgcccgttattggtcaggacaggcgccagtgttctcacctgctc

SEQ ID NO: 590477 - DNA, 127 bp, Homo sapiens
tgtaggtcaggtcagctcggctgtcttccccaggagcgtgctcagcgactctgtgggtaccttcatgctccactgtcagcccagtcaggccagtgaagcctatcagtgccctgcagagaatgggtcc

SEQ ID NO: 590478 - DNA, 600 bp, Homo sapiens
gtggttttaacagcaggccccggggtcgcgtctacaggtcaggatagatgggctgctcctctttcccccaccttccgtgagccacgagtgctaactcctttatggtctgaggaacactgcttcacgcacccctatccgtggtcattcagaactgtgactcatgcctgtgcaggttgatgccagaagatgcataccagaccacacaagccccctgataatctttactgccagaagaagagctgataggggccgcatccctgctttagtgcaaatacgctaccgcgaccacacttttattgcttgcgagatgttggcattcgcatgtgaaagcagacaatactgggcagaacagggtctcaaggcagtgaaagcactggtctgacattggttacatctttcggagctagggaaggattgataactgatcctaccgttgaggaataccacaagctagctattggatactcatctcagccttcgtggatgacttcgggatacttatgctttatacgtgccacgcatgcgctgataacttttcactggacccattgcggttctgcaggatgatgcatggtacactggtgactctacatttaatgg

SEQ ID NO: 590479 - DNA, 993 bp, Homo sapiens
gaataggacggtgcccttctgcggcacttttgcggccttcttcacgcgggcctttgaccagattcgcatggccgccatctccgagagcaacatcaacctctgcggactcccactgcggcgttgtccatcggggaagacgggccctcccagatggccctagaagatctggctatgtacggtcagtccccacatcaatttgtcttttacccaagtgatggcgtgctaccgagaaggcagtggaactagccgacaatacaaagggtatctgcttcataccggaacagccgcccagaaaatgccatcatctataacaacaatgaggacttccaggtcggacaagccaaggtggtcctgaacgagacacggaatgaccaggtgaccgtaatcggggctggggtgacccagcacgaggacattcggccgctgaccgaactgctgaagaaagacaagatcacatccgagtgctggaaccctaaccaccatacaagccctggacagaaaactcatcactcgacagcgctcgtgccaacaagggcaggaacctcaacgggcggaccatcatatatgaaggtggcatgggaggctggttccagatgcagtaggagggcgagacctggcatcacgtcaaccaacagggcagtcaccgggaaaacaagacggtgggagcagagcgagcgcgaaagttggtatcgacagggcatgcccctgcacgagccgtcgaggggccctcacccaaaggccctagggcgggaatgaacaggggacgccaaaccaacatcacggagatccgggcacggggcacacgacatcagccgcgcgaacactataatggacaccaaacgacccaaaaacgcgtgcagacaccatccagaccaaaagcgaagacgaggcgcataaagaacacaagaaacaacacagccacacgtcacagaataacaaaagagacacgccgagaaccagagaccgcaaagagaaaagacgagacaaaagcga

SEQ ID NO: 590480 - DNA, 151 bp, Homo sapiens
cgtaaatcccgatgtggatgttgccgaagttggcagttgccaacacattatctggagcagcagtggctgtcagagggagggggtccggaggacgtaaaaggcgcggaggggtcgcggtaggtgtgggagggggagcggttgcccgcggccg

SEQ ID NO: 590481 - DNA, 161 bp, Homo sapiens
ctctacacaacatgattttggtcgaccagatggaccctactttcttggccctcccctcgttgcttgattgaggttctggacgagcgattacccccccggttttgccgctgacggacccaaccttcgattactaccctccctgatggtggttgggcgtttcc

SEQ ID NO: 590482 - DNA, 991 bp, Homo sapiens
ccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttcttgtgctgcaaggatgcctgctcattgacacgacggtagagactggacacgacttttgatgcaaatactcgaacgaaccacgaccacgaccgaccacacgacaacgatgcagacggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagcttccccgatgattatgatactcgtgcttctgagcctgggaagaacgagggtcagatgggcagacctggagggagaagacaggatgccgataggcaaacgggcataggttttgtgggtcggacagcattgatggggagaacgatcacctcgctgacacgtgggtcaacttggttgaaaaaagccctcaatcgaaccaaattttttttgacactcaggtttggaacggagcattattcctctcaagagtggtacgctcagacagggcctgaaagcaagcctcgcggacactcctggttttgcccgtgtgtcccagattcacagccagtagtaaggacaacgcgtcagcgcattaaaaaggtaccagggtccccaagatatcacatcgtgtgcccagcaaagaagtacttaacagcgtgagaggaacagagagagacaactgcgacacaagcgtgagggaggcctaaaaaacactactcaggcgccagcacaacacacgaggggtggagagaacagaggagagacaactcctcaacaatctctccctg

SEQ ID NO: 590483 - DNA, 320 bp, Homo sapiens
ggaccggcatcagaggaatataaagcaagggtggtgaatattatgcatattttctttttcattttttatttttttggagagatgagatctggtaatggtggcccagcacgggaaggcaggggctaatccacagggtgccatcagtaatacactaacagccttgcaacttctggggctcaaggtggctcttccgggccttcagccgttctgagctagcgtggaacttatagggtgcactttgactatattcgtgactggcttgtgttgcagatttgggcgtgcccaatctccataactctcctttccatacttagaaattc

SEQ ID NO: 590484 - DNA, 106 bp, Homo sapiens
tgcgaagatcacctcagatcccgtcatcgtgcgaacgatcacctagatcaccctctcgtgcaggtacgacggcttcctagaagtgtgaaaaccgtaggcttggatt

SEQ ID NO: 590485 - DNA, 176 bp, Homo sapiens
  misc_feature (105)..(105): n is a, c, g, or t
agagatcccctttgtctgctctgggcatataagggggagaacaggtcacagctgaggggagctgggcctattggtgtaggcagagcagagtggcagataggacantgtgacggtggggaaaatattcctcatgggacagaagatacctgccacatgtacccacaaactgtacacag

SEQ ID NO: 590486 - DNA, 274 bp, Homo sapiens
gttgaactgaagggcggtgacatggttagtgcttgtgttcccacccaaatctcatcgttaaattgtaaacctcataatcctcagtaatccccacattgtcaagacagagaccaggcggaggtaactgaatcgtggattcgaaaactcccatgctgttctcgtgatggtcagtgagttctcataagatccgatctgatggttttataagaagctcttccccacttcgctcagcactcactctgtcctgccaccctgtgaagaaaagagtgcttgg

SEQ ID NO: 590487 - DNA, 115 bp, Homo sapiens
gctgttactctatgatggatcccttcgatgtgggactcagagtggaagcatatgcatgaggacacggctgtgaatcgtgggctcgatgtctgacactacgcaggtggtcggaaga

SEQ ID NO: 590488 - DNA, 471 bp, Homo sapiens
ccgggcgctgccccgtcctgtgattcggggctggacgcagcatagcggggtgctgtgtcccgatgctccccgtcctcggtggagcttttggaatagtcccatatgtatgcgatcagggtccggcatatggcagtaggagctagtgaaggacaacgtatgctgctcccaccaccttctccctccttgggctccttcgacccctggctgagctcacaggaaaggactcaaatgtcacagcatctcccacagcccctgcatgccccagtgacaagccagcaccggtccagaagcctccatccagtggcacctcctctgaatttgaagtggtcactcctgaggagcagaattcaccagagagcagcagccatgccaatgcgatggtgctgggccccctgccccgtgaggacggcaacctgatgctgcacctgcagcgcctggagaccacgctgagtgtgtgtgccgaggagccgg

SEQ ID NO: 590489 - DNA, 354 bp, Homo sapiens
  misc_feature (206)..(206): n is a, c, g, or t
  misc_feature (303)..(303): n is a, c, g, or t
agcttttagcaggagttgggcaacagagaatccagagttatgttctcaggcatcaagaagagctggtaggtatctgccgatgctgactgaggggagcgggctcgtgttgttaatgctctcagcacctggtccgtggcaggcctgcagtgaatctgtgtgcagtagttaaatgtccacatcacatgtagggttgtccccctcttccnaaatccttgctcctcatctccacctgaaggaaggcctgggcagtagctatgggattaggccaaggtgctttccttaggaaacaaatccgggactgtncttcatatatcaaccaaagtgctaggatttacaggtatgagccaccacgcc

SEQ ID NO: 590490 - DNA, 292 bp, Homo sapiens
ctgcaaagcgcgtaagtgatcttatgggccctctttaacttaccactctactatcagtgtactgttacggggacctggggcccttaatttgcataagggctatcgaccttccctggggtaaaaaatgtaccccatttcttgccacctcacgggctacaccttgacctaacgtgtctacttgggtacttacgctcactttgtgctcttcatgaaggattgccgaagaccgcgatgtatagactgaacaaaacgttgcgaggtccatcgcattttatcgagtacaaaacaggct

SEQ ID NO: 590491 - DNA, 333 bp, Homo sapiens
tgtctaagctggttacgtgcgacgtcactcatgaagacagctcaatgggttctccctgaatgtgtcagttttcaggaatcccaataagagatgtgatattatctgattcaatgtcttgatctgtgcattctaatttctcttaggatcatcgttcacccctatttactgcaatagtcacttcctgagaagctgggtctttccctgtctcatttttactatgattttcctggttttccttaaaatattctttcagggtggaaagaagatcatcatctccttcaaggtcaatgtactggatttgttcaaaagctgaatctgcaagttctactggac

SEQ ID NO: 590492 - DNA, 378 bp, Homo sapiens
  misc_feature (26)..(26): n is a, c, g, or t
  misc_feature (63)..(63): n is a, c, g, or t
  misc_feature (67)..(67): n is a, c, g, or t
  misc_feature (94)..(94): n is a, c, g, or t
  misc_feature (100)..(100): n is a, c, g, or t
  misc_feature (117)..(117): n is a, c, g, or t
  misc_feature (125)..(125): n is a, c, g, or t
  misc_feature (139)..(139): n is a, c, g, or t
  misc_feature (202)..(202): n is a, c, g, or t
  misc_feature (241)..(241): n is a, c, g, or t
  misc_feature (256)..(256): n is a, c, g, or t
  misc_feature (266)..(266): n is a, c, g, or t
  misc_feature (305)..(305): n is a, c, g, or t
  misc_feature (320)..(320): n is a, c, g, or t
  misc_feature (331)..(331): n is a, c, g, or t
  misc_feature (334)..(334): n is a, c, g, or t
cgggttccgcaggaccacgatgactnatttcccgcgcaggaacatcttggagatgtagcggtntttnttgattgtgcttggacttcttcttgcnctttcnacttttgggtaccttanttcacatnttctttacgttctncagcaccatgttgcagttcctattgaaggcctttacgcggcccaggagtttcttattgttgcngcagttgatgagcacttgggtattgttcttgatttattnttttaactcagatanttgaccggtnttaaattcctcctcctcttgcttcttcagctcctcttgngttatcttacttttnggctttttgangangcttattatggttactacgctcttcgttcactcccgtttcctcc

SEQ ID NO: 590493 - DNA, 374 bp, Homo sapiens
ccacatttgcaggaggatcacttgagcctaggagttgagactgtggtgagctgctatgattacgccattacactccagcctggctggcgacagagcaagaccttctttcttttttttttttttttttaaaaaaaagggagggggagtagggggaaaaaaataatttcccttttttaaaaggtacgtgtcacaatttaaaagaatattagggtccttttaaaaaaatatgggtagatatcacctgctatcatgtaagggccgtaatggtgtccagcagtatttttttaaaaaagaaaagacagtgaccagaaacgggtacctagggatcctagaggcaaggagacacagagtccggtataccaggacagaccgtt

SEQ ID NO: 590494 - DNA, 215 bp, Homo sapiens
  misc_feature (117)..(117): n is a, c, g, or t
cccatggggaaagtctagttggggataaaactcggagaggttaagaatttgatccatgggaaattccaccattttaggagcaaaatgtcacgttctgcaaggtcatattatatgatnctgacctctggcggacagatttcatgaagggcctagagtagttaggcaacctggagggaggacatgttaaggatttcagaggtaggtaatttacaccc

SEQ ID NO: 590495 - DNA, 222 bp, Homo sapiens
actaccgatccttaagagacgtgttgcatgatcctcttatttatgcagaatgggactctcaagtaataaatgatctcaccagccacagccaaaaaagactttgcctggctaacagagtctctcgactaagtatgtaatatacaatgaaatacaattcaaagatgatgtacctataacgtccatttatttacacggtcttatatttacaaaacggaggcccca

SEQ ID NO: 590496 - DNA, 1363 bp, Homo sapiens
  misc_feature (477)..(477): n is a, c, g, or t
  misc_feature (1363)..(1363): n is a, c, g, or t
gccaatgccccccagaaggtgatcggaggagttctacaaccagacatggtgtccagccgcgtatggggacgacgcagtcctgcccaccatcgctcagccatcgctctggatccctctcaggtggccattctttttcgtgttgaggggcattgattggctcctttctctgtgggccctttatcgttaactcgctttggcacggcggaggttcataggctgtagtgatgagagcctgctgggccttcgatgtccggctcgtgctcaatgggcttctacgaaaactcgggcacagtcctttggatgatgcgtgatcctagggtcgcgcttcatctagtcgcgtagtagttactggtcgtgcctagaccacagagcttctgatgccgcaatgatatagtggggtggaagttgtctacccgactagatccggttctgtagggggcgccgtgcgcgcatagccatgctagcaagcatgggacnatcggtcgatcggctgtccgtcatcgcccacggtgttcggcctcggactccatgcatgtggcaaggaaaggatccttgtgtgacccatgctggcttggagcatcatcttcatccctggtccttgctggcagtgtcatcgtgccgtgccacttgcgtggcccgaggagtcacccgctttgcctggctgcatcgaagctgcacacgaggggagaaaccgggccaaagagtgtgctaaaagaacggcttggcggcgggggaccagctgtacgttggacccaatggaccctggcccgcgagcaaggcacgggaagaaggacgtcaggacagatcatgccggggaaaaacgcaccaggtgacacacaccatcggagacaggggacacggaacaccccggccaaccgacacagacacacgaacccaaaacgcacgaagcacaagaacaaatgcccgaacaggacgaccggcacaaccaagacggaagccatagaaaacaaagcaaggagaacacaccatgcagacaaacgcggaggggtcaccatccccgtgatctgaccccacatggagaccggggacgacgaacacagggacacagccagtcgagcggacccaaaacgagaggaacaaaccacgaacgcacgagcgagcacgagacaccccaaacgaacaccagaagaaagaagaacataacgaacaaacagcgagacacaacgggagccaacacacacgagaaagatcacgaggagcaaacgagacacacagagatcgcagcacagccagcgcgaacaacaagcacgaaacacaagcacgaagcaagaaagcacgaataagcaagacaaccgataaagcagcacacgcacagcgagcagaataaagagctacaacggcn

SEQ ID NO: 590497 - DNA, 640 bp, Homo sapiens
  misc_feature (151)..(151): n is a, c, g, or t
  misc_feature (154)..(154): n is a, c, g, or t
  misc_feature (164)..(164): n is a, c, g, or t
  misc_feature (187)..(187): n is a, c, g, or t
  misc_feature (230)..(230): n is a, c, g, or t
  misc_feature (253)..(253): n is a, c, g, or t
  misc_feature (285)..(285): n is a, c, g, or t
  misc_feature (317)..(317): n is a, c, g, or t
  misc_feature (467)..(467): n is a, c, g, or t
  misc_feature (483)..(483): n is a, c, g, or t
  misc_feature (485)..(485): n is a, c, g, or t
attcggccattatggccggggggataccagggcaatcctattctagagtccatatcaccattagggtttacgacctcgaggttgaatcaggacatcccgatggtgcagccgttattaagggttcgttggttcaacgattaaggtcctacgnganctgagttcanaccggagtaatccaggtcggttnctatctacttaaaattcctccttgtccgaagggccaggagaantagggcctacttaacaaagggcnttcccccgtaaaggatatcatctaaacttagnattataccaacaccaacccaggaccagggtcnaaaaaaaaaaaaaaaaaaaaaaaaaaaaccttgtcgcccgcttgggccaagccgattttagactggagcaggttaatgcttgcggccgaatttggggttaattgggccaattggccttatagggagccgatttacatttaattgcccgcngtttaacaacgtcggnantggaaaaaccttggggttaccaaattaaatggcttggaagaaaatccccttttggcaagttgcggaattaccgaaaaggcccgaacgaatggcctttccaaccagtggcccagcctgattggcaatggaaaatggaaggcgttttggttttcgcc

SEQ ID NO: 590498 - DNA, 485 bp, Homo sapiens
ggtgccatggaagtaacaaagacacaattagaacagttaccagaacacatcaaggagccaatctgggaaacactatcaaaaaaaaaaaaacaagaaaaacaaaaaaaaaaatttttggggccggccttaggagtccttagaagaaggtttttataggaccaatttcggttggggggcgggggccaaggtaggttatggtgtgaccctgtgggtaatatagcatgtgggttcacatataggagagagacctcgggggcgataatggagactatagtaggcttggggaggttctctcttcaaccaatctataaaacaaacgcgccgggggggagaacacccggagggctggtccttgagaacaacaatctcaagaaagtggagagatccagagaaggaacaatcaacgggagcctcatatcaaacaaagggggcgttcacaaaagcagagcccagataattcaaattttacggcccgcgcgcggggc

SEQ ID NO: 590499 - DNA, 615 bp, Homo sapiens
  misc_feature (442)..(442): n is a, c, g, or t
  misc_feature (458)..(458): n is a, c, g, or t
  misc_feature (460)..(460): n is a, c, g, or t
aattcggccattatggccggccacaggggttaatgcctgaaatcccagaattttggaaggccaaggagggtgaatcagttgaggtcaggaattcgggaccagcctggttaaaagggtgaaggcctgtcgttactaaaaccccaaaatttagttggttgtgggggcagacgcctgtaatctaagttacttggaaggttgaggcagaggaataattgggaccccggaagacgaaggttgcagtgagctgaggtaacgcaattacattcaagcctgggtgacagagtgggactccaaaaaaaaaaaaaaaaaaaaaaaaaaaaccttgtcgcccgcttgggccaagccgattttagactggagcaggttaatgcttgcggccgaatttggggttaattgggccaattggccttatagggagccgatttacatttaattgcccgcngtttaacaacgtcggnantggaaaaaccttggggttaccaaattaaatggcttggaagaaaatccccttttggcaagttgcggaattaccgaaaaggcccgaacgaatggcctttccaaccagtggcccagcctgattggcaatggaaaatggaaggcgttttggttttcgcc

SEQ ID NO: 590500 - DNA, 847 bp, Homo sapiens
  misc_feature (673)..(673): n is a, c, g, or t
  misc_feature (748)..(748): n is a, c, g, or t
gctctcccagattgtcccgattgtaactcagagggtggaatatcaaggtcgttttgtttcattccatgtgcccagattaaatcttgctttctttgtttggctgggatagaggggtcaagttattaatttcttcacacctaccctccttttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgcactctggctaggttaggacttgccctcgcggtggcaactttcctcaacaacgtctcaccaacccttgtatcaaacgtgggatctacgttagcaggcaggggttgcgaatcacacggatgggctctgcgctgtcgcaccgcgcgcttcccccgcacagtgctctgcccctgttgctagcactgtggcttctgcatatggagggcccgcctcgacaggactggtctgtcgaacccaccgcgctctcctgcgtggcttccatcctccttgctgcgtcctcacggcgagcttctgcgcatgctcctccccacctcgccagtcgccccaataatgggtgctacatgtgcctgcngcttttctacttgcgactgcactctgcatggacccctgtgctcctcctactctctcttgagtctctccactcgcncttgtcggcggtatggatctcttgcgctctcgccgtctctcatctccactccctcggtttgcccctctgctcttcttctgctgcctgtcgtgggagccc

SEQ ID NO: 590501 - DNA, 194 bp, Homo sapiens
agtccaccatcctgtggttctattcatggacggttttggtcctcataacgggactgtgtcctctgatgcttggtatagcggataattggtgaccagatgccaaatgtaaattttacactgtgggtttctagttttaaaatattcctttaactaatttggggctttttggctgttgtggtttggtttttttggag

SEQ ID NO: 590502 - DNA, 980 bp, Homo sapiens
gctctcccagattgtcccgattgtaactcagagggtggaatatcaaggtcgttttgtttcattccatgtgcccagattaaatcttgctttctttgtttggctgggatagaggggtcaagttattaatttcttcacacctaccctccttttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgcactctggctaggttaggacttgccctcgcggtggcaacttttcttaagaagttataaccaatttgtctattaaaagtgggaattaggagagaaggtaggggtagcgaattcagagataatggctttggtctcttgcttgtgggactagcctggcttgggactaaatgccctgcgtcgtgaagcagtgaagcttagtaataaatgagtggatatccctatcttgaaagaagaaaaggttcttactgcttggtccttgatttatcacacaaagcagaatagtatttatatttaaatggtacagaccaagacaacgtatactgtaatggctccgcgggactcaagcgagaacggcccaagggaaaagaaccactcagggtaccagggccaccaccattgaacccaattcgctgcgcttcaaatcaagtcatcatcgcggcacaagcgagggcaatgcggccaacacgggaaccggacaaagtgcacccaaacactcagagatggacagccacccgtgaaaagggggctcggtaaaaaacagcaagcacgacgagcaactcggaggttacaaccactgtcacaacaacgcggcgccgctcgtgaaggcagccacttacgagctgaacagcgcacaagaatataacacagaccgaagtaag

SEQ ID NO: 590503 - DNA, 130 bp, Homo sapiens
gccctccacctcagtcagcgagtcagcccatcccagaccgactcgggatgttcccccggagactgaagagtgcccctcgcatcacggccgatgccaatatcgactctgaagatcgagtcggaaaccatcc

SEQ ID NO: 590504 - DNA, 188 bp, Homo sapiens
aattttgtaaaaagaaattgtgaaaaatgggcttgtaaatcccccattattttattttatggtcccaaatcaaatccatcccccctatgttatttttaaaccaaatatataatccccccatgggtgtatgttaaatctgaacctgtatctgggctgattttttaaataaaaaagagtctggaatgcta

SEQ ID NO: 590505 - DNA, 869 bp, Homo sapiens
atttccgatctgcaaccctcttgtacaaaaccccgtttcccctccctttcgttttttgtcacccgttaatatgtaactcgtccccacaaaatccctcgtctgcccaatacgcctctttcacaccattatattgtgcctccccccccaagagatgtgtcaaacaaaattggaaacaaactgtgaacaaaaaaccatagttttttccctcccgaaatacggttcaccatttgccaattgttagacgcctcttaactcctggaaaaattttaacttccccgttatctagaaattttaatatcccgaaacttcccctcggggagaactcaatttatggtcctccgcaataagaactttacaacacaaaacacctcgggggtatataaaaaccaaaacaacgtgggcctttgcataatatagatgctaacacgttgtatggaacccccataccttttgtttgccccctgctgagaaccgtgaatttagatctatgtaataacacccccaccaccgcagaaatggagtactcgtcttcgagccccaaaaggcggagtcctcattaacacgcaacaggagtatcgatttttccagcgatgacattgatttctttcccagattcacccgaaagtttttccccctatcaaagttggtctaaccccccttattgttggaagttaacaaatatataatattctccggccgccaacaatttgcctcagacaaccccagtatgattgcggttagaacttggtgtttaaatttcttattaagtcccccaccacccccaatattcaatcaagatatgtgcaaaccaataaggaaacggggcatatatcccaaaaatctacaaaaacaaaaaggcgaacaaaaca

SEQ ID NO: 590506 - DNA, 389 bp, Homo sapiens
agagatcgcaaaacattcggttggagcgccgggacagaaggtaaatggacatggttcttactgttcctaagagagatcctggggtagtgtagctaggtggctgtgcgagttcattaaataaattgaacagaaggggccggtgccgggaaaacgtaagcggttcaggaacaaatgtcagatgggcactcctcgaaggttgcttatctgggaatttagtgaaacagaggagttgtcgaggtgagatcttgggacatttaggaattttaggcttgcggtccgaggacaagatgaatgccgtaaaaattgacgacattcacagagggtttatgggattctattagcaaaagaatcctggtacattcagatggagaaatttataatggaaatat

SEQ ID NO: 590507 - DNA, 1066 bp, Homo sapiens
  misc_feature (228)..(228): n is a, c, g, or t
gcgcgtgttgccgtcgagaaacatgagctgtggtcgatagactgatcctccttaagaccatccatgggtcataagtagatgcctcgagtattcatcactctgattgatcaatatggcaccagcgtagcatatccggagccagatgtctgacaccacatatcttgagacatggatgtatcttgaatgagatctagtttagctgggcattctgatcaaacaagagacagntctctgagacagaatcttccggaaaatcgaaggcttgcgtcgcccagtgcgcgagaagggcttccatatcaaagttatgcactggagatctttggatcaaacttgcaagagcatgagacgatgaacgttggatattcgcacgcatttgcataatcatccattgttggcaacattgtgcagaaccagccacacgtactaatcgtgcactactcaattgacttgcccacagagacacaagacgacattgtagtcagaaaaccatgacttacaggggcacatctacaggactgacgtgatgcatgtcacgtgcattgtatgctgccatggatgctctgcgtggaactacttagacaggacatgggtacttcatccaaggacagtggggtcaggacccgcgagaagacattgaccgcattactggactttaacaacaactgtgcgtgttgaaaaagcaacttacatttgatcggtggtggttaacacaacaacatggagaattatctcaaacgtggacaagaccaagcccagtaaaacagggcccacgacaaccgaagaagtcgtggcagaggaacaacatggaacggaaaggaggaaacgattcacagacgcaacacttgagcaaaatcaaacaagcacaccaatacgcggacgctaacgagacgccccccggaaaaacgacagataaagccaatacaagggatgaccaaacgcaagcagcgtagggacatgacgcacacggcgttgaccacccaaccgaatggccgagtggacagcgaccaagaggtcggcaacagcgaaagggaacatgaggcgagaccaaaacgaacacttgcaaaag

SEQ ID NO: 590508 - DNA, 828 bp, Homo sapiens
gttctcgaaggtgggaccccgggcagtgaatagggaacatgccggctgtccccagcccatgcctcggagtgtgccgcgggtccgctgcaagttgtaaccgccctcgattcggttgggggccaccaccaaccgagcctggggcccccgccatttttgcttcgaccgagagtcaggttccaagcagaactttctgcgtgaccctcgggtccaccccctgccactcaggaccggtgccctcctatctgcgttgggagtctggaagaagactctcccttccccgcccttgccccagaatctgagggttggaaagccaaagccagatgtggtggccccaaactgctccccaagaaagatgagaaccagcgtagttcctcctgcccctgtggacagcgacggggagagtgattgattcagaccgtgttcctcgtgcccccgtgtttcccaaattccttcagcccagctattgaagcagccttcatgaactggaccacaccaagctacttcagatcccctctctgaagagaaaaggaggaaagaaaagaaaaaaacacgaaacagaagctcctgttcaagcacctcaatcgtccacaccccaagtgacactaactggcccaaggctaccttctccactctggtttttgtttttgtttttttttcccccacagcttttgtttggctgctgtaatttttaagtatttgagtttgaaccagattagctctggggggagggggtttccccccaagtgagggggaacccagaaaattttaaaaaccagtgtattttcccgcttcctgtctttaccacccaaataaagtattgacaccaga

SEQ ID NO: 590509 - DNA, 169 bp, Homo sapiens
ccgactttttccccaggcccaacacaactcaatcatttttggtaaagggacggacttcctaaaatggtttttatagttggggaaaaaaaaggtggggggaataatagtttggcagacttaagattttatttaaaggcttaacccaaaataaaagttgagtttcccccca

SEQ ID NO: 590510 - DNA, 242 bp, Homo sapiens
cactcactgaggagccttcatcagggtttgccgaagatggcggtatataggctgagcaagaggtgctgagggggatcgtggtttatcgattacagaacagcctcctctagagggatatgaagcaccgccagttcctttgagttttaagctgcggctcgaagtgtcctgacgagcagttttgttgatttaactgtcgaggtttaggactaagcataggggcgtatctattcccagtttggttc

SEQ ID NO: 590511 - DNA, 217 bp, Homo sapiens
ccccaagggggctctttttggggtaaccccccggggtttttttaaaaagcggggttttttcccccccccccttagggggttttttttgttttccttttggggccgcgggggtttttttaggccccccttttttttttggtttaaggggttcccccttttttttttccaaagggcccccccccccccgcccccgtttttttggggtttttttttttta

SEQ ID NO: 590512 - DNA, 125 bp, Homo sapiens
gtaccctcgataagggccaagggtcatgatggcaggagtaatcagaggtgttcttgtgttgtgataagggtggagaggttaaaggaagttttttcataggaggtgtatgagttggccttatcgag

SEQ ID NO: 590513 - DNA, 642 bp, Homo sapiens
aagcccagcttctgggaagggagagaggggaggtctgcataaagagggagttttgggggctgggcgccgtggctcactcttgtaatcccaaaactttaggaggccaaggtgggaggatcgcttgagcccaggagtttgagaccagcctggccaacacagtaaaccctgtctccacaaaatttaaaaattagcggccgggcgcagtggctcacgcctgtaatcccagcactttgggaggccgaggcaggcggatcacaaggtcaggagatcaagactatcctggctaacacggtaaaaccctgtctctactaaaaatacaaaaaaattagccaggcatggtggcaagcgcctgtagtcccagctactctggaggctgaggcaggagaatggcgtgaacccaggaggcagagcttgcagtgagccgagatcacgccactgcacttgagcctgggcgacacagcgagactccatctcaaaacaaaacaaaacaaaattagctgagcatggtggtgtgtgcctgtagtcccagctactatggaggttgaggtgggaggatcgcttgagcccatgaggcccaggttacagtgagccaagatcgtgccactgcacttcagtctgggtgacagaaagagacttctctcc

SEQ ID NO: 590514 - DNA, 96 bp, Homo sapiens
caatgtgtaagaagtactttaatagctcaaactcagagtcatcgtgctcccaattccaaagagattcctaaaagaggcaacttctgtcgtcttctc

SEQ ID NO: 590515 - DNA, 164 bp, Homo sapiens
  misc_feature (134)..(134): n is a, c, g, or t
gatctagaggattccgaatcgattccctgcttctgtgtggctttccacagatcactgcctgcatagcaacagaatgatttcctaaaaaaaaaaaattgagactgtattgatcccttgcttaaaagccctccaancagcttcccattggcaattaaaaattaatg

SEQ ID NO: 590516 - DNA, 201 bp, Homo sapiens
  misc_feature (22)..(22): n is a, c, g, or t
  misc_feature (29)..(29): n is a, c, g, or t
  misc_feature (40)..(40): n is a, c, g, or t
  misc_feature (50)..(50): n is a, c, g, or t
  misc_feature (70)..(70): n is a, c, g, or t
  misc_feature (103)..(103): n is a, c, g, or t
  misc_feature (146)..(146): n is a, c, g, or t
  misc_feature (152)..(152): n is a, c, g, or t
  misc_feature (163)..(163): n is a, c, g, or t
  misc_feature (165)..(168): n is a, c, g, or t
  misc_feature (174)..(174): n is a, c, g, or t
  misc_feature (198)..(198): n is a, c, g, or t
tccagggtgtgcgtaaaatccncttcccntgaccatcccnggaagagccngaatgcaggtgatagctccnctcaggatttacattgcattttttgttgttacnccgggattgtaaaagtgctatgtgcattgtggaaaatgtaggngatacncgaaagcgcgnannnnaaaaantaaataaagatctgtaattcaccncgg

SEQ ID NO: 590517 - DNA, 257 bp, Homo sapiens
tgcagataggccacctaggccagaaatcccccactactctgcttttatctccatctcccccagacttttttctccccttttctctctctggccattttctttctctacgcaagtgtgttctcttgcccagctcagatctactcccctcaaaaagctttccctctcttcccagttggaagacaatcctcttcaaaaatttagttccctctagaagtttgtctctctcttctaatacctactcctttgccttatctgcg

SEQ ID NO: 590518 - DNA, 543 bp, Homo sapiens
gatcgcttcaagaatcggcttgagcagatcgtgcttcaccttcagcgccgcctgattgatgaccagacgcgagctgatgtccatgatgtgttcgacctcgaccagattgttcgcgcgcagcgtgccgccgctgctcaccagatcgacgatggcatccgccagaccgaccagcggcgccagttccatcgagccgtacagcttgatcaggtcgacgtggacgcccttggcggcaaaatgttcgcgcgcggtgtgcacatacttggtcgccaccttcaggcgcgcgccacggcgcaccgcctgttcgtagtcgaagccgctgggcaccgcgacgctcagccggcagcgcgcgatgttcaggtcgatgggctggtacagcccggcaccgccatgttccagcagcacgtccttgccggcgatgcccagatcggcggcgccgtactgcacataggtcggcgtatcggacgcgcgcactatgaccaggcgcacgtccggccggttggtgccgatgatgagcttgcgcgacgactccgggtcgtcggtcgg

SEQ ID NO: 590519 - DNA, 216 bp, Homo sapiens
  misc_feature (216)..(216): n is a, c, g, or t
gccgaagcgcatgctcgtgggcacgcacgagcctcaagatccaaggcaattatttccagtcagagagggaaaccagtccctggcattttaaccatcttttctacctaccttgatcaggtcttgtcaagttgaggtacaggccaattgccgttctggtttggccataggtctcttgggccaatgtgttgaggatctgccctcaccagtattatgctn

SEQ ID NO: 590520 - DNA, 147 bp, Homo sapiens
  misc_feature (3)..(3): n is a, c, g, or t
  misc_feature (17)..(17): n is a, c, g, or t
  misc_feature (107)..(107): n is a, c, g, or t
  misc_feature (138)..(138): n is a, c, g, or t
gtntccatagacaaggncaggactagtttgtacccgttgatgatagaatggggtactgatgaaaagttgggtagacaatctggagacagtggttgggggagaccctncaggaagcgagaatgcagagttcctctgtgnatatcgctt

SEQ ID NO: 590521 - DNA, 459 bp, Homo sapiens
  misc_feature (457)..(457): n is a, c, g, or t
ttttaataggaattctccaaatcactaaagtgaataatcagagtactctaaacaaataagaccgggttaaagtcagaaaactccttagcttcacaaaaaacgccaacctgcatttctacacaaccagctcaggagtcaaaagcagagaacaacctctcaggagctgagaattctaccacattctaacagtagggaccagatggcaacatgcttccctggattgccaaaactgctctggctccccaaagttcatgctgagtagttttcctgtgtcttaaatgaaattgggaaacagaaattgatgaaataaaatggattttttcacagtttggccccaaagtagcaaaaactattcatttctctctacctttctgtatcagtattactacttcatagaaaagatgaggcatatgccagaaagcaggaaaacattaattttaactatgagacagacagnaa

SEQ ID NO: 590522 - DNA, 214 bp, Homo sapiens
cgctgccactgccacgactgctggaacccagccagtgggagggcctggcccaccagagtcctgctccctcactcctcgccccgccccctgtcccagagtcacctcggggggctctctacccccctcagagtgcccgagtcacacacagtgccccacacaggggtctaccccctctgttctctgcacaaaaatatctctcccggagagggccctc

SEQ ID NO: 590523 - DNA, 1003 bp, Homo sapiens
cgagagccggggcgagtgggcctctgctcgtgggtggttctcgtggagtgtcagctcccgcgtgtctccgctcgacagtggtgcttgtggcagagcccatcggtgtatgctgtctgggccatgtgctgcagtacaatggtgcaccatgctgcgatgtgcaggcctgtgccatgcacctcctcaagaatgctgctgaaatgtgcagcgtgtgagcagatggaggtgctgaatgcagctgcatcgccgagtgagaccatcctcaagtcgcagtgtggacaagaggttctctggctgcattactgacgcctgttggatgtgcctgatgcttgaatgtcctagcactgtgttgtggccttggtggacccttgaactgacaattgaagtgccctgtgcatgggagtgcccttggtcaagggggaagcggcggatgctgtgcatgctggtgccaattgctgccagccacgctacggacggacgcatgctgcgcttgcacggcatgtgatggccgtgcatgctgtgcgaccgcatgtgagtcattgttgtgctgcttgaagctgcgcaaagcgtgttagcggcagtcgtcccgttggccggtggggctcgcgtatggggccgggcgtaatgaaagccgacgccgtccggcaagtgaagcccaagtggccccctgcatagtgcctgtgtcaccgagagaggcgccaaggggcgggcccggccacggagagaagaccgcatcgtcgcggcagacggaagacgcgcccgaaacccggtatgccgcacagagccgacaggccttagcccgatggccccaagaaacaccggcgggaacccggcgcgaacagggacggcgcacggggcacgcacaaaccgccgggccatcaccccgaacgacgagtgaagccgatggcggaccgcgaacgaccaagtatagacggcacagcgcgcgcaacagcgcggcgcgtacgctacgcagaggcgcagacacggcgtcaccgcaacgcgcaca

SEQ ID NO: 590524 - DNA, 391 bp, Homo sapiens
  misc_feature (30)..(30): n is a, c, g, or t
  misc_feature (346)..(346): n is a, c, g, or t
ttttagtgaataaatatctacagaaagtcnataactcaattttgttttccctaatccttgcttactggcaggctcaattgaacagtgaaggtcctaaagaatacaggctgggcacagtggctcatgcctgtaatcctagcactttaggaggccgaggtgggtggattacctgaggttgagagttcaaggcgagcctggccaacgtggtgaaaccccgatctctactaaaaatacgaaaatattagctgggtgcagtggcttgcacctgtaatcccagctactgtggaggctaaggcaggagaatcgcttgaacctggtagatagaggttgtggtgagctgagatcnatgctgctgcactccagcctgggctacaaagtgaaactgcatcca

SEQ ID NO: 590525 - DNA, 194 bp, Homo sapiens
  misc_feature (98)..(98): n is a, c, g, or t
ttagaggatctatcctctcgacatctctcctctcgagatctcctatttctcccactcccactccagccctggtaacgcactgtactctctgtagaagncaacttttaaaaaattagccaggcaaggtggtgggtgcctgtaattccagctacgtgggaggctgaggcaggagaatcacttgaacccgggaagcg

SEQ ID NO: 590526 - DNA, 1397 bp, Homo sapiens
tagtctagatcgcgagcggccgaccttttttattttttttatcacagttacatttttaattctgtgtggaaatggtacaaaatatccccacttccctgtgaaaaagagttatacttaaaaatacactttgtgagtgaacaaacaaaaaaaaaaaacaaaaaaaaaaaaaaaaaaaaaaaacacaaaaaaaaaaatagggggggcgcggcaaagagaaacacccctggggggcccgcacatctgtgctccgcacgcccccgaagtatattatgtgtgcaagaagagtggggacgccactatatatttggggggagctattatatatatatcaagcgtaagtgcgggaggcgccgacggggtttatacatcgataaggtgtgatgaggtgggaataagctgcatgagagagggaaatctgtagttgagaaggaagatatataatttatgggggggggctggcataatatttgtgggagactgcaaaaacgtccttatagtaagatgtaaagagggtatactgagggagaaactagagaaagttattaagaagtggtgttatgagagcggtgtggcaagaaaccagattcttgggggaatatcatgcgtgagtgggtgaggtggagaaacattgtggaggaataaaggagaaggtttatgtaaattttttgaagacataaatattggttatatcatgcggcggtgaagcttgatctaattataaaaaggggaatccagtttaacaattcttaacggggggcagagaatttttcacaatttacatcttataaaatggggcattggttccctttataaaaaaaggaagggaattcttggaaaagtcaagacgtaattaattgctatacccaaaagacagcgtttatagggaagcccaaaattttgtcccaaggaccacccgatggaagccgtccctgaactgggcctagctaagttagtagggatcaacctggaaggaaatgtctagcgaaaccacaaccaattagggcataatgcgcgaaggggacaagcagaaaagaacacaaaacataatgtgccaacacaatcggtaagaacagggcccccccgggagcaactagaagattaggcgacccagtaataacacaagatctcaaacatcattaacgaagcaaagtcctcgagacacacaccacacaagcttggcccgccgggcaaacaagcaacgccagacaaacataatgggaaacaataccaaaagcccgaagagataaaagaaaagggggaataaagagacgcacaagggaacgaagatagaagaaacaccaaccagaagaaagaagaccgaacgaaccaaaacaaggctaaaattacaccaccagaaaaatagaaaaaaaaacgaagggcaagcacaggcagagaag

SEQ ID NO: 590527 - DNA, 246 bp, Homo sapiens
tcttgtatcacgcttcactcactcaggatttcaatggtgccctggaggattttagtggtgatacctaaagcctggcagaggaggtcttctcgggcctgagacagtgttctgggctggcacagtgacttcacatggggcattggcaccagctcgggcaggagctggtaccttattggccagctacatgtccctgatctcagtgaggtcctccttggtgatcacggagcccacgttttctgctttttc

SEQ ID NO: 590528 - DNA, 1095 bp, Homo sapiens
atatacaacaaatatagacggaagtgtgtgccacgttatatagccgagaacgcatgcgatgttaggatgaacgaggttactcacagttgtgtccgtgttgacgagcatgtacatcttacggtgtctcatggggcggatacatgcatgaccgggaccagggactgtgcagcagtgttgcagcatgtctttacgactaccttccttgtacacacgaactacttctagattttgtatcgggtagactgtactaatctagaccttagtgcatgcatgcctacctagtggctgtacatccgtgtaatttggtaatgaactagtaaaggtgtgagttcgatcggtcaacgacttcacgtgtgggattttgcattataatcgataagatgctatagtttgggaagattgtggaaagtgtgaggagtcgtttgcgaattgactaaagaagttgacatatagttgtatctaaactctgattaataatttcactcgtctcttctttaaaacctagcctaagctggattactaggattaacaaaggggtgtgtatgtatacaattcaataggtaagtaaggagttaatcttttatgagataaaaaattttgtatatctactttacatatatggtattaaaagaatcttctgtattaaaacactgaacgaaatcttttatactaagtggccactatagattcgtggacccgatgagtcaagtctttgcaatagcattatatgcacgtcttgtggattaaagggaaactctttttggttgggatacacagtcctcttggagtaatggtacagggaaattagataatttagcgtctcccagtaattgtcaacgtttagatatatctatgctttttcccgggatttaacatgggggggcttcatttaaaataagcaagcgatatcttaataccatcttgaaagaacttctacggtggtacagtatagttccctttggctacgaagaagtttcgccactaaatggcgtaatccaactacatggttaaggtcactagtggggtaaaatgatttctgccgagttaacgaaattcttaggtttctcgaactatgttgctttaaggcctaatggg

SEQ ID NO: 590529 - DNA, 648 bp, Homo sapiens
cgggcagaagtgctggtctcggcgggattccgggcttggtcccaccgaggcgggactgcggtaggagggaagaggtttggacgcgcgtgtgcctccacgcggcgtgtgccatttgcgggcatttatttccagttccaaacatggaactattaattgcctgggcaacgccagcctcatcgaggaccatttgaccaaaaaagcacttgggttctggcttgcgcagaattgggaaagggaccactttataggctttttaaggaaagccattgtgatcaattttgcaaacttaggtgctaccatcagatctgtggagcgtattcattggtggggcaaaaaaaattaacggcgtggatatttcctcgagggggaatttgtgtgggtcagagggaagaaaattgttggtcctacttaggagaaatagactttggaaaaaggagagtgacacatccctccagcaagtatccatttgaacgaaattctagaagaacaaagggtggaacagcagaccaatgctggaagcagagaagttgaaatgtgcaggccctgaagggacccggaggggttctttttccaatttcccttcggagcagatactctttgatgagtactaatctttggcccagaggcttgtaggggccttcttttgga

SEQ ID NO: 590530 - DNA, 669 bp, Homo sapiens
  misc_feature (114)..(114): n is a, c, g, or t
  misc_feature (163)..(163): n is a, c, g, or t
  misc_feature (406)..(406): n is a, c, g, or t
cgaaggcggctccttcacagaattaaaaagggtaatcctagtaagcatgtgtgcggttgcgactaaatgggtaggtatgtcgagcatgaagaacttcgacgtaaatcgtaggcnaagtacaaagaaccgggatcgcccagtgagtccttatgatctgtcacanttgtgtgagatgcactcagtgtcgccactatatattgtcccgaatgtgctgagtgcaccaaatgtctatggttatgtcatcccgataactgcttagaaactcatagcactcgggtgaagtgaactagataggacaagtccctctcgagcgcctcccagagttatggcatttctcctctcaaggagcatgcagtcccgatggaatgtgcagagcctctcctcctgtggcctttcagcattgagnagaggtcgtaatggtgctctgaaggtagctcagcgcactgttagtgtagtggacaggcatgcacctgtgcaagttgatcacgagtggtggtgaaggtgcctcggtcgagcacagccgtgtcggggctaccagcttctgtgtaccagtgcggagagagcacttggcacgcaaactctagcagctggcccattaagctaagttcgcacagataatgcttcgcctctccttcacaaacccaagggcctggtccagcttcactcggt

SEQ ID NO: 590531 - DNA, 927 bp, Homo sapiens
taaccaaaatactttctaaagaattccaaaccaaaatgtctctgttaaaggcatctttttaataacatttcctcttcactcaaaaatgatagtcatgcaccagttaaatgataaaaataattttaatattttgattcttatacagcagcaagaagttagtggtcaattaaaagcacacaaacctatctttaagggaaaccctgtaaaagactatcgttacaaacaatttcagttgggagacaccagctgggtaaagtgctctcctaaacttggctattttcataccctacactcttgaatatatgagttatagaacatacttttgatagaaggcttgtaccctgggcggaacacaaatacacttagcatatatttgtagccagtaataactagcaccacacgtctactgggaaatcttttacatacaccaattgggttttcacttttaaaacaaaattcagaatccagggtcagaggataacctataatggtgtcgctcggcttttaacccggtctacatagtaaatacgcctagcaaaaaatcaaagaatagttcagaccttttacaagtttaggcgcacaggtgtctgtgacccccaaattttgattcacctacctgagtgttccaggtaccgctttccgtggatttcgtgcccgtatttttaaaaatccctcaaaaacaaaacaactgacaacaacaaacaacaaaacgcgggggcaaaaattcccggggcgcattaagtcacattttggaaaggggccattaagggcttaataaacgagacgcgcgttcaaacgtgccggaaagcgctggtttggagcacatctgggtgtcacgactcaaatatacccgctacaaccgattgacgctgcgatttgtatcatacgcatactgtcactgctccaccttatacttcatctctgcta

SEQ ID NO: 590532 - DNA, 492 bp, Homo sapiens
tggggcgagggggtttagttttgcccccagtcttgtagtgtatgggcgctttctgccatacgtgttgaccctactttgtggatgtttacctgccgggtacccttttactcattcccggtcgtcagcctttttttatcttggcgattgtcgggcgattaacattaattacatttcggtccttatttacttattatccccgccttatccccctatttttttccttttttccctgtgggcaacattttcattgacttagatgttgtttcattattttacgccctctcttggtaccgtcttcgaaaggcccttcttatccattgtcatcgcgctctctctactattacgtccgataaccatgggtcgaaatttcagtgtgacgaatgcccggactttgtttaccgctcatcgatatccgtgtaacgtggtacaccgattatttagccacggtccgcatttcgtcgtgcgtttacttatccggccaagttactcagg

SEQ ID NO: 590533 - DNA, 257 bp, Homo sapiens
tcgctaccggctcgaggcagatcccatctctacaaataataaggatacaaaatggccaggcatggtggctcaaatcccagcactttgggaagccaaggcaggtggactgcttgagcccaggcgtttcagaccagcgtggaaaacatggcaaaaccccatctctaccaaaaaatgcaaaaattagctgtgcatggtagtgttcacctatagtcttcagctacttggggggctgaggtgggagaattgtttgaacctgg

SEQ ID NO: 590534 - DNA, 194 bp, Homo sapiens
cgagagcggaaagaagaccggcatggagccagaggagtacgactctgacatcctccgcactctcgctgaggcttacaaaattaggctaactgaaaccagccattaaatccgaacagactcctgtgcgctcacagagagactggtgcacttatagaacttcgcgtccacatatcggacttggatctgtcaaaaca

SEQ ID NO: 590535 - DNA, 883 bp, Homo sapiens
gacggatctgcttctgtataggactgcgtggcccgtggaggttgaatgctgtggtctggggtggaggagcgtgggaagtgcgcggattcgcgtgggcactcgccgcatgaatcaggtgatgggcatgagagtctctgtccgaatgagttggaaaggcttgaggctcccacagaatcgagtgatcagagatctatacaatgcgactacagagggcagatatgtggaacttgatcgagagaacatacaatagtatttggaggagtattgacgccgcaggaaaaagacagaactgatgaggacgtgttgtcataggacatcagaaatcatgatattatgtccgaagcgggggtacgaagaacagaggtaatcaaatgatgaatgggccgtctctcatagtctaggctgggccactggaccgtcaaatgatggggcacgatatcagtcgatgagaggaggccgggtgcgcctgaagtactcgaagtgtgatgggatgaggtggtgtgaccggagctggatggatgatggagcttgatggttgcgcaggatccgagtgaacccggaaggaatcttgagagacgagttcgagaaacagattaagagagacattgcggggaagacatcacgagtggttgtaaaagcttgtgctgtgagggacccggatattctcagttgtgaaagttcgttactacgattgtgtgacattgcgtcagaatcccaaagcactcgggttcaaggtcaaccgtggcacaatggcgtgggaggggttgggaaatcgaagaagtcaagggcgcaaaggcagacggggtacctcacaggatgagggaagaagacgcaggcagaggacaaagaggaaaatttagagacacttagggggagaaaaact

SEQ ID NO: 590536 - DNA, 263 bp, Homo sapiens
gcaagtgccagaagtggagcacagcacggcctacctgtgcggggtcaagggcaacttccagaccattggcctgcgtgcagccgcctgcgtagcagttgcgacactgacacgcggcaacgagttcatctccgtgatgcatcgggccaagaaagcagggaagtcagtgggagtggtaaccaccacacgagtgcagcatgcctcgccaggcggggaacttacgcccacacggtgaaccgcaactggtacggcgtgggctaactgag

SEQ ID NO: 590537 - DNA, 248 bp, Homo sapiens
agaggcatgatgttacacccgggcggtgtgctttcaaggaaggggattccttgctatattgacctgaaatgctttgtttttgtttttgtttttctttgagacagtctcgctctatcctccaggctggattgcaacatcgcaatctcagctcattgcaacctccgcctcccgggttcaagcgattcttgtgcctcagcctcccaagtagctgggattacagacacgtaccaccacacctggctggtctc

SEQ ID NO: 590538 - DNA, 1417 bp, Homo sapiens
ggcctggcgcttcagccaacgcgggagtggatgggccccttcttacttcgcagacagcgttcggccgctgcccggtgctctaggctgctggcctgtgactggcccagtctggagggttcggggctggatgtgcccggtggtgtggtgctgcgcgcccggggtcctggcctctcactcgctcccctctcgtccgatgcgcagggccgtaggcagccatggcgcccagccggcctggcatggtcttgaagcccacagttccacaaggactggcagcgtgcgcgtggcacgtggattcaaccagaccggcccgtaagatccgccagacgtaaggacccggcaagaccacaggcgcagccgaaatacgacaccgatgccaccgagatacgagagatcccacatcacggacgccaaatcgatgacggcatggcaccactagcaggggtctcgggataacggcaacgacgcgacaagggcatggacgcggacccgaggcaccgaacgaggacataatcacagcacacttgtgaaagaggcaaggcacttccaagaggggaatggctgccccgggtaccacaatttaccaacgccagacggtcaacaacgcggcattgagggaacccgcacgagggaaagcaaccagaaagtaccggggagcagaacacattaacatacacacaatcgggacttggcggaggaacagttatccgcccagagcaacggggtgcacaacgtgacggccactgtaggaccacacagacaacaacaacggtattcagccgccacgactcggtgcgaggaaacggcgagtataccagcacccatatttggggccaccaatgcgaggccccccccaagaaaaacggagagtctgtggaccagcaaagaggacagtcgagcaggcagccccatttgggaaaaagcaatgagcgggcgaacaaggtgactattatgacgaccccgccatgggaaagcgacagtttgtcaccaccaataagaggacgcgatgtacaccaaaaatttcgggcgcacattcacgcaatatagaacgcgacaccaccagcccacagacggtggcgggcaaagatagcgggccgcaccagcaattagcggcggagacaccgacgacacacacaacgcacagcagggaaaaacaaagacgggggggggtggcaacaaaggcgagcaagccacaggccgaaccagcgcgggagcagcatacaagataccaccgacgcagattaggggacgagccgcacgatgagcgcacaacgacagacaggggagagacaaacgacgccgctgtgtgcgggacactagcatgcacaaccaaccacgccactggggcgtgtgtcacacgaccccaacaaacgcaccaatcacaatacgagacggccaagtattatgaacacggcaggcc

SEQ ID NO: 590539 - DNA, 609 bp, Homo sapiens
atgatctggcacataaggttacatgtgagacagatgttcctttaggagaggacaggcatgctatacacgtgtgcccgtagtccaaatatgactgttatgctgtctggctgtctagctcgatggctgactcgtgcactcgcaataacatgctatgccgagcgacgggtaacacagcaggacacgacatggtgactatcctggcccacttgacgagactctatggatactctctgtactcgaattcatgggcgacacatcaggagactgcaagcaagaactgttcggactctgtggcagctctgatgaatctacctataccacattgacaggaggattctgaagacttggcactgtactacatcatgtttatacactgagacagcatcattccagaatgcttattatgcatgtcgacgcctatcactggatcctaccatatatactgcaggtgctaatatgcaactataagtagtcattactatactccaaagctgcactcgtgtttgcctgtattacgttggccgtgctaaggttcacatctatacgtccaccatgttttttccacattgagtcgtcaatgacgcaatttggcacatgggctgctggcct

SEQ ID NO: 590540 - DNA, 413 bp, Homo sapiens
  misc_feature (32)..(32): n is a, c, g, or t
  misc_feature (49)..(49): n is a, c, g, or t
  misc_feature (228)..(228): n is a, c, g, or t
gttgaatccgtggaaggccaaaggatttgccncatatgggcctgggacnagggcttactaaatgacttgcttacctggcttgataatcgggacaacctcaggcagtagttattcaggcgggaggacacatgagtttgaatatagggagataaggtatatttctatatgccctggtacattccagaatgtgcttctctggctctgtgcactggagcagccaactcctgnagttgggaggggatcgccatggtttcatgagtggtttatttcagcttgcatctcacagtgtggtgttcagaggcataggctctaggctccctggcagcactgagagatagaaactgaatcagcacaacttaggtccttcatgttgaatagtttgaacagaatttgatttaccctggcctaattga

SEQ ID NO: 590541 - DNA, 192 bp, Homo sapiens
ctcttgggtttaagttgttgattgtgatgtaggggaggggagcctactagggtgtagaataggaagtccaagagcgagtgacaggccgagagcgactgacagggtgtggtgagtgtaaattagtgcgatgagtaggggaggggagcctactagggtgtagaatgggaagtccaggagcgacggacagggggt

SEQ ID NO: 590542 - DNA, 111 bp, Homo sapiens
acctgcctgctcctgtaacatagtgcgccttataacacactctcggcccccacgagcccgcaatgtgccacccaccgcgccacacgaagagccacacgatgagccacacaa

SEQ ID NO: 590543 - DNA, 316 bp, Homo sapiens
aaattttttccaaagccccccccctttttttggggtcccgaacccggaagttgggcttttttagttttttaagggaatcaggcccgttttcccttcctgaatttcgaagaattttaaaacaggggcaagatggggttgtaaacccttttaaatttaaggcccccccctgggttttgggggactttccaaaacaaacaaagccttttaaagggtcctcccccacccccccagtgaacttttttgggggccccctgttttttttggataacttttttttcctttaaatcccttaaggcccccaaaaagttttttttta

SEQ ID NO: 590544 - DNA, 216 bp, Homo sapiens
attagaggatccttgtgctaggtggagtaagtggaatgatcacagcttatgcagctcgattcctgggctcaaggatcctcccaccttggctctggagtagctgggacacaggtgggtgctaccatgcctggctaatgttttgattttttttgtagagacaaggtctcactatgttgccaggctggtctcaaattcctgagctcaagtaatcccccc

SEQ ID NO: 590545 - DNA, 581 bp, Homo sapiens
  misc_feature (9)..(9): n is a, c, g, or t
cgatcaggngctgtatagcatccgcaactctcccttcctcccgtggcttcaggccgagtccctgacgctgagcacgggcttccgaggtcatcaagaagaagctgtacagcatcgtgaacagtctgctcattgaggagtgttgaacttcaagctgagggggccgacagtgcgctccaagacagagacgattgaacttctggggtggagactagaggcaggagctgagggactgattccggtggttggcaaacctgaggcagccacctaaggtgcaggtgggggaatagtgtttcccaggaagctcattgacttgtgtgcgggtggctgtgcatcgtggatcacaatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgacggaggaggcacgtgctcctcagagcagccggaagtgaggggcgaggtcggaggtcgtgaaggtggatagtg

SEQ ID NO: 590546 - DNA, 347 bp, Homo sapiens
gaggcttcaacggaactttcaccgagtactccgtgagagggtggcaatggagacgctgaccccttctgagctacggcgacctggtcaaccaggcagctgcccatctcatgccgagaactgtggcccggaagagaaaattgccaacctgggaagctggaatgactctcaactggagttcaggagtttctgggagctgattggagaagcggtcaagagtgtgaagctggagaggcctgtccgggggcactgagaactccctctggaattcttggggggtgttggggagagactgtgggcctggaaataaaactggtctcctctaccaccaccctgtaccctagcctgca

SEQ ID NO: 590547 - DNA, 249 bp, Homo sapiens
ttagtggtcgatctctagcaggatccccagctacatcccacatgtctgtacctgcgtgttcatcgtcgtactgcagccggattaccatggcaatctaacacatcatcagtagggtaaccctatcctgtctcaacgatcggtcttagatctccagctcacgttccctattagtgggtgaaccatccaacgcttgtgtgaattctgcttcacaactgatggagccacatgatgtagagcctcatgtgtagt

SEQ ID NO: 590548 - DNA, 101 bp, Homo sapiens
  misc_feature (6)..(6): n is a, c, g, or t
ccccgnagtgtcgttcaagatctgtttcacttggttgtaaatgtcttccagcgtatccccctgtacaatagctgtgaaatgttcagtaaactccatgttcc

SEQ ID NO: 590549 - DNA, 300 bp, Homo sapiens
  misc_feature (20)..(20): n is a, c, g, or t
  misc_feature (34)..(34): n is a, c, g, or t
  misc_feature (43)..(43): n is a, c, g, or t
  misc_feature (63)..(63): n is a, c, g, or t
  misc_feature (200)..(200): n is a, c, g, or t
  misc_feature (240)..(240): n is a, c, g, or t
aattgtcccatttatttatngagagacggaggcnggatgttgncggccaggctggagtgcagnggcggcgatctcggctcactgcaacctctgcctcccaggttcaagcaattcttatacctcagcctcctgggtagctgggattgcagggtgtgtgccaccacacgcagctaattttgcatttttagtagagatggggntttgcatgttgccaggctggctcgaattcctggctcaggngatccacccacctcggctcccaaagtcctgagattacaggtgggagcactgtgctcagca

SEQ ID NO: 590550 - DNA, 707 bp, Homo sapiens
ttgcaaaacacactgtggtattattagaggaacccagattgttaaagctggaatggtcttagacatgatgcagcagagtgagactccatctcaaaataaataaataaaataataagaaaataagaaagttaatcactcatgtgggaacgcctcagtggaaaccactgttaaagcttttggtgtgtttcttaacagtttattcccaggcattgaatttttgctttgttttgcctttcacataatgaacatgtaaaatgtgaagtaggatatgatgtaaaagttatcaataggatcaatcaaaaaaatcattttttagaaattctaaagtgaccagaatctccccctctccaacacaaaatcagtcctccccacctcccccatgtcttacacaggaaacggtgcttttaaatgtacatccagagtacaaacattgtgtatttctgcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggtacttctgcactactcgtttgaaatggcatgcttagtcatgtgttgcttaaacatgaaagaaactggaaaatctgccattaaaagatctcatttttcgagcctcata

SEQ ID NO: 590551 - DNA, 303 bp, Homo sapiens
ccagcagttgagccagccggcatccaattcatttgaataaggagcgatgggacagaacggtaaagggcttttgggagacaggctaacccaggtacactaaatagtccgtgtctaacaaaccacccatttgtaggccgtccaggcttgtcacacctggaagccctggaaattctgtccaatgaaagcgaaagcaaggtacttctgcactactcgtttgaaatggcatgcttagtcatgtgttgcttaaacatgaaagaaactggaaaatctgccattaaaagatctcatttttcgagcctcata

SEQ ID NO: 590552 - DNA, 355 bp, Homo sapiens
aagattgtgccacggccctcaagcctgggcgacacagtgaagagaccctgtcccaaaagaagaaaaaaaaaggaaatatttggctaaaatttactttttacatgaatgggactagttcgaagcgacatagtaataaccttagaggacatgtagaaatggaacacatcagtctcaagattagctctgatgtatcaagtttgtgcagatagtcttaacattagtgtctcattataattctgttttacctgaaattttctgtagccttaagaaaataattgaaaaataggcctggcataaatttttcttgtaaaattatgtgcttcattatgtctgacatatccacttctgaaataat

SEQ ID NO: 590553 - DNA, 416 bp, Homo sapiens
tagcgcaccccgcaccatcctggtgccagcgtacgtgacctcggaagttgaaaaccgcgtgccagatcggcttcatgatctttatcccgtaactaatcatcgaactggtagtggcgagcgtgctgatagacatgggatatgatgatgctgtcgccgctgaatcatctcgtagccgattcaagatcatgctgatatgtgctggatggaacggctgggcgcaaatttatcggcgacgtgagccggacagtattcggaggaggtataggcgctataacgccagaagtcgacagtcaacctgtaccgtgaagcgctgaggctgaccaacatgatggtagacgtgtaggtagtgccgagcctgttggtgagcctgcatggtggcaatgttccaggccgaaacccaaatcaaagaaaagaag

SEQ ID NO: 590554 - DNA, 286 bp, Homo sapiens
ctgcctcaggttgtgataaactaacaggtactgcatataccctccaactgaaacagacacaccaaagaacaacaacaaaatcaaaaacagaaagaagaataaaatggagaacatatatgaagcaatggctttttgtttgtataagtataagtttattatgagacaaagtctcaactcttgtccttccagtgctgggagtgcgaatggcacacatcttgtgctcacatgcaacctcccgtctccggagctaccggggtacccgaggcttcgaaatttcgtaaatcat

SEQ ID NO: 590555 - DNA, 355 bp, Homo sapiens
  misc_feature (33)..(33): n is a, c, g, or t
  misc_feature (65)..(65): n is a, c, g, or t
gaaaaatagttccctgtttaaattccaccatanggccaatgagatatggaaagatgaccaagatnccgtataaacattggtttgccattttattaaattattcctaatgccaaatccttgtataaagaaccccatgatgttttgtaactttcctaattaaaatgttcaaaatgaggccgagccatggtggttcattccctgtaatctcaacactttgggaggccaaggtgggaggatcgcttgagcccaggagcttgaggctgcagtgtgctatgattgcaccactgtactgtagcctgggtgacagagtgagaccctatctgttaaaataaataaataaataaataaaaaagtc

SEQ ID NO: 590556 - DNA, 86 bp, Homo sapiens
acggccgtgtattactgtgcgaaagtggacggtgactacggaccctttgactactggggccagggaaccctggtcaccgtctcctc

SEQ ID NO: 590557 - DNA, 187 bp, Homo sapiens
gtgacatcgtctttaaaccctgcgtggcaatccctgacggaccgccgttatgcccagggaagacagggcgaccttggaaggtccaactactttccttaagattcatccaactatttgatgattatccgaaattgttcatttgtgggagcagacaattttgcctccaacagatcagcagatcccattc

SEQ ID NO: 590558 - DNA, 193 bp, Homo sapiens
cgcacagacacgtacacacacgtttcatagtaatttttcatctataggtttttcttaaaaaaaaaaaaaatccggggtggcacaaagatctcttcaattatctaaacacagcacgcaacaaacagaaaagaacgggatgtggcactttccactggcagacaggctccttaggagacagaggggggtcccggac

SEQ ID NO: 590559 - DNA, 148 bp, Homo sapiens
agctcggtaccccagggaagccaaaagattggacacccctgggctatagcaataaaatgggcacatcaaacttgtgtccacaacaactgacacacaggtttccactcagggggaagttacccttaaggaacacttggcaatatttgga

SEQ ID NO: 590560 - DNA, 296 bp, Homo sapiens
cggagacacttacgattcattttattcttaaaatagtttataaatctttatgatttttttttacaaattaggttattgatattaatcgcaaattttactggtaggtatcttcttgtttttgctatagatagattccatacttatctagagtacctcccattatgccttattcatatatcggtgaaagctattgccctctatctacataaagttacaaatggaatatcttctaggaagacagaattattacttagtctatattgtctagatgatagaatttagtatcattatttaat

SEQ ID NO: 590561 - DNA, 211 bp, Homo sapiens
aaatttggggaaacccccttttggttttaaaaggatttggggtttggggggggtaaaccggaaaaaagggtttggtttttaaggggggtttttcttcccctggggggggggggggcccaaacattttccttgggaagggaccccggggggggtcccggcctttttttccaaaaattttttttttgggtggtttaaaggtttttccctttta

SEQ ID NO: 590562 - DNA, 186 bp, Homo sapiens
tttttttgttgcatttgttttgagcttcttggtcatgaagtctttgcctaagccaatgtctagaagggtttttccaatgttatcttctagaatttttaaggcttcaggtcttaagttcttgatccatcttgagttgatttttgtataaggtgagagataaggatccagtttcattctccgtcgacg

SEQ ID NO: 590563 - DNA, 1261 bp, Homo sapiens
  misc_feature (1016)..(1016): n is a, c, g, or t
agccgccccggttcctggggatgtcttttgtttgggagaaaatgggtttgtgattattgccccaagtttcggcctttctgtgtgggggtctcccccgggactttatttgaaggtctctgggtattgtgtgcgcgcccgctggtgtgggaagagaaattggccctccctcgtccaaagaagatctttgagttttcccggaggttgccttggtgttccacagagggcgtttctcttctcgtctatagagctctactttgccccagggtctcttgtaaggggtttacacatctggcgggggaaaacctctggggggaaatttgtctcttttttattaggtctgaaattgtggcccacggaaaagggatttggaaatttgggggggaattgtgttcgcgaggtgatttctctctcacgggataaaagagagagacccctctgggggaatatatttgcgccccctctgcgcgtgtaaaacttgggggagttggagccccccccccattgtccccgctctcttcatatagagagggggtggagaaaccacgtgccctcaaacacactccgagagtgtttatatccctctgagagagagagatagcccccccgctctatgtgggcgtaactctcacacgggtgtttcgctgtgtctctggggtcacacacaggggggtcccgctggaactctctctcccacaataacccccacacacatcacagggggtttgtccccccaccacactcaaactctgtctctcttccctcttttcacgggcccctctttctttgaagaccccgcgtggaatagcgcggatatttttttctcttatattttcttattaggtgtataactcgagagctcggctcttgtgggctcccacagagattttcaccacatctctccacagcagtttgagaggagattttatagtggttctctatggagaaatttttttaaattttttttttgttaaaagaaagagaaaaaaaactaccacataaattttctaacccagggnccactatattatgccacgctgagaaccacatctttataaactcgccacgagaaattgtggttttggtgtcacgagaaacacaaggttgtaataatttttcaccgccccgagattaatgggagaaaaaaatcacgttctgtctttgtgggttgctctaactaatggaggagtccaccacgttatctgtgagctgagagtcggccccttctgtttagaaaaatattttaaaagtttagtaattgtga

SEQ ID NO: 590564 - DNA, 192 bp, Homo sapiens
gcatatggcaaggccaagcttgactttgacaagcctggtgctgcacacagaattcttattttttctttttatgcataattttttattgcataaaaaaatcactgggagttcccgtcatggcgcagtggttaaggaatctgactaggaaccatgaggttgcgggtttgatccccttggccttgccatatgcaa

SEQ ID NO: 590565 - DNA, 125 bp, Homo sapiens
ataggacatgatcttaagtcctttgtcaagtcagtgcagtggctcacacctatatcaagcattttggtaggctagatggcgggcacgttacttaagctcaggagtttgaggatcaatctggtcga

SEQ ID NO: 590566 - DNA, 384 bp, Homo sapiens
  misc_feature (292)..(292): n is a, c, g, or t
tcaacgctttataacttcaaattaacacacgataaagctcaaaaaagtccaatatttacacaggaaaaaagtacaaaattccccccaaagttcttcagtttttttttttcagttttttaaattacaaagtaataaaaagcttggctctttaattaaaaaaaaaaagggaaaagggggaaccaggggtaaataatttaggaaaacacacacacgggagaaaacaaacaaaaataaaataaaataaaaccaaaagggggtacctagggagggtggggttaatccaaaacccagnccggactccaggctcctcctcagaaggggggacccggggaggggggggaccccaggtgacggtcgggaccggggaagtaatttataactcca

SEQ ID NO: 590567 - DNA, 436 bp, Homo sapiens
  misc_feature (19)..(19): n is a, c, g, or t
tctagtgtcatgtattacnaaacaggtatatttaggtgaacatacaacttcacctttacaaaaaacaaacacacacacacatttctggttataccggtaagccaccatatctttacccaaaataaagaattaggggttctgtccaaacactggcaggcagagggagtggacggcaccaagggacccgggcaacaccaacaacacagacagaagcggccatgcatctcacgtgccgcgtgggaacacagcattctaggtgtgcactgcggggaaacaagttgtcactcagccacaaacgggctctggggcaggtgccgcagggacggcgtacgattggttgacgcatagttctttcaaaatggcttaaattaacaaataaagcagggtaagggagaaacacaaagccagaaacatttaggaaatgatgcataggtag

SEQ ID NO: 590568 - DNA, 350 bp, Homo sapiens
aatctgctcccaaaagcttgaaagccaatatgaggccaggtggtggctcatgcctgtaatcccagcactttgggaggccaagggaggcggatcacaaggtcaggagattgagaccatcctggccaacatggtgaaaccccgtctctactaaaaatacaaaaaaaattagctgggcgtggtggtgcatgcctgtggtcccagctactcaggaggctgaggtaggagagtcattgaacctggggggcggaggttgcagtgagccgagattgcaccactgcattccagcctggcgacagagtgagactccatctcaaaaaaaaaaaaggccaatttgattggggctccttcct

SEQ ID NO: 590569 - DNA, 991 bp, Homo sapiens
  misc_feature (1)..(3): n is a, c, g, or t
  misc_feature (6)..(6): n is a, c, g, or t
  misc_feature (9)..(10): n is a, c, g, or t
  misc_feature (360)..(360): n is a, c, g, or t
  misc_feature (513)..(513): n is a, c, g, or t
  misc_feature (640)..(640): n is a, c, g, or t
nnnccnttnngaatatttatacgtttcgtcaagtggagtgcgaagatggtgtgaggtgcgagactaggacctgcacagcgcgccacgagtcaacaagcgagagtatcaactagatatgtgagagccgacgaagagatggcgatactttgtggatgaataagaatagaagtaggagggaagataaatgaaagtgagggacgaagcgagccgacggcgtctgcgacgaagatcagtattcaactcatcactccaacactcactcgctcactctgtcacgacgcgatacaagctctggataatatcttatatatagcatatctcacattgaaatattaatggtagtatatatgttgatgtatntatacattaattatgtatgatatgagtacgatgttgatgtatgagaaggatagaggagtgaagaggagagatagcgagttcgaacgtgagtgatcataaaggattctcgcggtcgaacacaattagcgagtgttcgacatatcgctgctaatntagtattatccatcatctctactactttattcaatatgaattattatgtgcagtgatgaataagcatgacgttgttgatatactcgtttgatagtaattcaaacaggaacaagaagacattcattangtagtgttagaacatagattatgagtatctgtatttgtgcgctatacgttgtatccgtttagtcgtaataagatgtgtgacgttttactctatattactatagttatatatatatcatctgctactaatactagatagaaccgcaatttaagacgctgtgtatatgtattgactttctgtaaagatttgattgaatagttcgttaggtttagttttatcatgtatgtagtatagatatggtggtaggaagagtactgtggaacgcggtactggtattgttttgtttctgatgtctgtgctctcgaatggttcacgcattcacgccaagtatccacatatgatcttaatgtt

SEQ ID NO: 590570 - DNA, 1383 bp, Homo sapiens
  misc_feature (55)..(55): n is a, c, g, or t
cctcagccattgtctcgaagctggaagccgtcgcgaagacgctgaatctcagggntgaggaagaaggataatggtgttgtcaagatgcaagtgaggaaggaaggcaggaatggtgttcttcagtttgactcggagatctttgagatcagcccctcgtaccatctcattgagatgaaacaaacaagcggcgattcactggagtaccagaagctattggaggagagcatccggccagcactgaaggacatttgtctgggcatggcatggagctgatggtcagcaggagcctcaagggtagatttagatgtctcacttattatgtttagttctgctttttttttcagctcgagtaattgtgttatatactctaaaaaaaaaaaaaaaaaaaaaaaaaaaaaaaaaaaaaaaaaaaaaaaaaaacaacaacaaacaaacaagcaaaaaaaaacaaaaggaggggcggggcgcgcacaagataatcccgccggagggggaggcgcacaagtatttgacggcaacacaccagatttttgtggacaagaggggacgccccactaaggagagcgcgtctataaatgacgacgagcgagagcggcgagacaccagattaatacaaccaacccagcccaagaggggaaaacacacgtgctacacggtggcgacatactgagtgaaaagaagaacacccacacaacagggcgggaggaggaacacaaaatgtggagcaacacaacaccccccacaaaaaatattaacaccccccatgagggagaaataacaacaacacatcgagaagactataaagctcgttgtgttaccaccccccaccggtcatataatacgcgtcgggtgcgcgagaaagaaaattatttggcttccaacacaggaagtatattataccagagcaaacctatattaagccgggggcggatctagtagatcacaataacacgaacgtaactctagtaatagcatagtgcagtcagacgagcgcacatcgaatagagacaacgcgcactaagactgacctacgtagtccagtcattaaattaattacgaaaacaaataaaaaataattctattatcagtccaatcatctaaaaatccaaccaaacacaccctaacaaacaaaacaacacacaatattccagatcactacaatcaactattcaacacaccacaaacatatgaatacagcccacccataactatacataccgtatacaataaacacattactcactcaacacactctaactattataaacatacaacaatagcaataatacttaataaaacacaacttcgaactacgtaaaagcaagatacccatcctatcaccatatcatacactatccacctagacgctgaataaacaacaaa

SEQ ID NO: 590571 - DNA, 217 bp, Homo sapiens
tatatgggtgtataccgcggaggtatatcagtccagtcaacgagccgttacagtgaccctacgaacaaaagcccccaaatgccaagagactttttcttaacctaaaggaagaaattatttgttaattccacgtagagcaactgacatatactagggctattatgtacttgttgtataggagaacttgaataataacttctttaacaaatgagctttt

SEQ ID NO: 590572 - DNA, 103 bp, Homo sapiens
gactcatagaaggactccccgctgactgtgccgacttcttgacgaactgactgcgccggtgaacgcttcacggggttggactgacgacactggctgttactac

SEQ ID NO: 590573 - DNA, 426 bp, Homo sapiens
  misc_feature (343)..(343): n is a, c, g, or t
cgatccttggtagccttaaccctcagcagttgggattaaggcttcacaagtctccttcagagaacacaaatcttttcttatccattcctgtttggttgctacgtcaatctccccctccccagagatgccaaaaaaatcctttaatggtatttgggagccaaactcaacttgttaaaatctcaaattatggagacaatcagcagacacaacctaaccccaattattttggcaggaaggttggtttagaggcagatccagcaatctgctttgggccactctggatggggtaggtgaaataagattggtcactgttaactaattttaatattggattggccattgnttatcactgattaccattctcccctggattttcacccaggactcaaaacttggttctgctaaccctgttcctttatgaggaac

SEQ ID NO: 590574 - DNA, 275 bp, Homo sapiens
  misc_feature (6)..(6): n is a, c, g, or t
  misc_feature (17)..(17): n is a, c, g, or t
  misc_feature (83)..(83): n is a, c, g, or t
  misc_feature (113)..(113): n is a, c, g, or t
  misc_feature (120)..(120): n is a, c, g, or t
  misc_feature (141)..(141): n is a, c, g, or t
  misc_feature (264)..(264): n is a, c, g, or t
  misc_feature (268)..(268): n is a, c, g, or t
aaaaanacaggggaggnaaaggacactttagatggtagttttatggtggcttttactctgtctgtaaccaaagtgtctttgtncatgcaatgaaatgttaaccctatgtctanctttttnctgcatgacttcttaaatgtncaccttaatgccttaattgtccctaacttgtaatatttttgtattaaatttttttaggagttcccttgtaatttctttacaatttaaaatatattaaacacaaagtgtttagtaaagtacagnaagnaaaatta

SEQ ID NO: 590575 - DNA, 582 bp, Homo sapiens
catcattctatacgacaaatgtttcttctaacaaccccacaatatcaccccttaccacaagacctcccttcagcttaatctctcccactctaggttcccacgccgcccctaatcccgcttgaagcagccctgagaaacatcgcccattctctctccataccaccccccaaaattttcgccgccccaacacttcaacactattttgttttatttttcttattaatataagaaggcaggaatgtcaggcctctgagcccaagccaagccatcgcatcccctgtgacttgcatgtatacgctcagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactaattttccattaccttcccaaatcctataagatggccccacccttatctcccttaactgacctcggttttcga

SEQ ID NO: 590576 - DNA, 395 bp, Homo sapiens
atcagatagtcaccacgtgttcatctttaacaaatcccataaacataaggattagctgtgtgtgtgtgaaaaactgtaaatatgtccagtagcgataaaactaaaataactttgattggttgataagtttcctaaaatgtggaggtggattcaaaaccttaggagaatagcagaaatcaaacttcatgcaaccagttcatttgggggctatccttgttgaaatgtatgaacacaagaggctcagcagaaaggactatggaagcaccaataatgtatcactctctcctccctccctgacttaatgcaaaaccatgtgtatttagtaccccgtccgtatgttaaacgatttcctatttagtgggtacattctggcactcatttggtagctattacgg

SEQ ID NO: 590577 - DNA, 296 bp, Homo sapiens
gtattttaatacccagtgtgttaataaggccctttattcagatgattaactcattgtcttatctttactgatttaaaatggcatcttcaccagaccctaaattttcatttgtacacagttctgcttctatactactcttatctattgtggtatttgattattcacctctgtaagagtatgtttgatatttggtaaggcaaatactccttcctttttaaaaaaaatgttgtaatagtttcaggtcagaagtgatttggcaaataataaaaacaaataaaatgtaatgaatttgtcct

SEQ ID NO: 590578 - DNA, 397 bp, Homo sapiens
tgactttcttgaaatggtctatgtctaccctcatccttctcctgattccacacgggttaatctaatatgtatggcgggctacttctatcagatgtccatggcttcttcaaaatcacatgtctatcagaaactcaatatattccattatatccttatcacccaggtattaagccctcagaatcatgattaatctttcttctctctcatccactgcatatccaatgaaccaacagatatattctaattcttaaccttttttctcctgttcccatggcagtggtccattccttcctgtcccctgtaccaactggtacagctgactccctgctgatcttgctggttccaccactggacccatcttgagtccgttcacattgctgtgagggtccaattccta

SEQ ID NO: 590579 - DNA, 841 bp, Homo sapiens
ccatctggaaggagcagctggacttctttgtgcgcctagtgctatgaggtggtggctcctgacctggccggccacggtggaccatgctctgcgccccaggtggccgcagcctacaccattctatgactgctggctagaggacatgcagatgacaatcttctaggtcgctatgccaacgaagcgaacatgtgctcattggccattcctagcggatcctgctcctggcattcctgaagctcagtcgtacgtacgggcaggccgacgatggctgatgctggaatgccctgagacggtcaagcacgctgctccacgaattcctgctctgggtagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagtaccatcctgggcgtggcctgttcgctccgtgtgggcggcggccaggtcagggagacgcccccaggctgcctggcgcggggctgtgtccatccgagggagcccattggacattccgctctccgatttccgtcccgccggggcccatcggcgtaataggggccgaagccggggacctcacggaaggatgaccttgtacagaagctctcccataagctttcccgacacaatgccaggagcaaaggcagaggagcgccaatgccggtgatcttcagagaacagccagagcttagacctgggacccacagaaccccaccagggaaacctcgaggcccacagaccgggaagaccgagacacaaacaaaaccg

SEQ ID NO: 590580 - DNA, 305 bp, Homo sapiens
ctgaccagaggatcccgtgatgttatcgcccaatcacagaatgatcttggcttgggtacgttttcctgcttgtgtaattttgataaataagacgttaatactgttttaatgaaaacagttaaatattgaattatttagtaaaataaccatatatttaatcttaaggtttctactcacctaaatatctgaaattcacaggctataaaatggttgacagggaaataactttacatgatgactcacagttttcataaataatgcaggtaaactattagtataaaataattaggtgtaggggataacat

SEQ ID NO: 590581 - DNA, 597 bp, Homo sapiens
gccaccttgcctgtcccagccccagcagtcatgggtacatgggtccccagctcacctatggattgccgccagtctgcccagctgcagtactcacgccccatgggggatcttggtctgacattcttgtgggagcctagtggagagcagacgtggctttttatgtgtcttgctggggaggtgacttgcatgtgggggacaaggctgtcgcggcaaccttggaatcgagtttgagactaaaggaagacatgagatccctggcttgtccccatgttgattccggacaagggcacaaaggaggcatggccagggacctctgctggccttactcaacagtggtactcatacctgcccacctgccactgattactgcaagggcaccagaggtatgagaaagccgtcctcatgacttacgctttcttattgtagctaagagccatctgaagcagcaggttgctggacaaatgctttagctcgccgtgagcagtaccgtgtggccaagaggtggactcagagccttccttgagctctctgtcaagcgggacgcatgatgttccctcaggactccagtcagttcgagttgaccctcagatactgctt

SEQ ID NO: 590582 - DNA, 262 bp, Homo sapiens
cttgctgcaactggtactgcccattataaaataaacactatttttggcatggcgtggtagcttagacctataatcccagcagttcgggaggtcaaggtgggcgtatcacttgaggtcagtagctggagatcagcctagccaacatggcgaaatccgtccctactaaatatacaaagattagccaggcatggtggcacatgcctgtaatcccagctacttggcaagctgaggcatgagaattgcttgaacctgggaggcggag

SEQ ID NO: 590583 - DNA, 207 bp, Homo sapiens
aacaaggagttggggagacaagctggtcgcacacacacgtgaggtgtgcgccccgtcgttctgcccactccaggcggctatatttatagaggacagacaaatgtcactgcaacaggcggttctgctcccccggagttcttcttcctcatacccgtgggtggttgtaatgacccagggaccggcctctcccccacaatagcagaaaag

SEQ ID NO: 590584 - DNA, 1137 bp, Homo sapiens
agactacgtggattttcaacgtactggttggggatgggaactcgtgcttttctttaacaccttcacgttatacgacgatgcttctgagagcgttaggcaaaagcagaaactacaatactcaggagcaaccggggaaacgctttataacccgactcatggtggccactgttgcacgctttgaacgactgacgtgctggcttgaacagttctttgcctgcactcacttgctagctgcactgaacaggaacaaacacctttcaccttaagcatttgacaagcggccgaccaccctgggctctggtcttcagtggcatttagactgagctgcttaagacagaacagaagtaatacgcatttcctgccataggatagggacaccatgtacacaagctggctctgctcttgacggttaccgaacacattgtctgtatctctgtgcgactgaacgctgcgactcacttgacccactggagacgtcggctctatagtccgacctactcgggacatcaagactatctagtagccaaagtattcaagtcgcaagccagaggttcccatttgtactggcggctacaattcgactaccaaacatgagtactaataggaactcctgaatccataaaattacagcttttctggcatattcaaaattcaccaaaaatctccccagtgggtgcatgacttgttactaaaccacttattggagacaccatcaccggtcaacacctggtctgtttgcccttgcccatttccagctgacaggacctggtggccatctggtagacaccagccttggtgtcggctgacacactcgccccgctgacgaatcaccccaggagacctacacggccgacaagagcaggcatacaaaaaaaagcgaaaacagagcaacgcgcaaccaagacgagccaaattaagacaacactcgcagcacaacataacaaatctagcaacaacaactccaaacaacccgccaacaaggtacgaacaacacaacataactcaacaaacgaaaacaataactctaaaataaaaaatcctaaatgaaaaaaacaactccccaccatcatcctaccagcacacaaccaaacataaaccatcaaactgcatcaatccctcctccttcttctcttatct

SEQ ID NO: 590585 - DNA, 396 bp, Homo sapiens
gcaccccagcgcgagcccttaaccctggaggtggaggttgcagtgagccgagatcacgccactgcactccagcctgggtgacagagtgagactctgtctcaaaaaaaaatgaggccgtatcaggttcgaaaaggaaaagatcgcacgttgccataattgatagaggcttagagtgcgcatatggagcatccaaaagaatgcacagatacttcatccaaattaatagggaaggaattcagctgggttgaaaaaaatgaatatcattcataatagcaccaaaaactataagactatagaaataaatatagcaaaagatatctaagaccattatgaaaagaattttaaagtgttaacataaaagatctaaataggaatgcactagcaagatggcgaggg

SEQ ID NO: 590586 - DNA, 404 bp, Homo sapiens
gcctctcaaaatgctgggattacaggcgtgagtcacagtgcccggcttttctttctctctctctcgctctttctctctttttatttctctctctctctctgtgtgtgtgtgtggcctctctttaaaatagcagctatatctaacttaaaaaaagtctagtctgaaaaatctttgccttttaatttgaaagtttttccctttaagtttactgcaattgttgatttatttggatttattttctaccaccttattatagtctattgtatttcttctgctttttctgtttgctcttctcttccaccaccacctacctcttggctgattaatggttttgtttttcctcttcttctagttttttcttcttagaataactattctatgtctctataagaatatctattcta

SEQ ID NO: 590587 - DNA, 135 bp, Homo sapiens
atctagaggatccctccttgcagacaggagactggcgtcttcaggagagagcagtgcttactgtgagcgagggaagcagtgggatgagtgtgccgggcggagcgaagtgcgtgggttccttgcagacgctttcag

SEQ ID NO: 590588 - DNA, 451 bp, Homo sapiens
tcgtgtgcctgcctggtagatgtacatgacagcagctcagatgagcttctgtcacagtaacttttctactgaacagatgatactaaactctcagctgtgtgactataagcaacttgcccagctctctgtacttcagttgcctccatcttcaactggggattacaaagtgttgaccactcatagtggttgtgaggattacatgatttgatagtttataaagcacttagaacttgtgaagaagagtgcctggggattgcctaaggtcaggagttcaagaccagcctgggtccacatggagaaacctcatctctgctaaaaatacaaaaactaaaccacgcatagtagtgcacacctctagtcccagctacttggggggctgaggcaggagaatcacttgaacctgggaggtggagattgcagtgagccaagattgcgccactgcactccagtc

SEQ ID NO: 590589 - DNA, 255 bp, Homo sapiens
acaaggaataaatgcctgatccttcctcaaaattcattaaccagagaagcctgaaactgtatgacagaggaaaagactaaaaattaaatatcacacctagagagctcagaggaactgtgcccagactatggtctggttctcagatcccattcagtttccaaagagaattatttactaaccattgtctgtgtactgggcccattcattcttccttaagatcatttactgcccttcaaaatggcgtcagtatagata

SEQ ID NO: 590590 - DNA, 966 bp, Homo sapiens
caaatacacagatactgctcagttgggaatcacgcatacctaatgtgcagtttatgaatcttgtcatttaaatttgggatgggcggggggtatctgcgcagctcgtgtggaggacgagattataatatggccatggcgctgaggtctgggcttctgatggtcccgtgcgttcaagtgagctagagcgcgctgtgcggaaaggttcaagggattctcctggctcagactgcccaagtagtccatttcattcttcacctctggatccttcaccagctaaggcgggtcttcggaagaattgcctgcaccacccttcgccatcctaatagtactatctggcaatgagccatcagttatggactgatgagtagggagggaccaactggagaccacattcatttgccaagatgtgaaggcttgggatccaaactcgctggttgatggaaggtgattgtctggacgctctgaggttgattaaaactggtggcagctggatacatttgacatcgccagcaagaaggcttatctggacatattcctgccaggtgaacaggagtctttagaatcgaacattattggcatcagacactgtgacaaggagttcctataaagctagtacggggacctggaatactgcggttgggccaaacccaaaaggagcagaggcaggaggttagaagcttttccggaaaaggacgaaacgtcgcacataggttttttggaagcttgcccggaaggtcggcctcaggataccgcaggtgagtcctgtgcctggacacgcagaaaaaggccggagcggctgcgggcccaagtagatgggcgcttaccggaaagccaaccggaatggtccgtagggcaccggcggccaccggcactggcacgggggcgcaaccagaaaagcgcacggggcgagaggggcggaccactcggggaaagacacatgggcaacgtgtctcacggcgtccactc

SEQ ID NO: 590591 - DNA, 232 bp, Homo sapiens
ccgcgtagtagctagtcagaacactgatcaataaggtcagataggtcatggatgtagtacgtgaagacgggaggcgatggttgtctccaaagcacagcaagtactcattctgggcttggatggccttcagcttattctccgggtacttggcttggcgcttctccttcatcttctcaatcctcttcattgagctcctccggacagtgtttctcctcaatgcggacattggccg

SEQ ID NO: 590592 - DNA, 1179 bp, Homo sapiens
  misc_feature (196)..(196): n is a, c, g, or t
  misc_feature (284)..(284): n is a, c, g, or t
  misc_feature (324)..(324): n is a, c, g, or t
  misc_feature (439)..(439): n is a, c, g, or t
gccaaaatgggtacaatggtacaaagatctcatatcaacattgtcgtcattggacacgtagcacttcgggcaaggtccaccacttacttgtgctcatcttgatctatattcatgcggtggcaatcgacgaaaagaaccgattgacaacaatttgagtaaggcaggctgcatgagactgggcaaagggcttccttcnaatgtagtgcctgggctcttgagactaaagctgtaaagcctgagtcgttgaaccgtggatatcatccattgtgagtactcttccttgntggcaaacctttgtagcaaccagtcaacgttatctattgntgtactactcagttgactggccccacggacatcaagacgacatttaatcaacaaagcaatgatttacaggggtagcactcgtcacggcttgatcgtgttgcttgtccgtgagttngttgcgtgctgtgtgattggtgaatttcgacacgctggtagtcgtccaagaagtgggcagtacccgatgagcatgcccattctggctgtacacactgggtgtgagaaccaacgtaattgtcggggttaaccaaatatggattccacatgagccaaccgtacatgtcagaagacgatatgaggaacatcgttaaggaagtcagcacttacagttaagaaacattggctacgaccccgactgtagtagcatttgtgccaattgcgtggttggaatggtgacaaccatgctggagccgacgtgcgtaacatggcgtaggttcacgggatggaacagtcccccgtaagggatggcaatcgcccgtgggaacaaggctggtagagggtcctggattgcattcttaccacaaatacgtccaatgggcaaggccttttggccatagctctcccggatgtttacacaagtgcgggcaccgggacagtcctgttgggccgagattggaacacaggcgggtcctacaacccggcttttgtgggcccccattggttcccaaatcagttttaaccgagcagtactactgcgcgaatgtgcacaaaattttgtgtagacacctctggggacacggagcactcgatacaaagcgttatgaagcagtcggaagacagattgacaaaaagtacccgtgaacagtctacacttcacatacgatcaacagcaagcacacactatgatgtagcacatac

SEQ ID NO: 590593 - DNA, 105 bp, Homo sapiens
tagaggaggtggacagcacaggtaggcacgctacacaggcacagaccccacgcacccctacacggggcaggcagctcacacaggtcacagacccctacgcacccc

SEQ ID NO: 590594 - DNA, 105 bp, Homo sapiens
atgttgatttttatacgcgcatctttttccaatcacaatttcaccaccctccatcccccatttcccagtctgcattcatacacagtgctacaagtggcagaacag

SEQ ID NO: 590595 - DNA, 260 bp, Homo sapiens
cacgagcgccatgtagctggattccaggttgtacaccactcctggctgattttggtattttcagtagagaagcgtttttccatgttggccaggctggcctccaagtcctgacctgaagtgatccacccaccttggcctcccgaagggctaggattacaggtgtgagccaccacacctggcctcaggtaatattcgatgaatggtgagagagggaagagggagaggatcaggaaaaattataagtacttcgggcgctcgtg

SEQ ID NO: 590596 - DNA, 263 bp, Homo sapiens
gtaaaattttcccttttttccggggggggcggaattgtcccatttttttcccccttttttttttcaaaaaaaaggccttttttttcccgggcctttttttccttttttttaagggccggttgggaagccattttttttttttttcgtttaaaaaaaaccttttttgggcccaggggcccctttttttttttaaaactttttttttttaaaacttttcaaaaccaaaattaaatggttgagttgaccccccttttcccccccca

SEQ ID NO: 590597 - DNA, 317 bp, Homo sapiens
ctgattctatgaggatcatttcgagtagtggatcagaggaggtagaagggttgggtccggagaactgctgcggttactgttgctgctgctgatgatgtggtgtggtgatggtggtggtggtgtccagtgaggctgctgatgatggtgctgctgtccagcagggcagaagactgcagtggccgggtgtccagtgttgttgggcccagatgggagtgaactgagctcaccactgtccttgctatcagtcccagggccgccactcactgtgatctcagctgctggggcagccattccctggacttctgcacgtgcaggga

SEQ ID NO: 590598 - DNA, 765 bp, Homo sapiens
cataataggataggaagagcctcatatgatctgcagcagctcatattccttctgaaggaaactactacctaggagaatctaagctatagcagggagtgatttatgcaaatttgagactaggcttcttagtgtcacaattcagttcctcgcaatgcaagccagtcttcatttcaatgagggccacactgcgaacctctagcttaacatgagataacgaaagactggctcaggagcagggcttgcctcgaggcatggtggatcaccgggaggtcagtagttcaagaccagcgctggccgaacatggtgaaaggcgcacctctagtaaaaatagtgtatatcttggtgtgtcttccgtgtttatgtgtgccaagggagtattttcagaagagttcaaaggagacacaattaagtcagagatggagcaaaccagtgccatccagtctttatgcagaagtgaaatgctgcaaagggaaggagattctgtatatgctggtaactacgccggcaagagcacatgggtagcagggaagaagtaacaaaaagagaaggagaatactggaagataatgcacagacatgaagggactaggttaaggagttaactagcccgttgtacaggattaactagttaaggcttaatagcagcaagatattaaatatgctaacatagctatggaggaattgagggcatgcacccaggactgatgaggtcgtaacaatagaccaagtgtggcgaagaaagaatgcaaaaacgacaaaataagcg

SEQ ID NO: 590599 - DNA, 176 bp, Homo sapiens
taatggacttgggatttttggtttaaatgggcctcctggggatggggtgggacccttagctttttagcctccttttaaagtaaaaaggtactggggcctgtttggtaaaccctttttaaaagctttggttttcagttttgcctttattaactttccccccccctgcattcaggcca

SEQ ID NO: 590600 - DNA, 228 bp, Homo sapiens
ctgaagatcatcatcaacgcccagtccctgcgcattgccgagtattccttcaagctaggcgcccgacagcgggcgcaacggaagtagacaggcgtgcacaatgccaacatcatgaaactgggcgatgggcttttcctccagtgctgcacggaggtggcagaccgctaacctcagatcaccttcgagaacatgattgtggatgagaccaccatgcagctagtgtcccgg

SEQ ID NO: 590601 - DNA, 293 bp, Homo sapiens
ttcaattaggttggccgagcattttgtggctaggtagacctttgtttatcgatggcagaacaggcttctctagagggatatcaagcaccgccagttcctttgagaagcaagctgtggctcgtagcgttctggcgagcaggtttgctgatttaactatggagagttagagctaagcatagtgaggtatctaatcccagtttgggacttagctattgtgtgttcagatatgtgaaagccactttgcgagtctattttgagtcaactggagtttcttacaactcaagtgagatcta

SEQ ID NO: 590602 - DNA, 343 bp, Homo sapiens
gacaattgacaatctggactaccccaagatggcacccaagtgtttggcttctggctacctaaggttaacatgtcactagagtatttttatgagagacaaacattataaaaatctgatggcaaaagcaaaacaaaatggaagtaggggaggtggatgtgacacaacttccaaattggctctttggaggcgagaggaaggggagacttggagatagttttgctttggggtagagctctagatctccagcatccgcttcccttagcagtctctgtctcaaccagagtgatgagagaaccacagagactagaccctgtctagaggatgtattgttgctaattcgtgc

SEQ ID NO: 590603 - DNA, 112 bp, Homo sapiens
tccggcctaggctgcggcgagtaggagaactgggggaagtgggtcgctggtccagctccagtaagcccaaggctgtcatagcggtcagggggtgtgattgtgatggactggg

SEQ ID NO: 590604 - DNA, 883 bp, Homo sapiens
aacatcctgcaatacacaagacagtccccacattgcccccccccccaaaaaataaattagcttagccttaaaatgtcagtagtgctgaggctgagcaacaccttggattaacaggtttcactgctgatgggaaactttttagttttttaaacaggggccttgcatctgttgcccaaggctataagtgcaggtcacttgagattgattacgcatgcatgtgacaggtctttgaaacttcccgtgaggtttcaaggactaagctatccgtgttactacgaggccttcccccaggaagaagcgtggaagagctagaccaagtgccaaaacgcactaattctccacagtgtaaattttaagaaccactattttttggcggacaaacactgctgggtgctcattaccgctggtaagttcaggcccacaagtggaggtgggtttctggcgaaaaaacgtcattttaacgcacatcaaaagttagaatcccaatgttcacaagttcgtgggaccccagtaccacaataatagcaccacaaacgggtattgtgacggaggacacatgttagacgattatataggaccgcttgtgcatcataccaccacacacgataacgaaacacaccccgtgcacgctgtgagtaaccacacgacacccaaggtaaacacccccccggcgaacaggagacaaaagaccccagagaggtggtaccaagagcgccacttgccggcgaacacgggaggcacgaccagataggggtcacccctggagcagccgacagatcccctcggtaggaggaaacagacggtacagccgctagaaagcacgcaaagaccccagcagggaggggaaacagggaaaaaatccccccagtgtgggggcccagac

SEQ ID NO: 590605 - DNA, 282 bp, Homo sapiens
acattcccttatgacaaagcctaatccatagcaaggccctaactctgttcagtgttatgaaggctgagagaggtggggatgctgcagaataaaagttgaaagctggcagaggtcagttataaggtataaggaaagtcacccccataaaagtacaaggtgaagcagcaagggctgatatagaaattgcagcaaaatctccagatctagctgaggtaattgatgagggagtttacactaaaacagatttcagtgtaacgaacagcttctactggagagatgcca

SEQ ID NO: 590606 - DNA, 2028 bp, Homo sapiens
  misc_feature (5)..(5): n is a, c, g, or t
  misc_feature (7)..(7): n is a, c, g, or t
  misc_feature (10)..(11): n is a, c, g, or t
  misc_feature (1836)..(1837): n is a, c, g, or t
  misc_feature (1844)..(1844): n is a, c, g, or t
  misc_feature (1847)..(1848): n is a, c, g, or t
  misc_feature (1869)..(1871): n is a, c, g, or t
  misc_feature (1875)..(1875): n is a, c, g, or t
  misc_feature (1887)..(1887): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagagcaaaaacgaacggaacgaggacggaacgactgacggacacgactgaacgacggactgacggacggacggacggaccgactgacacgaacgactgacacgactgaaccgaacgaacgactgacctgacctgactgacactaacgttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590607 - DNA, 332 bp, Homo sapiens
  misc_feature (49)..(49): n is a, c, g, or t
  misc_feature (291)..(291): n is a, c, g, or t
ggttgcagtgagccgagattgcgccattgcactcccagcctagcgatgncgcgagactgtgtctcaaaaaaaaaaaacaaaagaaaaagagaaagaaaatgcatttgggggatcctcagaaaaagctactaattacactaacgggctggcaaccagctgtgttatccacattctagggttgagtatcatgacacaccatagtttaagaccatctgggctgggcacagtgcctcacgcctgttctcccagcactttgggagccaaggcagaaggatcacttgagtctaggantggagaccagcctgggcaatgtagggagattccagctctat

SEQ ID NO: 590608 - DNA, 924 bp, Homo sapiens
  misc_feature (3)..(3): n is a, c, g, or t
  misc_feature (287)..(287): n is a, c, g, or t
  misc_feature (295)..(295): n is a, c, g, or t
  misc_feature (303)..(303): n is a, c, g, or t
  misc_feature (310)..(310): n is a, c, g, or t
  misc_feature (313)..(314): n is a, c, g, or t
  misc_feature (319)..(319): n is a, c, g, or t
  misc_feature (322)..(322): n is a, c, g, or t
  misc_feature (325)..(325): n is a, c, g, or t
  misc_feature (340)..(340): n is a, c, g, or t
  misc_feature (344)..(344): n is a, c, g, or t
  misc_feature (355)..(355): n is a, c, g, or t
  misc_feature (403)..(403): n is a, c, g, or t
  misc_feature (462)..(462): n is a, c, g, or t
  misc_feature (464)..(464): n is a, c, g, or t
  misc_feature (469)..(469): n is a, c, g, or t
  misc_feature (488)..(489): n is a, c, g, or t
  misc_feature (498)..(498): n is a, c, g, or t
  misc_feature (512)..(512): n is a, c, g, or t
  misc_feature (526)..(526): n is a, c, g, or t
  misc_feature (529)..(529): n is a, c, g, or t
  misc_feature (532)..(533): n is a, c, g, or t
  misc_feature (538)..(539): n is a, c, g, or t
  misc_feature (541)..(542): n is a, c, g, or t
  misc_feature (548)..(548): n is a, c, g, or t
  misc_feature (555)..(556): n is a, c, g, or t
  misc_feature (584)..(584): n is a, c, g, or t
  misc_feature (655)..(655): n is a, c, g, or t
  misc_feature (923)..(923): n is a, c, g, or t
cangtgggaaagtcataagctcttcccccacatcccccaacttcattccccacacacaccacagatagtttatgagctaattctcaactctcctggtgcacgtatccaggactctattgaattatttatgaagtcaggcctcaattcccaatagtttaaagtaatgaaaaagaaagatatgaggaaatacattcaataagcaaaaataaaagaactctggaatctgacatatttcatgttatgaaagtaatggctgacataatgtacagggacattaaaagtgagtnagtaacanacaaaganatcagantgnnctgcnggngcntccagaataactgcnagtnttcctggagtnttcattctacatctactcttcgaggttctaacagagttatagcttctnactgcgtacctgagattagaatcaggttaaaaatgcttaaaacactttcaattatgtcngnggggngagatgagaacaaaaaagnngcccagggngagagataagagtnatgagcaggacagnacngtnnggggnncnncatgtnaaaatgnnaaagaaatgggactgaaccaaaaaagcnagggggggaggggagcgggagggagaactgggagagagaagttctggcccttcctgtgaagagtccgtgtnaccctgtgtaaattctctatgagacccttctaaggggctacagtgttcatgttatcttcacaggttcacccaacagtaatgataaccaagtggcaggcaaatcccagtgaacacagtaagaagtcggtgatttctttgtcatctttccttagagagggcacatacactggaaatgtggccaattccgctggctgagccaaatcaatctgtggtagaaaacacccaaaaatggcccctactcactccaggggggaaaaatatacaaaanc

SEQ ID NO: 590609 - DNA, 2020 bp, Homo sapiens
  misc_feature (1828)..(1829): n is a, c, g, or t
  misc_feature (1836)..(1836): n is a, c, g, or t
  misc_feature (1839)..(1840): n is a, c, g, or t
  misc_feature (1861)..(1863): n is a, c, g, or t
  misc_feature (1867)..(1867): n is a, c, g, or t
  misc_feature (1879)..(1879): n is a, c, g, or t
atgaaatacatctcagggccaaaccgataggaaacgaggcgtgcctcgacggatggcaccgacagcccccaaccgggattccgagcaccggagctggctgctgctcccatctttgtgagcaagagtttatatgcgaacagaggtgtgtatttctgacaactttctggtgcacgaataaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590610 - DNA, 421 bp, Homo sapiens
gacagtctttgtctaccacccactaataaattgtacttaaatgttccaacatatgtttctacttcattaacaatttttctctaaattttgttcctttgttccttcacccatcatgtaccatctgtaccatactgatttgtacgtgcattacttagtaaaactaatgcttaagtagtctatctactcaaaagtgtaaggcactggccaggtgcagtggcttacacctgtaatcccagcactttgggaggccaagcgagcggatcgctacggtctggagttagagaccagcctggccaacatggtgaaacctagtatatactaaaaatacacaaaatagcagggcgtgatggcgaacacatataggtcccggctactagaaaagatagaggcgggaggatagaagaggaacgggaggacggag

SEQ ID NO: 590611 - DNA, 1293 bp, Homo sapiens
  misc_feature (1101)..(1102): n is a, c, g, or t
  misc_feature (1109)..(1109): n is a, c, g, or t
  misc_feature (1112)..(1113): n is a, c, g, or t
  misc_feature (1134)..(1136): n is a, c, g, or t
  misc_feature (1140)..(1140): n is a, c, g, or t
  misc_feature (1152)..(1152): n is a, c, g, or t
aaaaaagattaagggtctctttgccatgcttttcatcatatgcaccaaatgtaaattttgtctcggtgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590612 - DNA, 435 bp, Homo sapiens
  misc_feature (133)..(133): n is a, c, g, or t
  misc_feature (346)..(346): n is a, c, g, or t
  misc_feature (395)..(395): n is a, c, g, or t
gcgaatcactagtgattccccaccaagcctgtatgtgtctgagagaaatgaacttcttattcagttttatcagacttaagtttaactgcagataggtttattggtcactacatattcaggccaaaaaaactgnctacaactacagaacagcctgtcatcatcacatttcctgtaaccacgcgtttaaaaaccaccgtgggctcttgtcaccacacagtgtagaccgacggggactcttggagggccaatattgttcaaagtgactttgtattagccggcactgttatcacaaacatcactcgcgatgggagtttgcacgccacaatctcgatcatcaaaatctacnaagagggaaatttggcgatacagcaggcgggcaagaacattagtgccangctgactgtcgtctgcgagcagtgccctctcctcagaaga

SEQ ID NO: 590613 - DNA, 996 bp, Homo sapiens
  misc_feature (5)..(5): n is a, c, g, or t
  misc_feature (7)..(7): n is a, c, g, or t
  misc_feature (10)..(11): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaaaaaaaaaaaaaaaaaaaaaaatttttgggcggcaagcgaccctaagaaaaggtgtgtcagagccacaccgatgtgggacagccggggccccagtagagtcaagagaacaagaggggcacaacgggggagccaagaagaaaccgcggggcaagaaaagggcggcgagctcaccacacaaaaaaaaaagggccggggggaacacagagtgttggagcaaccacaagaggagtccggagagacaaagagggacacaaccgagaggccaaagagagcgaaaaaag

SEQ ID NO: 590614 - DNA, 968 bp, Homo sapiens
  misc_feature (23)..(24): n is a, c, g, or t
ttatggatatgtcgaccacgcgnncgagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaaaaaaaaaaaaaaaaaaaaaaatttttgggcggcaagcgaccctaagaaaaggtgtgtcagagccacaccgatgtgggacagccggggccccagtagagtcaagagaacaagaggggcacaacgggggagccaagaagaaaccgcggggcaagaaaagggcggcgagctcaccacacaaaaaaaaaagggccggggggaacacagagtgttggagcaaccacaagaggagtccggagagacaaagagggacacaaccgagaggccaaagagagcgaaaaaag

SEQ ID NO: 590615 - DNA, 415 bp, Homo sapiens
  misc_feature (4)..(4): n is a, c, g, or t
  misc_feature (26)..(26): n is a, c, g, or t
  misc_feature (48)..(48): n is a, c, g, or t
  misc_feature (85)..(85): n is a, c, g, or t
  misc_feature (126)..(126): n is a, c, g, or t
  misc_feature (146)..(146): n is a, c, g, or t
  misc_feature (227)..(227): n is a, c, g, or t
cttncttggcaattcagaagaccacngaacccaagactcatatcccantttattagatggccagatgggacacacactcatcagncttagtgagcagcccaatcccagagggaacccataccttcnccctaggggctgggcgcggntgtctcgccctgtaatcccagcactttgggaggccaaggcggatggatcacctgaggtcacgagttcaagaccagcctganccaacatggagaaatcccatctctactaaaaatacaaaattagctgggcatggtggtgcatgcctgtagtcccagttgctcgggaggctgaggcaggagaatcactcgagcccgagaggcggaggttgtggtgagctgagattggccattgcactccagtctgggcaacaagagtgaaactctgtctc

SEQ ID NO: 590616 - DNA, 168 bp, Homo sapiens
cagcgtggatacactgggggtgtatgagttggtctacggaatcgcggggtatgctgttcgaattcataagaacaggaaggttagaagtagggtcttggtgacaaaatatgttgtgtacgagttcagcgtgagagtgcgtcatatgttgttcctatcgtagattgtagt

SEQ ID NO: 590617 - DNA, 419 bp, Homo sapiens
agcggccgcccgggcaggtactatctttaaacagtgtaagttgcttctattctgtgtgtcaaaagctaaaaacaaattattgtataacctccgctccttccaaaaagcagaacaaagcaaccatccaccttatggagcaatgattcatgaatgaaggccacacatagttactaaatagaaagctgtaactaagtatcctgacaacagaaacagaggtgaaatgaaagaatagacactaaagacatgcggtctgcaaggaaaatattagactgaggtaagttatttttaaacaaaggggaaggagggagaaacaaacaaaaaaagaggcatgaccagtcaatcaaatatcagcttaaaagaaaagcttgtgttcataatatatgcctaataatactggttagcatttactcgacaatttg

SEQ ID NO: 590618 - DNA, 4845 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (4653)..(4654): n is a, c, g, or t
  misc_feature (4661)..(4661): n is a, c, g, or t
  misc_feature (4664)..(4665): n is a, c, g, or t
  misc_feature (4686)..(4688): n is a, c, g, or t
  misc_feature (4692)..(4692): n is a, c, g, or t
  misc_feature (4704)..(4704): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590619 - DNA, 175 bp, Homo sapiens
  misc_feature (96)..(96): n is a, c, g, or t
tttgtctacagtctttagctttgttaagtcaccatcccacaaataaagaccctatgaggctgaaaaaactaacggtcagtcgtctcagatacgtgnaataaatccagttgactgtggtgtattacggacagagtcttctgggctcgagaggaccgtgtaggcgaaggggaccggg

SEQ ID NO: 590620 - DNA, 1026 bp, Homo sapiens
gctagttctagatcgcgagcgcccgccctttttttatttatttttgggctctaaagggggtaaaggggatgacaaccggtagatacgggccctcactacaaagcttaggggagactaacgacctaggccaatggaccacaactgacaaaaggcaacacactagatcccacaaaacaagacaacgacacaacattttcgcaacgaacctgcaacccgcactagacacggcagcccgcaacccacatcagacgcgccaagatcacagccacacaaggacgaacataaacacaccaggccacacacaagaaaaagaaagacagggaaccagcggcagacgtcaaagcacaacagacaagaacagcggacacagcaaatgcggcaagagagaacaaaagctaataagaaaaacacaacacgacacaacgccacgaacaagacaagacaagacacaacgacgccaacaaacgacaaaagaaaaaacgagtgacgaacaaaaaaagaaaagaaaaagaaaaaaagcacagaacacaggtcgatacaaaagcaaagaacgaagatcaggcagacccgactaaaagatgaaggcaccaagccaacacacgatacgcgcgattcgaaacgaagagggaaaaaagaagaaagagaaaccgcgagaacagcagacagcaccacatacaacgacaaagaacaagcacgacacgatagagcgacaatccaagagcgagcaaaaaagacaaacgataacaagacgagaggagagcaaatccgacacgagagaaaatcaaaagctagcgaaggtcaaaagaagacacagacctgaaaagaagcgcacagaaccaatgagcgagctacagagagaggaaggaacaacgacacctagaacgcaaaccacacgacacacaacagcggtcaaacaaagagcacaacagagaaaacgaagcaggacccagacaaacgactcagcaagcacaatcaccgacacacgagcaaaacaccacagacaaaagacccaaatagaacggaccc

SEQ ID NO: 590621 - DNA, 799 bp, Homo sapiens
  misc_feature (5)..(5): n is a, c, g, or t
  misc_feature (7)..(7): n is a, c, g, or t
  misc_feature (10)..(11): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgtgccatcattaaagtgtttcgggggtgttacgacataaaagtccacctatactcgtaacgtagtagcaacg

SEQ ID NO: 590622 - DNA, 589 bp, Homo sapiens
gataaacttcggatgtgccttatgtgtaaaaaaactttttttcctttccatgcttccagacagtgtgcccctcagactgttggctggaggttgactagggtctgaattgcgcacagggccgtgaaggtgcggcttctgttactgaatatgagccctggagacccggatctgacagcgggagcttcgaggggatgtttttccggagcttcgagaatgatggttttcaaagaaacacttttccgcgggtggcgctcagagtgggtctggaacccggcggtgcttccgagcgctgtcttcggcttgaggcccggttctgatgcagactcttgactctgggcatttcctatgtgtctgtgtcctcatcgctgaaatgggcatagtagcggtgccccaagtgccgacgggcccacacccgggctctgggtgtgctcacgatgggggtcaggacaggtgcaaactgggacacaggaggcgcttcccagagcccaaaggcgtgcttgttccacagaccctgggtttgctgtgaagaagggtcttccacagaccgaaagtctggtactgacccttaggggggaaggattgtggctcc

SEQ ID NO: 590623 - DNA, 4692 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (4500)..(4501): n is a, c, g, or t
  misc_feature (4508)..(4508): n is a, c, g, or t
  misc_feature (4511)..(4512): n is a, c, g, or t
  misc_feature (4533)..(4535): n is a, c, g, or t
  misc_feature (4539)..(4539): n is a, c, g, or t
  misc_feature (4551)..(4551): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590624 - DNA, 3585 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggtgagtgagtgcagacagatggggcctggtgcccttgagcagttcccgggtctcagctgccacacatctcatagccggtgatgctgggggaagcttacgcagtcacagtactggcttcttcctctttttctttccatacaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggtgatttattatcttgccaagtttaggctgggcatggtgactcatgcctctaatcccagcattttgggaggctgaggctggtggatcaccggaggccaggactttgagaccagcctgaccaatatggcaaaacctcgtccctgctgggaatgcaaaaattagccgggcatggtggtgtgagcctgtagtcccagctactcaggaggctgagacaggagaattgcttggattcaggaggtgggggttttagtgggccgagatcacgccattgcactccagactgtgcgacagagcgagactctgtcaaaa

SEQ ID NO: 590625 - DNA, 803 bp, Homo sapiens
  misc_feature (87)..(87): n is a, c, g, or t
  misc_feature (113)..(113): n is a, c, g, or t
  misc_feature (251)..(251): n is a, c, g, or t
  misc_feature (256)..(256): n is a, c, g, or t
cgtcgggttacacatatgtggctctcctgtacttgaaagtgtgaaagaaaagttttcctttgaaccaaaaatcccatcacctagaanagggggtgggaacccaccaacacctntcagcccattcaatttttctcctggggatttctggggaagaggggcttccggcagcacagcaaatcctcagacacctgtggaatacccaatggaaacaagtggcataaagcatattgatctgacgggggggggggaancatcnggaccacttccaatacaacagccaaactctgggccatacaaaaaacaagcttttcccatgatctccaaacggccagagcacctgcgtatgaatctatgacagagcaatgcttttaatgaatttaaggcgaaaaagggtgacagggagatgtgtgagcatcctgcaaggggaaaccactcacagtgacagtttgcagaaaggcaatgtcattacctaggacacttcagacaccgggaaaataaccggggattttaaaaatcaatgcgtgggggcaaaaaaaccttaaggcgaatgagatgggtgacctctcagggcctccagttaattggttcctcgcagctcttcttaaccttatcaaggatttcatgggggaggacttcaaactgacgtgattaggggagaggggtgcttcttgaagctgggggggtcttggtggggggaaaagggggtatcctttccttgcggcggggcaaaattccctttgatcctggacctagggcctatgaggtggacgcgggggaaatatttccgcggaacggaacgccgg

SEQ ID NO: 590626 - DNA, 4211 bp, Homo sapiens
  misc_feature (4019)..(4020): n is a, c, g, or t
  misc_feature (4027)..(4027): n is a, c, g, or t
  misc_feature (4030)..(4031): n is a, c, g, or t
  misc_feature (4052)..(4054): n is a, c, g, or t
  misc_feature (4058)..(4058): n is a, c, g, or t
  misc_feature (4070)..(4070): n is a, c, g, or t
tcagtttctacacaggacatccttcaaaggctacaattaaggatccacctaacttttcagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590627 - DNA, 459 bp, Homo sapiens
tgcgcagccatcgaatatggcgagagcatgcagcagcgcgtcgacgagcagctcgaagcaatcaagcaaaatccggccttggtacgtgcgttcttcaagcatccaagtgtcgcctacatttctgacttatgagtaagtaatgcagtcgagcgagatatacaatgaaattcaatttcatcaaggtggacgtgtctgaccaagtcgcccgactcactttggatgacgcagacagtcacaatgctctgaccgaaggaatgcagcgggaaatgatggttgcactggaatcctttaaagaacgcgacgatgtcggagcactcattatcacaggcagtggaaaggctttttgttcgggagcagatctgaaatggcttaccaaccaaagtaagtcgggaccttgcgtcaatcccaaggcccttcagatgctggatgatcttgccaacatggtgtgctgcgctgcta

SEQ ID NO: 590628 - DNA, 1515 bp, Homo sapiens
gaattctacgcagcgtcctgaggcgacccagaacaattgattattgtaatatgtttttcttctgattgttctctgtatgtgatagtgagtgagagaatgatactaatcacatatattttattcactacatattatatctgactacaacaacaaaaatctatacatatctatccataactatatctataaaataaaaataaacaaaatttatacaaataaatcatgcataataacaaacacataagtctgtttggtcagtacgagacgacagtcagcggataggcatcgccgagacgcgccggtcgatccagtcacagcagcctcgtcggcacagtctgcggacgcagtagagcagaagtcactgcgcaaccgtagaactctagctaagacaagaataacaggcgttagtaggacagtaggaggagagcagcgaagacagccaggacaacgccgcatcagctcagagcacgtggcctccgacagcacgcaaacggcagcctccagtccaggctcgacgtcgaagactaaccgcaagaagagcgggcgacgccgaggcgcagggggaggcaagagagaagagcagagaggagccggccgggagcgcgaggccagcggcagccgccgaccaaaggcacgagcaagcaagcagcagaggcagaggacaagagagcgagaacaaggcacaagcaccagaggcgcaacgaggcagacacggagagacgcaaaaggggacaaggcagacggcagagcagagcagcaaagagcagagagagaaccagaagaatcaggacacggagcaagcgcagaccaacaagcagagaagcacacgcgcagcaagcgcgagccatcgcagagacccgaagcaggcccagaccagcgcacacgcagacgcgagcggagagcagcgcagagcagacagagaagagacgagcgccgcggcaagcggagaagaacagcgcagggcaagcagcagcaataggcgcagaggcgcgagaagggaccagaggcgagaggacaggagagagaggacagcgaggcggaagagcaggggccaggaagcaggagaggagagaacgcacggcggcgagagcaggaagagtgaccgtgaagagcgaacacagagacgacgcacaggccggcgcgcgagcagccgcgagagagagagagcaagagcaggggaagagccgagagggcaagaagaagacaaagcacgaggaggagagcaggaggacgagcgagaaagcaggagagaggcacgagacgaggagagagaagctagagggccgtaggcagactgccggcaggaggagcgagcaggggagagagaaagagaggagacggcggagagcgacagggacgggcagggcagcagcgaggctgggtcagatcgagaagacgagagcggagaggagggagtggagcaagagcgccagggaagcagcaggcagtcaggaggctgacagagagggcagacagcgagccaagggcaagcgagagagacgcgaggagcagcaa

SEQ ID NO: 590629 - DNA, 342 bp, Homo sapiens
  misc_feature (61)..(61): n is a, c, g, or t
  misc_feature (152)..(152): n is a, c, g, or t
  misc_feature (168)..(168): n is a, c, g, or t
  misc_feature (220)..(220): n is a, c, g, or t
  misc_feature (245)..(245): n is a, c, g, or t
  misc_feature (254)..(254): n is a, c, g, or t
  misc_feature (283)..(283): n is a, c, g, or t
aaccaataagaatttctaaaggaaacctgatcttgctataaattgctgctgcttaaatggnaggccaactggtcagctgctgatcagggtgtcttaggctgaaggagttggagaccttgtgctaggtaggtgaaccagaaaccaccctggcnaccaagactcgctccnaacctggttcccggcaacctcaggtccttcctcgcccaggctttcacccttnttacagaaacttacctcggtctggntaccccacnaccagcagccttgtgcaatatttattggnttatcaatttctcccgtctccttgtcccaaagtaataaatcatgtttaataaaaaaaaa

SEQ ID NO: 590630 - DNA, 166 bp, Homo sapiens
catcctgggatactgctgcattcctctgccaggtagtcctctccatctccgagccagctacagcgagcattaacccctctcctgcttcgaatctcttacctcctcagattctgacctctaaatacaggtttaaagggctctggcaaatagatctagccccactgag

SEQ ID NO: 590631 - DNA, 300 bp, Homo sapiens
  misc_feature (88)..(88): n is a, c, g, or t
  misc_feature (214)..(214): n is a, c, g, or t
  misc_feature (218)..(218): n is a, c, g, or t
  misc_feature (226)..(226): n is a, c, g, or t
  misc_feature (244)..(244): n is a, c, g, or t
  misc_feature (247)..(247): n is a, c, g, or t
  misc_feature (250)..(250): n is a, c, g, or t
  misc_feature (266)..(267): n is a, c, g, or t
  misc_feature (272)..(272): n is a, c, g, or t
ggcccagttcgtgaggttcgacagctacgccgcgagttcgagagagagccgcgagcaccgtggatagagcaggaggggccggagtatngggaccggaacacacagatctacaaggcccaggcacagactgaccgagagagcctgcggaacctgcgcggctactacaaccagagcgaggccgggtctcacaccctccagagcatgtacggctgcnacgnggggccgnacgggcgcctcctccgcnggnatnaccagtacgcctacgnnggcanggattacatcgccctgaacgatgacctg

SEQ ID NO: 590632 - DNA, 185 bp, Homo sapiens
tagctcggaccgcgattgctctgagtcctcgtttattcactcagttggtttatagagtacctttttatgtgtcaggtctgttggtagggaaatagcaataaatagaaaagacaaaaaaatttgacagtcaaactagtaaaatatataaatacatagtatgcagtatgctttagagaattacaaag

SEQ ID NO: 590633 - DNA, 210 bp, Homo sapiens
agaacttgttatagtggataagtgaaatatggtagccggtgtatggtaaatagtatgggactcctgatatgtagcagaatgagatagaagaaaatatgacttttttatagcatcgtctgttattcattgctgtggaagagaagcatagaggagattttttatagattctagaatggcataaatgattagactgggctgtagcagagaatt

SEQ ID NO: 590634 - DNA, 303 bp, Homo sapiens
aagaactatggttctctgtttttagatattgtggatgagttattttttccagttttcaacaccataaagatttttgcagaatttctcaaaatcagtttgtggattccagtagtatttatattgagagacacacattttagtcctctaactgtgctaaaactcggatatttgtgaaactccttaccaccatacaagcatcagagagctctctgttgttagcactcatgttgcaagacagatacatcctttatcctctatgaaatgacagtgaggcaaagggaggtattgactgagagaggtcct

SEQ ID NO: 590635 - DNA, 167 bp, Homo sapiens
tcggtacctcctcgtcaaggccaggatcgcatctttgctgtcggccgacggtgccatcaacaccgaggatcccaagccccagctcgcccaagccgccatccagggaggcgagtgcgttgctcgtcagatcgttcacctcgagctcggcgagccgctggagaagttcg

SEQ ID NO: 590636 - DNA, 1231 bp, Homo sapiens
  misc_feature (428)..(428): n is a, c, g, or t
ggcctatgccccggtctctgctccggcggcggagaggagactatggaacgtcgaggtgcgtgctgagtcgagcccgaggaggtcgggcggctctgtatcgggggccttagccgccagcctcggtgctgaggcgccggactgcctgtgtgccctggacggtcaccatcagcagtacgggcggccaatatcgcggactggtgcagcacttgagtgtgtcccagaagggaccgtggaacggcatggagaacattcgcattctgccggcaagtatgcctgtcttggttatccactggaacgggtgggagcgtcacgtcgggggtgtgtctgccgagggtaaccctgtccaggggccaagcaagtctgtatgcggaggaacgcgcgagagggagggtaccactggcttggaagccacgacaagagagtgttcnttcgcctttgctgagaggcgacacttatgtggcaaacagccttgggtggccttaggtgccaacagggcatctggggcaggcggggaccggggtgcgcgcttgggggacggccacgaggaaggcataagcccaaagttgtccccgttggggccacgaggataccttggggaggggcaacgtcacacacgggaacgagcccctggggtgtgacaaggccccgtgtcccaacacagtgtaccgacggctgttggtccataaaaggaccccattgtgagtccatgaggagcgggcaccattgggggataacggcaaaaaatgacggcactttggggtgggcgcgattgggacatttgaagttcggcaccgtggccacctgcacaccgttgggcaataattgagggggcccaattgctcccattgggtagtccccagttgaggtgtataccggcccaagcagtcccgggggggaacggtaaacggacccgcaacccgatataatgggagtaagagggggcaacactatggattgggggagccaacgacaacggacacaaaccgcaaaacagaggcgaggtcagcgccccacccgacaaaagtggtgggaccccaggggagaggggatattaccaccagataagtacacagtattgagtaccagagagacaaatgacccaagcaagacagaagaggggagcaccgcgtagatggggggaaacaccacgaggtctcccatatgtagtagggccgaccaagacggaaacgggaaaccatcggagacacacttggccaggggcaccgcctca

SEQ ID NO: 590637 - DNA, 254 bp, Homo sapiens
atatcagaggacccgtactgcgctggatatctagaagtcctgggcttatacttggatatatacagaggaagttgacttcagtctgcactcttcaaatggtgaccggagaggacgtgataggaccagtaaaaaaaattgatagtcattctctgatggaagtgaagcaagctttgtcaaccatcaaaaaaatatgaactttcattggtcacaagcccctgcaaaagatcccaacaaagatttggagttttaaaata

SEQ ID NO: 590638 - DNA, 141 bp, Homo sapiens
  misc_feature (82)..(82): n is a, c, g, or t
tgatctgagatcttgtgctagggagtgagtgcagatctggttggtgggcttcactccaggttcaagcgatctaccactcagnctcctgaatagctgggactgaggtgccatcacataccagctaattttttaattttttaa

SEQ ID NO: 590639 - DNA, 743 bp, Homo sapiens
  misc_feature (432)..(432): n is a, c, g, or t
taacctaaagtaacctttatttccaaaatgctctcgaggtccaaaaaaaaacaagggcaaagtctaacaataattaacaaaccagctctgtgagcggcaaagtgccccagggatgaaaaggggccgttggggaattcgaacacagggtggttgtgggagaacacaacattttttctagccttcagaaaagtcgagggaagccccagaatcacagccgtgaaacttcagtggtatgggttacagattcttatacaagagggtgttatacctctctcatgaggctcttctggtgggattactctccctcagaaaaatctcattcattgtgaccatctccaagcaaccagcacgtggaatgtgtctcattcaagagccctcaaagtgtggaccgcctattaaagacagcggtgaaccgttgggggagactctcgntgtgctcctgtgcctgaaataaacgcccagggcttctcgagtggtgtgcgccatgatgcagctgtgctctctataaatatggcgcccacgctctcaaattctccttatgtctctcccctcccctccctgtgtggccccctctgtggggatcaccgaggctctctcttttcaaaacacaaaacacccgtgtgcggagagaaaacgccctgtgcgagaggcttaagaagtagaacgcccccagtgttaaagtgggtgaaccccgggagatatgggcaaaaaactccccccacagagcgggagcaaacaagcat

SEQ ID NO: 590640 - DNA, 385 bp, Homo sapiens
  misc_feature (31)..(31): n is a, c, g, or t
  misc_feature (140)..(140): n is a, c, g, or t
  misc_feature (195)..(197): n is a, c, g, or t
  misc_feature (199)..(199): n is a, c, g, or t
  misc_feature (201)..(201): n is a, c, g, or t
  misc_feature (214)..(214): n is a, c, g, or t
  misc_feature (228)..(228): n is a, c, g, or t
  misc_feature (235)..(235): n is a, c, g, or t
  misc_feature (240)..(240): n is a, c, g, or t
  misc_feature (260)..(260): n is a, c, g, or t
  misc_feature (299)..(301): n is a, c, g, or t
  misc_feature (332)..(332): n is a, c, g, or t
  misc_feature (336)..(336): n is a, c, g, or t
  misc_feature (338)..(338): n is a, c, g, or t
  misc_feature (340)..(340): n is a, c, g, or t
  misc_feature (379)..(379): n is a, c, g, or t
ggaatttgtatccccaggagtgtcaattttnttaccaaaatccaaacttaattttcatcagtgtgcccatttttataatgtgcttaccccagttgcaaatcactagttaacagtgtggagtgagaagttatactactgangatttcaaaatgtgcctcagcttatctaccttattatgactagaataattatagnnntnanataatatgcatangcacttagcatatngcctatnatcantactatgtagagagataganatgtgtgaaaatgggagtcttaccttaaggatgtaattnnncatccgtgtaagattaccaatattctataanatangngntgttacataactagaaagttgtagccattcaaccatttntctgga

SEQ ID NO: 590641 - DNA, 879 bp, Homo sapiens
aggtagttattactggcataccccaagtcagcaagctgtttatagagcaaaggcaaatatcgacgagcggttctgtccgcaagcagcacaaggagctctgggcacacaagcgaggtggaccccggcacccaagactgcctgacggcctctggtaaccttcctaccccctctgcggtaaggcctcggagccaggcacgggcggaaaggttggcgaaggaaggtcgagctgggcttgctgtgagggcgccacgcgtgagaaaggggatgaggcttgctcaggcgtaaggggactcatgggcagggctcttgctacaaggactccttgccttctgtccttctcccgcagccggtgagcggtattcggaaaccaggatttggggtctgctccaccacccgtgcgttcggtgacttcgtgtcagccatcccgtccccacctcaccaccaggaccccactgggaggcccccaagcccagctcccctattctaggctgccattatatctccagcaaggagtcaagcatgcccgcccgtcagggtcccagagctccctcactgccaccggagactgtgtggcccccagcgtctccccatctacgctctacccggtaacctgtttctgagccacggagacagggaggaaggagcagcgacagtgccacctgttgggcatcagtaaatgcccctgcagcccatgggggaggagatggggaagtggagccagccatgcactctgcagggcaaggcagggcctgccacagtggggcttgggaccatctcgaaccaccagcgtggagaagcagaagcaaaagcactcgccaggctgcagcctcaggcactggaggggctggtgcgccccacttacgtccccggtccattgtg

SEQ ID NO: 590642 - DNA, 204 bp, Homo sapiens
tttgtggacactttctggatgggggggggggacagggatcaaccatcttccagttgctttacggctaagatcaactacacccattgtgaggagaaccagatgattagggcctagcaaggcctgtgatcacaacggacacagactggcaccgtaccactgttcatgtactgactagctatgagtgaggcctgcatgatacaaagt

SEQ ID NO: 590643 - DNA, 783 bp, Homo sapiens
  misc_feature (347)..(347): n is a, c, g, or t
aggtctgagcgtgctggtatcagatcgacaacattgtggtctcggccgttttagtgggaagtagtgctctcccccgcgattggtggagaaagcaccatttgttcaagaacatggtttttatatataaaacatagtatcctcccgagtaattatgtgtgttaagcgccggcctacccgcgtcgtgtggtggtgctcccccgtattgacgccattgcgacggcctggttcgccgccccgttttttgatgcgggcgccccttgggggggtctctcccctccttaagttattgggggcgccatagagaacgcatgttgtctgtctttctattgatgacttgtgtgcgagcnttattacaatcgtccccatgcccgagtcttccttcttgagtaagcctcatcaaccacttgcgatcaagcgccgcccctcataggtgtgcgctcacacacgcagagacagtacgagagtgtggttagacaccccccggtgcgtgagagcgacacagaagagaaagaatatacagagtcgcccctctcccaccacccttttctcactcgacttggctgtctcttctatacagaggccgtctcggcacgacatatctgttgcttctctttgtaagcccaggcgcccccgtccccgtggcgcggtgtgatgaggagaatgttgctgaggtcgtggccattgggagagtatggtatgttgcggtactccatcgagagcgatgtctcccttctatgcggataaaatatccccgctgagtcagtcataacaatagacaaaaaa

SEQ ID NO: 590644 - DNA, 878 bp, Homo sapiens
  misc_feature (616)..(616): n is a, c, g, or t
ggccgggcgcatccattggccggagccgtaacaggggacccatcgccgcctcctcgctgccacagtgccatgaccagaccgcgttctcgagcgcggcacaggattggagggcagcccgccacgcggcagcgggagccggggtagccgtgacaggagtccactcatggcatgtgcgggatgtcgaggcaggatctccatgtaacatgtccccggaacctagagtaacacgtgtcatcctcaggcgacctggacgtggtggccccggatgaggcgtcaacaagtcataaaccgtgtgtgaatgtgagcgcacctcacggtgcagacacgaacttcgaggacaggcacaaaagtaaccacggtcctctgggcccagcttcactttgtggcaggtcgtcatcaaggagtgctgcccctttgcgacgtgcaccgcggggatatcctatatcaggttggtgatacacactagaacgaccttgaccgccgtcgcgcaaggatgcgactgctagaagtcaccgggtggttggccagagggggtcgactagtgcccctgtggtgagcccgcgagggcaactgctaagcacaaagccgagcgtcggtagactcaatgcatggcagnctatgacccaggccagtgtctcgtccgtgtggctgcgatggttcgtccgagctctttgcgcggggtcctcgaagctatgctctccgtgagatggcagtgagcgagtcgtcagcgtgcgttgcaatgggagctgcatttgtcagcgagcgtgtcagcatttctgcgccgccgtatcatgcgatgcatgccgtacagacgatctgcgtccactctccttacgcaggaatggggggaggccgctgcaaatcgatagagatacgtc

SEQ ID NO: 590645 - DNA, 127 bp, Homo sapiens
cagcttctctactcctcctacactaacctgactataaacattacctaaaacaatctcacagcaccaaatctccacctccatcatcacctcaaccccaaacggcatcattaaactattacttcctctc

SEQ ID NO: 590646 - DNA, 1206 bp, Homo sapiens
acactgtaaaaaacacgaataggatcaagatgtataaactgtagtttacttacgtgagaaacatcttcagtggccaagaactgtacatattctctacagaaagacacatgaaatagctacagctatacccagaccttttatagacggagtctcactctgtgtccaggctggagtgcaatggagcgatctcgagctcactgcaacctcagcctacccgggtaacaagcgattctcctgcctcagactacctgagatagctaggagatatacaggaaaactcaaggaagagaaagatgctagccaatcccactaccagacctgaggataataacaaggagaatcagtcaagaagcacaacctataccatgactatctgtgtctagaaccataccaatttccgtgatgtgacataatcagtttccttcattattcaacaccacacgtatacgctgaggttacatagttacttctacgagatacagtcgctaagaatactatgtacagacgacggtacgattactcacacacacacagataaccactgttcataacgcattagtgggacacacaagtaactaaggcccatgactagtttacaactcatccagtcatagcaccgtcatatatatatccttcatactcaaattcgaaagaacatataaacatctagacaggagaacagtagtaccagtgctaggccttactaggcatctatcaccatggtcatatatatacactgttgcagacattgttactaccaacaattaataatacattactgttgacataaaatagaataagaagagcatgaaaaaggatacagacatatgctagacacaattaaaaagacacaacgaaaaggatgacacaagaagagacatagcaagtaataggctgacaggcaggagactgcacaccacaggagagcgcagcatcatatcatcacgaggggaccccaggataaggcagactcgcaggactgtacaggaggaaccccggaagaggcgcgaaacgggcatcagagaggaacgaagaggagacaaaggaagcggaagcggaagtgggagacgcaggagaggcacacggctacatgccccacgcgaagagcgacgacagaacgcaaccagaggagacgagtagagtcggttagcaaacgcagtaggacgagacgaagacgacggcgaaacgaggcagtgacgcacacga

SEQ ID NO: 590647 - DNA, 401 bp, Homo sapiens
aggaggttatatattacagatatcaatattcaggagctagtaataggtctgtttacggaaaatcaatatcttcctggctcagttgtgggagggtgtatatctaccatgaatttatccatctctttgaagttttctagtttgtatgcatagaagtgtaagcagtagtttctagatggctagtatctatatactagtggggtcagtggtaacattccctattgtacatttctaattgtgtttcttacaatcatcctctgtattaagtctgctagcagactttcttattaaatattttcaagaaacctacccggaattcatagatcttctgaatttctataattcatgtctcggtttctttcagttcagctcagattttcagttatatcttgtcttcctctagc

SEQ ID NO: 590648 - DNA, 277 bp, Homo sapiens
tgaaatccgagagcagccgtggacaacatagagagaccctgtctcttaccaaaaaaaaacaacagagaatccggcggggatatgaagacctgtgcccgtatccccagctacttggaaggctgaccgaggaaaatggcttaagccagagaggtcaaggccgcagtgagccatgatggccccattgcaccccacccggggcaagagagagacccgtgtccaaaaaatattacataaataagtacaagggttacataccatgattttgccctcagggaaa

SEQ ID NO: 590649 - DNA, 276 bp, Homo sapiens
gcatcctgcaggttatctctaaatcatccccacggcttgcttgcttcagccagtcggtggtcctaacactctcctgtgtaaatttttatcactatagggatcatgcgatggactgggtccgccaggctccaggaaaggggctggagtgggtctcgaccattactgcgagtgggggtagcacattctatgccgactccgtgaggggccggttcaccgtctccagggacgcctccacaaacacagtgtttctgcaaatgacgagcctgggggccgccg

SEQ ID NO: 590650 - DNA, 123 bp, Homo sapiens
ggcttctgttctgccccgcccactgaaaaaacactaacgattgcactgacagacagaccccagagcgccaggcctcccacacacccacggggctgtcagagtcaaccagggttcttggtgagg

SEQ ID NO: 590651 - DNA, 162 bp, Homo sapiens
actggttatgtggttaggtacagctgcctcagcatattgtggtccctgtgggcggtggttaggtaacagcagcctctcaacatagtgggggttccctggggggcagacagttaggtaacagcagcccctcaacatcagggggttccctgggggacagttagg

SEQ ID NO: 590652 - DNA, 375 bp, Homo sapiens
  misc_feature (36)..(37): n is a, c, g, or t
  misc_feature (48)..(48): n is a, c, g, or t
cgtgttataaggggggtcatgcttccaaggaaaacnncaatggtcagncctcaacttccagtggacgcgtatatccaggccagaagtggaggctgaggtgtcaaccataatttaagctagagagaacccacacttaggagtcaaacctttttaaaaatctttacaaataaaatcaatgattatatcttttgggcataataattaagtgggtcaaacttacaaatcaatgctacaaaatacagtgtttcccattacttttagttgtaatgtacactatgtacagaaaagagttgcctatcttaagctgaatactgaagaacagcttgttaaaaaccagactctggacttataaacagggcagaaaatgcaaacgcc

SEQ ID NO: 590653 - DNA, 3557 bp, Homo sapiens
  misc_feature (1)..(3): n is a, c, g, or t
  misc_feature (13)..(13): n is a, c, g, or t
  misc_feature (21)..(21): n is a, c, g, or t
  misc_feature (3365)..(3366): n is a, c, g, or t
  misc_feature (3373)..(3373): n is a, c, g, or t
  misc_feature (3376)..(3377): n is a, c, g, or t
  misc_feature (3398)..(3400): n is a, c, g, or t
  misc_feature (3404)..(3404): n is a, c, g, or t
  misc_feature (3416)..(3416): n is a, c, g, or t
nnnaaggaaagcnccctgctnttgggaatctccaggatcccccgcaaatttccttccactcgaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590654 - DNA, 115 bp, Homo sapiens
tttatgtggtaaatacatgtcacatacattttaccattttaataatgttttcagtgtaccgtgaagtggcattaagtacagtaaaaaaaaacattatttaataaggatcccctag

SEQ ID NO: 590655 - DNA, 1472 bp, Homo sapiens
  misc_feature (1280)..(1281): n is a, c, g, or t
  misc_feature (1288)..(1288): n is a, c, g, or t
  misc_feature (1291)..(1292): n is a, c, g, or t
  misc_feature (1313)..(1315): n is a, c, g, or t
  misc_feature (1319)..(1319): n is a, c, g, or t
  misc_feature (1331)..(1331): n is a, c, g, or t
cctaccaagagctcggatctatctgtcgattctcctcttatcgaacaccgtcttaccacgacttcacggtgttattatttttttaaactaaggtgctcaaccccgttcaaccgttaattgcccaggcacacagttcccccagccattccaataaggtccttttagtataaatactttggttcaacccgctttaatcgaatgaatgcccttaaccctccaaaaaaggggattttccaagcctgaaaaacccaagacaaagaaggaagaggaggaagatgaggaagatgaagaggatgaggaggaggaggaagattcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590656 - DNA, 258 bp, Homo sapiens
ctgactacggcggaagcagcagtgcaagtgaaggtcttcccatgggtccatgggtcggcaccaccggcaggacactggacacgctgtagagccacagaggtgacgctcaggtggtgcttgaacagagctcttcccacttgagggcgtgcaggtgaaggtgacacctgaggcatctctcaaggcggtcagtgtgcacgtgagggtcgcttctgaacctaagaacaagtccttgagggccggtcggtgcaatgacagtcg

SEQ ID NO: 590657 - DNA, 231 bp, Homo sapiens
ctgcactagaggatccccgtcccaaggatgagaaagttgtccagcacaaaggtatctgctaatgatgaccatatctggcattgttatgaaatctgtcagcttctcagattgtcctctttattttttattgttatatttttgagacagagtctcgctctgtcgtcctggctggagtgcagtgactctcacctcggctcactgcaaccgtcgtctcccgggttcaagcaattc

SEQ ID NO: 590658 - DNA, 2674 bp, Homo sapiens
  misc_feature (2482)..(2483): n is a, c, g, or t
  misc_feature (2490)..(2490): n is a, c, g, or t
  misc_feature (2493)..(2494): n is a, c, g, or t
  misc_feature (2515)..(2517): n is a, c, g, or t
  misc_feature (2521)..(2521): n is a, c, g, or t
  misc_feature (2533)..(2533): n is a, c, g, or t
gtaaaaacgaccgctagtgagtgccaaatcattcatcctagctgtttcctcgaaggaaagagggcctgattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590659 - DNA, 618 bp, Homo sapiens
gatcgtcgcgaggggcggggcgcctgtcagggaagcggcgcgcgcgcgggcgggggcgggctggggatccgccgtgcagtgccagcgcagcgccagacccggcccggctctccggcccgtcgctgtcttgggactcgcgagcccgatcccgcctgctgtcgctgccgatatggagctgctgtgttgcgaaggcacccggcacgcgcgccgggccgggccggacccgcggctgctggggaccagcgtgtcctgcagagcctggtccgcctggaggagcgctacgtaccccgcgcctcctacttccagtgcgtgcagcgggaatcaagccgcaacatgcagaagatgctaggcttactggatgctggagggatgtgaggagcagcgctgtgaggaggaagtcttcgccccggacatgaactaactggatacgctacctgtcttgcgtcccccacccggaaaggggcacgttgacaagggtcctgaggtgcgggtcctggattggctgctgggctaccaatgctggagcgaagaaccacggcccctggaccaagccgaaaaagtgtgcacatctaaaaccggaccaggcttgtctactccccgcaaggttggcggagactg

SEQ ID NO: 590660 - DNA, 2107 bp, Homo sapiens
  misc_feature (39)..(41): n is a, c, g, or t
  misc_feature (43)..(44): n is a, c, g, or t
  misc_feature (46)..(46): n is a, c, g, or t
  misc_feature (48)..(49): n is a, c, g, or t
  misc_feature (51)..(52): n is a, c, g, or t
  misc_feature (62)..(62): n is a, c, g, or t
  misc_feature (66)..(66): n is a, c, g, or t
  misc_feature (76)..(76): n is a, c, g, or t
  misc_feature (131)..(131): n is a, c, g, or t
  misc_feature (1915)..(1916): n is a, c, g, or t
  misc_feature (1923)..(1923): n is a, c, g, or t
  misc_feature (1926)..(1927): n is a, c, g, or t
  misc_feature (1948)..(1950): n is a, c, g, or t
  misc_feature (1954)..(1954): n is a, c, g, or t
  misc_feature (1966)..(1966): n is a, c, g, or t
atgcatgtattgtgctaaacactctcccaaaacatcgtnnngnntnanncnncctctttgtnccantggccctggntgactcaagtgcccattcaatgaccaggacacagaggtcttagagagatgctccntgaggccccaggtgcgagcctgtaccctgccggagcatgaggcaagggacagggcatcgtctgtggggatagtgggggtagtgggggtagtggtcagccagatttggtgactctacttgctcaccagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590661 - DNA, 127 bp, Homo sapiens
agcggtaaacaatcacttgtatctcattaattcattcaatacatatataccacacatgggttttaggcttatgatggctgtagccagtataacagacatatcaaacctttagctagtcacggagctg

SEQ ID NO: 590662 - DNA, 3782 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (3769)..(3769): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccacttacttggtctctccttttacaacacacacacaacacatctaggagcgctactgntacgagctgatgt

SEQ ID NO: 590663 - DNA, 555 bp, Homo sapiens
atgtcgatctagaggtccccgggcagtacggatgtggaggttgagtgagccaagattgtgccactgtactccagtctggtgtgacagagcaagacggtctcaaaaaaaaaaaaaaaagaggatccaggggatacaaggtagatttggtagggggctgataacccaaggacagtttcctccacccttttctttggggccagagtggaccatttccagaattcatcattgtgtcacgatgactttttgggtgggtaaatatgattaattggcttccctggggacttcaagggctccgggaaataacttgcaaacatttggtgcaagtctcaggtggggagatgggtgagggggtgggcaatatgggggcgagggagggtccatatccttcatcagcttctcagggggttcttccaggaggtacagggggagggctggggtggggtcaatgacatgtgctagagccagcacccggggggccaccggggtgttgctcccccatttcaaacggtgtagctagcgggagggaactcctggtctacttggaaatcgtggggg

SEQ ID NO: 590664 - DNA, 3482 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggtgagtgagtgcagacagatggggcctggtgcccttgagcagttcccgggtctcagctgccacacatctcatagccggtgatgctgggggaagcttacgcagtcacagtactggcttcttcctctttttctttccatacaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggtgatttattatcttgccaagtttaggctgggcatggtgactcatgcctctaatcccaaagtgctgggactataggtgtgagccgctgcacccggtccaagtaaaattattttaacaatatactatgaagagaaaaacactggctatgaaagaatatgcatagttttaccctgtttaaaaataaagattgaaagaatacatatgca

SEQ ID NO: 590665 - DNA, 3356 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggtgagtgagtgcagacagatggggcctggtgcccttgagcagttcccgggtctcagctgccacacatctcatagccggtgatgctgggggaagcttacgcagtcacagtactggcttcttcctctttttctttccatacaagtggcttagggatggggtagagtagttgacttatttggatgaaaaccactatcttctgtctgcactcactcaccttcctcaggtactcgcatgggcatgtcactgactttacatgctgctgcagctccttggtgagctggccctggtcatgggacaggaactgtggggtcaggacaatagagagcttcaccatttgcagaatgagaacaggggctccag

SEQ ID NO: 590666 - DNA, 158 bp, Homo sapiens
tcgtcttttgataggcagggggcacaagatagactgcgagagtctgttgaacatatatgtacgcacattaactctaacccgaagtgctacaaggttccgaactaagctaagccctatcacctaccagtggacccaacatacatgcgcggccgcacagt

SEQ ID NO: 590667 - DNA, 335 bp, Homo sapiens
tagatgtttcacctcctttcttgataatttcctcacattctttgccacacaccacagaaatattgcagctgacagtgcatggggtgcgccaatattccaggattgatcaaagcactgaaggttagttggacatattcatattcacagtctcatctatatacaatcggtgcttatccagttgtgagcagtattctttcacaacatgttcattatttttaacatgcttgtgcctcatttgccacaggtctttcagcaaatacatgtactataaggtagaagaggaggtgtggaaaacagctatcactgtgatagtaaactcatcacctatatttcag

SEQ ID NO: 590668 - DNA, 3432 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggtgagtgagtgcagacagatggggcctggtgcccttgagcagttcccgggtctcagctgccacacatctcatagccggtgatgctgggggaagcttacgcagtcacagtactggcttcttcctctttttctttccatacaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggtgatttattatcttgccaagtttaggctgggcatggtgactcatgcctctaatcccagcattttgggaggctgaggctggtggatcaccggaggccaggactttgagaccagcctgaccaatatggcaaaacctcgtccctgctgggaatgcaaaaattagccgggcatggtggtgtgagcctgtagtcccagctactcaggaggctgagacaggagaattgcttggattcaggaggtgggggttttagtgggccgagatcacgccattgcactccagactgtgcgacagagcgagactctgtcaaaa

SEQ ID NO: 590669 - DNA, 1063 bp, Homo sapiens
  misc_feature (48)..(48): n is a, c, g, or t
  misc_feature (59)..(59): n is a, c, g, or t
  misc_feature (71)..(72): n is a, c, g, or t
  misc_feature (82)..(83): n is a, c, g, or t
  misc_feature (105)..(105): n is a, c, g, or t
  misc_feature (107)..(107): n is a, c, g, or t
  misc_feature (117)..(117): n is a, c, g, or t
  misc_feature (168)..(168): n is a, c, g, or t
  misc_feature (170)..(170): n is a, c, g, or t
tggctgtgaatattatgatgtagatggtcgagagggaggggggcctgnttggtcaacgnagcatattcttnntactggaaannacaaaaatggaaaggaagagtnanaaagagaaanttccttatattctgaaacggcagctgtatgagaataaacccagaagacccnanatactcaaaagagattcttactatactgagagaataaatcatttatttacatgcgattgtgattcatcacgcgttacttacctctcataccatatttgcgtgaaacagtgacaaaccgactcatatgtttcttctctcctcgcgcctctcgcctgccccctcccccgcgtcccgcccctctccccccgcccctccccccgcctactcccccctccccccccaccccgcccctctccctcgccctccctccctctctccgtctcccgtttgtttgctcgtccccgcctcccacccgccctcccttccggtctcgactaaacaaaaactaaaaatcaaccctcagccactcgccctcccgctcctcgccttatccgcacgtactcacgctctcatccccccctccttccattccggtatgacaggcgcccccccaaccccaccccgcgccctcgagagaaacgttcacgacatccggcgtgcgtcgtccccaagacgccaccggccccgggatgacaacttcgacgcgatttaccagcgacccgcacaaccgtcactaatccgccccgccggacgagtacgcacctccgcaccccctttagctcactccccgcaccatccgcggaccttcttcttccccccgtcgatccccatcccatccccattcgtcccccgtttcccccctcaagcgccattcccctactcccgcaccgccttattacacccccaacatcttcaatcccacgaaccgttgggtgcctgcgccacgtcctcccgctccatctcaaatcatgatgtgcctatccccactcaattatcacacaccatcgcaattagaagcaccctcccccgctatatcctatctcccagccgtgtccccctcgcccgcccccgcg

SEQ ID NO: 590670 - DNA, 646 bp, Homo sapiens
  misc_feature (618)..(618): n is a, c, g, or t
ggggggccaattttgtttttttttttaaaggttaaattgagtgttaaaaaacgcgggtttattttttaaagaaataaaaagtggattggggtattaaagacatattttgggttataaaaaatgatgatggatactttaaaaagggatataattaggttttttttggtaaaaaaaaaaaaaaaagtgttaattgggacagggtaaggtgggaattttgtgtttagaggttttataatggaagaaaattttaaaaattttttgtcgcattttttgacagtgtatatataaaaaatgccttttaataactggatttttatggaacatttttgggataataaagtagaaaagttttaagggaaagtttctgttttgttattatgttttttaaaaaaaaaataattttaaaaggggttttgtggtgttgagccgataagaagtggattgttaaaaagtgataaaaaggtttttttggggttatatttgcagaaaaaaaatgcagatttttttacttattagtgaggagcaaaaggtttaaaatataaagtaattaaaatataaataaaaaaagaaaaaatgggagagttatattttttttaataaagcacagtaaagaatggntcgagactagttataactcggtgcgaat

SEQ ID NO: 590671 - DNA, 3717 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgctgaggcaggagaatcgcttgaaccagggaggtggaggttgcagtgagctgagattgcgccactgcactccagcctgggtgacagagactctgtctca

SEQ ID NO: 590672 - DNA, 419 bp, Homo sapiens
  misc_feature (307)..(307): n is a, c, g, or t
  misc_feature (331)..(331): n is a, c, g, or t
  misc_feature (348)..(349): n is a, c, g, or t
  misc_feature (353)..(353): n is a, c, g, or t
attcgcggccgcgtcgaccagcaggttgagaatcgccagttccgagggcaggcccttgcggtagttgtcgacaaagtcgcccaccaccttgaccccggcggagccgattgcgccgcccaatacaccgcgcagcacgttgaagtggccgttgatttcaccgccgggaatcaggtgcatgcgcggctcgaccaccgcctcgctgcggccctggatcgccaggctggattcgatggcgtcgaggatttcgtcgttggtcagggccagttcgtcgatgtccaggccgttaaggaagtcgatgtagatcggntgcatggtctgctcactgatgggntacgaaggtcgacgctnnagangcttttatgtgccgagggagcttgttatggggccttgaacacaacttgctgcacatcgaccttttt

SEQ ID NO: 590673 - DNA, 1217 bp, Homo sapiens
  misc_feature (1025)..(1026): n is a, c, g, or t
  misc_feature (1033)..(1033): n is a, c, g, or t
  misc_feature (1036)..(1037): n is a, c, g, or t
  misc_feature (1058)..(1060): n is a, c, g, or t
  misc_feature (1064)..(1064): n is a, c, g, or t
  misc_feature (1076)..(1076): n is a, c, g, or t
aaaaaaattttttttttaaaaatagttggggtaaagccaggtttttttttctggtcaaataaaggccttttacccccaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590674 - DNA, 1482 bp, Homo sapiens
atcttgtgttttgtgctttccctctcctctctcggctccccaacatgttgggtgagttaaatgtcaccaacagagtcttctgggggggttcctttttttgtgagccaacatgttggggacataatccagaacagcggggtgttttgaagcatattatattttttgcccctccttggtgtatgacccgcccaacgttggtcgcaacgagggggggcctgctccgctataagaggttgttataacggttgggctccggggtgtctcctccgaggggggggtccggttttaaaatatatgggcccccttccctccgtcggttgtaaaatttttttgtggtgggaaatattttgttgttgccgccccaccgccagatacggcgggttttatccaaacacacccatttgggtgtcacacatatgcgcacagaggtttttgtttgggcgttcttcggaagaggagccttggtatacaagggggggaggataacaatgaggatgtttttttggaaggttttctcccccccgcttattttctgtggtggtaatacacaataaaggtccttggggagaacagaaattggggctccccctctaaaatattttctcatcttgaaaaaagtttgtcatatggggttacgtaaattctgacatctgttccccccacccatggtgggtttgtagaaaaatataataggggttattttccccctctggggggcaccaatatggctccccacatctggtgggctggtgtttttttgaagtagagagccctttttgtcttgcccacaggacatcttaatttggcgcgcaccccccctcttgttgtggggggtttcctccccttcttgtgtgcgctctggtgttgtctgtggtgaatataacttatgagagaacccactagacgaccacagctttgttcccgcggttgtgggggtgtgttgtcactcgccacacaaacgccactacttggggtgacaccacacagagagaggggcttctctcttctggagagctgttctggggcacacaacaggtgtcaacccccacagagtgttctcgtccccaccgagataagtctctcacgagaagggctatatactgagaatatataatccctctctaatgaacctcgcaccacactcccacactctctctataatctcacagtcggtgtggagaagaaccgcgtgtctccacgagacctcgctgtttgttgtcacacatggccacatcttaaaggtttaggtacgtataaaagagactggttataatgagtaacccaatgcactcgctaaaccctctcacagagaaggaaaaggagagaaatgttttcgtggacccacctttggttttcttttttgcgtgtggcacagttttaagttattaggtttttaaaatccgtactttttaatgggaaccaccttggccccaaaatttgtccccagaagttttgagaccccatttaaaaagttcaatgaga

SEQ ID NO: 590675 - DNA, 1530 bp, Homo sapiens
  misc_feature (48)..(48): n is a, c, g, or t
  misc_feature (165)..(165): n is a, c, g, or t
  misc_feature (196)..(196): n is a, c, g, or t
  misc_feature (220)..(221): n is a, c, g, or t
  misc_feature (227)..(227): n is a, c, g, or t
  misc_feature (235)..(235): n is a, c, g, or t
  misc_feature (245)..(245): n is a, c, g, or t
  misc_feature (250)..(250): n is a, c, g, or t
  misc_feature (257)..(257): n is a, c, g, or t
  misc_feature (267)..(267): n is a, c, g, or t
  misc_feature (269)..(269): n is a, c, g, or t
  misc_feature (282)..(283): n is a, c, g, or t
  misc_feature (309)..(309): n is a, c, g, or t
  misc_feature (312)..(312): n is a, c, g, or t
  misc_feature (323)..(323): n is a, c, g, or t
  misc_feature (334)..(334): n is a, c, g, or t
  misc_feature (347)..(347): n is a, c, g, or t
  misc_feature (353)..(353): n is a, c, g, or t
  misc_feature (356)..(356): n is a, c, g, or t
  misc_feature (358)..(358): n is a, c, g, or t
  misc_feature (364)..(364): n is a, c, g, or t
  misc_feature (387)..(387): n is a, c, g, or t
  misc_feature (404)..(404): n is a, c, g, or t
  misc_feature (406)..(406): n is a, c, g, or t
  misc_feature (412)..(412): n is a, c, g, or t
ggcagggcatgctgatgctgagcgtacaggcagacaagagcgtagccntgctgttgcctccatcactatgaaatgacttattttacctgaaggacccatggtttatgttcctctaattcctttcactctccctaagccctctgagagagatgacgatagatgatntaatggctactaaatggaagggagcactatnctttggtctttggttagcaaaaanntggcanaaagaatngtacattctngctanaaataantaactaactncncacaattcaaaannacaagggacctaacaaaatcagcagngtnactgtattttnaaaaatatttnatagactcatttncaggtnatnanatgtangagaaacagatacccctcttttnaaagtaggtaaatcatngntgattnatataccaatttttagaagtaatttctagtaagcttgtggcatcagaaaatactagaagattttttagttaaattagttagaacatttatgatgaatatactaaactatttctttcagaataaaatatggaccctttgtgttactaatagataaggcagatataattttccgtctcttaaggccacaaaatatggcctttggttacagaacactaaagttagaaatctcacagttagagcaactttttaatggctatttcctcattattcgtcacgtgttcaaaaccctgccgaattcttgatacaggtgctactttatactatatttcttattcataacgataactgtctcttagtcttcttagtactagatctttattaggcactagaatcaaatcagtaaaaccatcatcattttcagccccaaattttgtccacagaaaaggcgtctcaacatgacaacataattttcccgaggatcctttccttttccacggaataatcttctccctgcatacactacattgggtccttgaaggtcacataccttggtgccaaacctaattgcacactcctggtgtcaatcctacagtaaactttagacccgggtttcaaccgcaatacattcaggatgctgacactgcgcactctttcacctggattcaccaatattccaggcaaaccgggtcaaaccgtgacaaccctactgtcgcggaagaatcccaacttgggtgaaaaacgcacctggcgaccacagcttcactcaactccacgcacgcgtcccgcaatcccacaagcacgggctccacggacgacatgcacagcgcaacccccaaccacactcgtcgacacaacaacccgctcaaaaccaggcacacccgggactcataagccgacaccgaggactgcagaacccatcgtcaccacgtctgcgccaacctcactccgaatccacccacagctaagcaaaccacgcttcctgatcttccgccagctgccgacatcaacgcacgtggaccacacatgcagaccgacccacaaaacgactcccccctaggtctttcttcttattctcctctcactctacaacacgacaccacgcccacaacacgcacgcc

SEQ ID NO: 590676 - DNA, 467 bp, Homo sapiens
  misc_feature (320)..(320): n is a, c, g, or t
  misc_feature (340)..(340): n is a, c, g, or t
  misc_feature (348)..(348): n is a, c, g, or t
  misc_feature (389)..(389): n is a, c, g, or t
  misc_feature (418)..(418): n is a, c, g, or t
  misc_feature (444)..(444): n is a, c, g, or t
  misc_feature (451)..(451): n is a, c, g, or t
  misc_feature (467)..(467): n is a, c, g, or t
catcttcttgaaatgggctccaagaagcaggtttgtggccagtagagccagctcagaacccaggagtggtacaaaaagcattcagatatcaagattcccctcctggctgcatcttccatgggggaggccatgaaaggggcccctggtgaaccattgagtcatttatagctaatcttagtacactccctgaagtagggaatgacatgggctgcaagaattcttcctaagcaccccagagagaacttcaccgatttaaaatatgagtttctgtaacctgagcaggagcttgcctgggtgcaagggcttatgcagcctgcctnccagggaggccaggagggtncgcacttnattgagctttgagcaaatggggggcttttggggaattcagncagcctccctggagcttttcctgggagcngagctggaactgtaccctgtaacttnggagggnttgctggggcaggttn

SEQ ID NO: 590677 - DNA, 1072 bp, Homo sapiens
atagtaccgctatcatatggttggttgtatggtgtactaccaggttgtattcagtgctagtccacaattgcattgagggctgagtgcagagcatcaactgtattcataaccggttatgcaactagctgctgatatctgatgtcgtgtgtgccagcaccgattgcttcattcgtatagtaaggctgtgtcgcatgagcgttcgtttcgaaaagtgcacgggttcgtgaacatatattctaaccacgaggtgagatgacttagtcatacatatgtatcacccgcaagatcaattgatgccatataaccgcattgtgggacacatatccgagcggagctgtccacagcgcatagtctagtcttcaatcataagagcgtaaggccgtatgctggcccatgttaaggtatggccggcaattaattggacagccttgtgtgggcggactcactctattgggcactgccttgtttgatgcggatttcacgaagctagtctgagtcgaggaaggtaactctgcatgcgaatacagaggactcacgtaagggtatccgcacaacggcccttccgatgaggctaactgtggtctagagttgcaccctcgcctactaccataggttaacgttgataccacacttcccatgtatagagaccattgaactctcagttcagcgggggaacgaatgaaacattgaacaaaatgacttccttgttaacccatttgactggttttgtgaaaccttacctattaaaatcccttaaagtaatagataaaccaggaagacggtactgatagttgtccttcgatcgttggagacctcagtgggccaactttaaagggagcttgcccatgtaaccgcttgaattgtccaaggcgccaggcccatctttaggctctagctgcgggctaatggcagttggggtccccgctgggggcgtcctggactgttgggccttctctttttactttcacaaattggcgggcgagccgcggcttataccgtaataaactcagcgcacatttgcgcccaacacatagtgagacaataaaccccgtcaaattacgagatttttccc

SEQ ID NO: 590678 - DNA, 185 bp, Homo sapiens
  misc_feature (8)..(8): n is a, c, g, or t
tgtctctnacagaaatacattagaaaaaaaaaatttagcggggcgtggcgatgggttgcccgtaatcccagctagtcgagaggcttaggcaggagaagggcttgaattcaggaggcggaggttgcagtgacccgagatcacgccatggctctccacccggggcaacaagagtgaaactccatctc

SEQ ID NO: 590679 - DNA, 269 bp, Homo sapiens
tcacaggatcttccaggtagacctaacccactaccacccaggttagctaaccaaatgcagtttggaaggcaaaacgagaaaaaaacacttcagtattatcaaaaccaaaagagatatgataaacataacatatttaacaatgtagtgtgggaatttgaagatacatagatcctgtttgcaaaatattggatattcaaatgaaacaaacagcctttggatccagtagccacaacgttaggtctacctggggggtacccgagctctgaatt

SEQ ID NO: 590680 - DNA, 327 bp, Homo sapiens
gtcacgcccacagactggcttgttatgaaatgaatgggggttagggcttgccataagacgctggatagaagatacactgatttggggacattattgagtccaatccaggcaatgcaaagggctagatcaacatgggggaagtgtcatagttcagatccctgatgtactggactggcgggtatgcagagtccacaggcaaatagcagtccacccggggagcctcgtaggggcaggtgccatgtctcagcagttgtcctagcaagctctgtgagaagcagatagagctgtcacgttctttctcatatttgtttaataatgacaggattt

SEQ ID NO: 590681 - DNA, 736 bp, Homo sapiens
gctctgaggctgagtgcgtttgggtgccctaggaggccgagctctgtttgttcgaactccagtggtcagacctgtcatatctcagcatttcttcaggaccgactatcccagaatggttgtggatgtgcagcacaatacacttgtcacctgagccaccattcgtggctccaaggttgcatctctccagtgactagcgagagggttgtcagtgtttgctcctgggtctgttccggtgcttatttgaatccttgctctgggatggactattcccctgggtgagccctcactcttcatggtcactgggcctgtggacaaatgtgtgttactgactatgttcatggggatggcttgcagaaagctgccaggcgagggtttgtgcactttcagctttaaccttgtgctgggctgtgtattttcaactatcacgatgtgggcatctgcaaagttgtgtgccatgctgtggaagctcttgaccttttgtgacttcatacttgtgaagaatgtgatgtagtgcctcttgttgcctctgcttgtgtcatgccattaagctcacaatagggaagacaatacaaagataagtccattggtggacagccttcttctctttaatcacaagatattttcagaattactctgtgagggacaggttgtgagaggatatactctcaggtggtggactgagtccaaatcgggggaaagggtggccccccttctaaagactccagggtattaactg

SEQ ID NO: 590682 - DNA, 406 bp, Homo sapiens
  misc_feature (167)..(167): n is a, c, g, or t
attggcatttgggaacttggagttcagggggcttccccccttcccaaaactggtcaaaggagctttctatatttaaactgtaaaacaaaatagtttttcctgaacccccgctttccttttgggggtttggaattttggtatgtgccaggcaaagactacctttgtgncacgctcccagtaaaaaccccaggcccccagtttttaacaagcttttttggttgacagggtttcccaagggctgttacaactgggtgctgggagaattaagctcctcctttgtgattcccctggggggggatttttggaaggttgcccttagtttcccccgacttccccccctgggttttttttcctttggtgattttgttttggatcctttccctgtaataaatcagggccgggggca

SEQ ID NO: 590683 - DNA, 728 bp, Homo sapiens
  misc_feature (51)..(51): n is a, c, g, or t
  misc_feature (83)..(83): n is a, c, g, or t
  misc_feature (100)..(100): n is a, c, g, or t
  misc_feature (354)..(354): n is a, c, g, or t
taaattttaaaatgatttttaattattgaacaaggggaaataaaaacaatnacaattatcaattaaaacattaaacaacccanttaccttttcttaacantcataataaaatatccctttcctgtcttatcaaaaaccttaattattctctaccacacacaccacaaaagcttcttaataaagcgggagtgtccatcacacctttgtgtaaaatacatagcaacaaggtgctgtctcctcttgccctacccccacatctgcttaactactcttatttctagaatgcctcttttgctcccattttgtaagctcctgccaatgtgtttaaggcccacctcagtgactacctcctanagccttgcttgaccacttaaacatacaaactaaaagcacaatgtggtcatttccaaaagatgattgataaattctcaacccacaatgtctagtttttaaaaaatgcaagccagggaggaacaaaagtgacatatcaaaaaattaaaaccccacattatacattgaaaaaactatactaataaaaaattccatttcccactcaaatattaagtggtaccagaaaaggacccaatctcaccctttatatttttccttaaatataaaaaaaaactttatatttataaaaatgttttaaagtttgcaaacattactactaacaattttagaaataaaactttctcgctaaatacctaaagcgtctcccacaatagttt

SEQ ID NO: 590684 - DNA, 371 bp, Homo sapiens
tggacatggccccctggtggcacgggtgtcgtcgcggtgatgtctcggctggtctcggtacctttttggccgctgggtgggcccgacggggctctcgtatgggcctccgggcgcgtctcagctcgtgcgtctcctggcgtgttcgtcgcctccgtgtacatagccgccgcgttggttcgcaggttgactagccgaccccgcatgggcgaggaactgggggcacggggcccgtcgtccccgctctccgccggcgcgggccacgggggcggggtgcaccaccgggagggcgggttgcaacgccgcggacccacccgcgggcactcggacccctagggcagagagggaaaaagaacacgcccatcaaagaacaa

SEQ ID NO: 590685 - DNA, 1037 bp, Homo sapiens
ggagacagagctacgagctgctgatccggcccaggtcatcaccattggcgatgagcggttccgctgccctgttggcactcttccaggccttccttcctggtgcatggagtcctgtggcatccacgataactaccttcaactccatcatgaagtgtgatcgttggacagtccgcaaagacctgtactgccaacgcagtgctgtcgtggcagacacgcatgcgatgtatccctatgggtattgccagaacaggaatgcatgaaggagaagcactgaccctggaaaccgatgtaccaagtgaagtatcaccgaatcagttgctcctccgtgatgctgcagagtttcttccggtgttggatcggctggttccattgctggtcctcgtcgtgtcctaactatccagtatgaatgttggatctagggcagaagcaagtgagttatgaccgagatcctgggccctcgttccagtcgcccccacactgctagaaatgtcttctagagtggagacttaattgcatcatctaagtctgtcggttaacttagcgcctattgcttggaacaaagaaacgctaaaatttggtgcagggaaagactaaagcagtcgtaggagtttggggccttggcctcttccattgtggtattataacgggggtagtcagtcttgccgcgtgtgtatggacattcgactttcagtggaggtagtctacatcacgttgtttggtacaagctgcgtttcaactgcgttagtgccggtttaccctttcctggtggctgtgcattccgggagttgtcattcctcacagcgtacgctgggtggtgcccggcagggaacgtatcgacccggccctgttgggacgtgtgtccgaattgacttgtgctttccgggtattttccaagagtccttgtggccctgagtaaggtacccatgtgccctcctagaggtgggtcccccccaattttttttcttaggggagggtggggccggtatctcttccccttcccccgtggcggggtgtacacctgctgcgggcacctgttg

SEQ ID NO: 590686 - DNA, 902 bp, Homo sapiens
  misc_feature (144)..(144): n is a, c, g, or t
  misc_feature (228)..(228): n is a, c, g, or t
  misc_feature (300)..(300): n is a, c, g, or t
  misc_feature (411)..(411): n is a, c, g, or t
  misc_feature (494)..(494): n is a, c, g, or t
  misc_feature (817)..(817): n is a, c, g, or t
tatggtaaaagtatgggaacagggtatggtggagggggaccagccttacattggcacccttccgatctgggagacgcaaaacactctgggatcttccagggaacgtgggcgaattaacacacatttcgcgtcacggtaaaaagnatagggtgggagcattagattctgggcggtcggttcatccagaggacccagacttggaagactgtcaaattggaagcaaacccnatgtgccaaagttttcattaaagggaccaatggatgggccaacaaatcatacttcctatggctggctcggtnacccacagacccacaactggtattggcgggtccataggtttggctcatggtattattaatcctccagggacatggacatgggccttccatatgggcgccttaaacatcctnattagacctggtccttggtggttaacccttggtccatggggggttcagaccacctggataatattccttatggtaccttgagngccattatggttaaacatacatcctgagggcagagttccagaagaaaatttgggaaccaggtggaattgggtccaggaattggctggaaaaccacctaatggggcaaccagcagaggagagtccccagagcaaagggtgggttttcccaaaacgtgtgtttggaaaggttacccttagacaggttggacatgggttcacccgggggctcctttcactcacgacacaggcgaaccggaggaactggttagtcccaacaaatataccaggaagcaaacaatttaggaccgggtatttttcccttttttcctctaatctggaaggngggttcacacgtttaccccatggttcggaccttaggcaggggaccgtctgggggccggtccgtgatgtctggtataccatacccg

SEQ ID NO: 590687 - DNA, 327 bp, Homo sapiens
cctcgctgccctccctcccagcctgggcaacaagagcggaacactgtcctcaaaagaaaaaaaaacttgaatcccatatgtagtcttccctacttggaggaggcagcgagaaaaagaaaaagaaggaaaaagaaaaaaaaattttttttgaattaggctgggcatggtgctcatgcctgtaatcacagagctttgggaggccaaggtaggaggattgcttgaggccaggagttcgagaccagcctgggcaacatagtgagttcccccatctctaccaaaaatgagaaatttagtgctgtaacaaatgagcaccaagttaagttttta

SEQ ID NO: 590688 - DNA, 670 bp, Homo sapiens
aggtaggccggacgtctctcgtgcgtgctgtcgagcgttcactttcagcctgcagtggtgcttgcaaacatttaacataaaaatggcttccaaaagagctttggtcatcctggctaaaggagcataggaatggccgacgcacatccctgcagatgacatgaggcgagctgtgattaaggacaccgattcagacctgtctggaagagacccagtacagtgtaaccgtgatgtggacatttgtgctgatgccagccttcatgatgcaaaccaaagaggtaccatatgatgtgcagggtctaccaggaggtaatctgggcgcacagaatttatctgagtctggtgctgcgaaggacacactgaaggagcaggaacaccggaaggacctgatagccgccatctgtgcagctgctactgatatgatgactcatgaaaaaggttatggaagtaaagctacaacacaccctcttgctcaagactgaatgatggagtgctttacagctactctgagaaatgcgtggataaagacgccctgattcttacaggccaggagcctgagaccagatcgagttcgcgcttgcaattgttgaagccctgaatgagcacgaagtgccgcctcaagggatgctccacttgtcctaaagactagatattgaactgcacctattaggcg

SEQ ID NO: 590689 - DNA, 252 bp, Homo sapiens
ccacgtactacttacgtactacgacgacggtacgacgtttttttcgtgactacgtggtccactggactaacgtggcgttggcttgccactgactggtgacggggtacggacgtcacggtacgttacgtacttacggacggaggggttcgttacgcggggctcggacggacaacacggttaggggacacacgtctacacactacggttggattgtatgacttatgagttacacacacacactacgtacgacgt

SEQ ID NO: 590690 - DNA, 1338 bp, Homo sapiens
  misc_feature (1146)..(1147): n is a, c, g, or t
  misc_feature (1154)..(1154): n is a, c, g, or t
  misc_feature (1157)..(1158): n is a, c, g, or t
  misc_feature (1179)..(1181): n is a, c, g, or t
  misc_feature (1185)..(1185): n is a, c, g, or t
  misc_feature (1197)..(1197): n is a, c, g, or t
gacctgcgacttttactacagagaaaccagctattacctgtggtctgctgggaaataacctccattgttcgagaccccaaactctgctcacatcttcctttccctatctctgcttgggctatgatcacggtgactctagcagcccttcatggacattatagtactctctgccattcacttttgctctaatctgacttcaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590691 - DNA, 172 bp, Homo sapiens
gattcacattacaatgactcctctttgtacttgtaccccttttaaatttaaactagaccttcctagaagtaatcctatcatccccgtggcaagggtccacagactcctgttgggaccttttgtgggggttccctagccagtagtactgcagtagattgatactgcacaaaag

SEQ ID NO: 590692 - DNA, 1321 bp, Homo sapiens
  misc_feature (1237)..(1237): n is a, c, g, or t
aaaaaaaaaaaaaagcctttcgcacgcagctataaaatgtaaaaactgaccgttggtacaaagtgcttcataacaatatataattgggtgtcttatgcctgtgagaaagaaaggctttattttattgtattgtttggtttaacattcttggcaaaggttcctttggcacaaggtttccccacacgggtcttggcgagttttcccctttcgtgaggggtttttgcaccccatatttctgtcgtataaacccgttgcgcttctcgatccagagcgttgataccctgtgtgatgtgaagcgcttggtggtgcgtcgtgtcactcggcggttgcaggccagggtgccccgtagacctcggatccccgtgagaccacccctctggggggaggtgagtgattacccatttttcttccttcgcagggcggggatactgtggggctccatttcccacgctttcataccagcgttcgctgtaacccggacttttgggggcccccttcgcgggaaagacactttgccatttgagggacagcgttcacaaaagcgctcgccggtgtgattaacaaggggtcacagcaagacagccgagagaaggacagcacgacggacccgactcctaaaaagtatattccccctcgaaaggggggacacacaaagtattatagagcggtatactcccaagttttcttctgtgtcgtcacaacgagtgtgggtgtcccccaaataaagggacagctccgacaatatataaataaagccgatcagagcaacaatcgagggaccagcacgcgttttcaaacacaacagcgcttctgcgagaaatgggggcgacaacaacagtgtgggtcaaaacacgatgggggagaacatcacttcgggggcgaaaaaggagacacgccccgtataacttcacgcgagaggggcgtgggcagccaacccaaatcaagtgggggggcaccgacaaaataccaacacgtctacaacgaacgagagacattttcaaaaaaggccccctctcagaaggggggtcaacaacattatctaaccaccattctttctcaaaccggggaggcgacaaaccaccgtgggggttcacaaaccaccacatagcgctgggcaaataattagcctgtcgccgcgctctgatggacaaacagtctttggcgcctcaccacagcagacggaatgtagatggcttactgagggacagcgacattctttttctaccgcacggaactngctggttgtgatgacacaacacgcaacgacagcacacaacagaccgaccacgcaacagtagatccaacacaagcagaagcggac

SEQ ID NO: 590693 - DNA, 3093 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (2996)..(2996): n is a, c, g, or t
  misc_feature (3013)..(3013): n is a, c, g, or t
  misc_feature (3022)..(3022): n is a, c, g, or t
  misc_feature (3030)..(3031): n is a, c, g, or t
  misc_feature (3037)..(3037): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaangttgatggacggatggntacatgatntgatgganngtttantatcgggacttccgaccctgctgatgttttgttgcttaagatataaatggcttaac

SEQ ID NO: 590694 - DNA, 104 bp, Homo sapiens
taaatgcttagttaatgtcagcctagtagctgatcttaggcttgccctgcacttatttttttcgtttttaaatttatggaggtcagtcccgctaggctggcaag

SEQ ID NO: 590695 - DNA, 3278 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (3181)..(3181): n is a, c, g, or t
  misc_feature (3198)..(3198): n is a, c, g, or t
  misc_feature (3207)..(3207): n is a, c, g, or t
  misc_feature (3215)..(3216): n is a, c, g, or t
  misc_feature (3222)..(3222): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcangttgatggacggatggntacatgatntgatgganngtttantatcgggacttccgaccctgctgatgttttgttgcttaagatataaatggcttaac

SEQ ID NO: 590696 - DNA, 980 bp, Homo sapiens
gattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccaccaaccccagttacccttcgggtgggacaaccaccacaacttgtgtactcagcggggcgtctagaaagagtatgtgcgaggagagttcctccttgggtgcatggttcagccaggtgtggtcatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacacgcagatggagcttgctgctgttatcaatggcgaattcgtcgtatgtctcgtggggtgaatccctccttggtgagctggatgaccactatgatgggactgaggcttcaaggtgggtctggagcacatgccttgtaggcctgatgccatagttcagaatacgtacgcagggttgggatccccccagcactatcgtgaggagcaatgcaaggccagggaagcagaagagctccctgacgccagcgggagaagggtcccaggccgtgaaacagcaggcgaaagccatgtcgagcgtcaccccgcccgggaggggccccggagaacgagtggagttcacctaacaaacctgggggacgcccggaggccatacaacgagtgagcggagggaacggccctatgcgaccaggtccgaaaacaaaagcgggccatctacggagggaagggcacaccaaaagggacgagcaacactgcaacgc

SEQ ID NO: 590697 - DNA, 781 bp, Homo sapiens
  misc_feature (5)..(5): n is a, c, g, or t
  misc_feature (7)..(7): n is a, c, g, or t
  misc_feature (10)..(11): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacaataaataatatactatcctaacaaaaaacatgtctgccgccttcgcccaatcgactttagactcgagcaagcttatgaatgccgccgcaatttgacctaacttgtcaaattggccttaagtgagccgatttcaattcaatggccgtcgtttaaaacgtcggactgga

SEQ ID NO: 590698 - DNA, 1409 bp, Homo sapiens
  misc_feature (60)..(60): n is a, c, g, or t
  misc_feature (67)..(67): n is a, c, g, or t
  misc_feature (70)..(70): n is a, c, g, or t
  misc_feature (73)..(73): n is a, c, g, or t
cattgtgtgtttgcagctggtcaggctggtctcgaactcctgacctcaggtgatccaccngtctcgnctngantagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcagatggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggctcttgctgtggcagtcttgctggtggaaggtaccgagctgatgta

SEQ ID NO: 590699 - DNA, 348 bp, Homo sapiens
aggccacatctggggacgcccatgatgtggctgatatgcgagagcttacgctgtgaaggaagcaacagcctcaagctcgaacctactgtacctgtcctgcacgacggcgtcctgaccgaggccatgatggacacccatgtgctagatgctgcccaacctcacgcatcaaatgatgctctggctgaagagggggaggcctgggccctaggacggactaacctgatgctcgtgtgcatggcggatgaccatacactgacgggagcctggacgatgactccctcacatgcctgcctttgctgccccgcacatttgggaaatgctgcctgaaataaatcaccggcggggccg

SEQ ID NO: 590700 - DNA, 831 bp, Homo sapiens
  misc_feature (5)..(5): n is a, c, g, or t
  misc_feature (7)..(7): n is a, c, g, or t
  misc_feature (10)..(11): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaaaaaaaaaaaaaaaaaaaaaaaaaaaaaaaaaaaaaccccgggggctacttttgggggggggcggaacaaagaggggttcacgacaaaggcggccacgcggcccacaagagggtgtctcggggacccggagctttctggtgtcaccaagggggaaaacaccgcgggggtcccacacaaaagggggacacgaaaaaaatcgggcaaagaccccggggtaaccgcgcata

SEQ ID NO: 590701 - DNA, 1006 bp, Homo sapiens
  misc_feature (814)..(815): n is a, c, g, or t
  misc_feature (822)..(822): n is a, c, g, or t
  misc_feature (825)..(826): n is a, c, g, or t
  misc_feature (847)..(849): n is a, c, g, or t
  misc_feature (853)..(853): n is a, c, g, or t
  misc_feature (865)..(865): n is a, c, g, or t
gcggccgcctactactactactactactactgctcgaattcaagcttctaacgatgtacggggacatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 590702 - DNA, 124 bp, Homo sapiens
  misc_feature (65)..(65): n is a, c, g, or t
ctgactcttgagtgatccccggatctctctggagctatcttctgatgtagcagcaggtgcagggngtgcttgtaggcgatcagaagctggtggtagtcatacaccatgaggccagtgagggtct

SEQ ID NO: 590703 - DNA, 199 bp, Homo sapiens
ggaagggtcacaaatcatgatggaggcaaaggacattttgatgatggcggcagaaacagaatgaaagccaagtgaaaggggaaactcttgtgaaacaactagatctcatgagacttattcacgtaacatagagaaagaagtatatgcggggaaaactgggccccatgatttaattagcccccactgagtccttcccaca

SEQ ID NO: 590704 - DNA, 951 bp, Homo sapiens
tttcaccattacatgagccagtgcatgtagcttctctgagtacaagacaaaatttatggcaatgggcaattagacttatactcagagaagcaacatgcgctggctcatatatgtgcaccagaaacgatatcaccattaataaaaattaacttggctaggtatggtgtctcacagccctgtaatcgcagcacttcgggtggctaacggcagatagactgcttgaacccaggagttcaagaccagcctggacaacatggtgaaaccccagtctctttaaaaaaagaaaaaaaagtccaaaaaatcaacgctgggcatggccgcacaatcgcagtggtagacccagcaaagtcaggacggctgaggtgggaggatccactggagaccaagggagcccagcggacgggacgccgaccctcgcagaatcgcccaacctggcatccccagccagagcaaccagacgcaaagacaacagacagcaagcatcacgagcccactttgaccactgggtataacagataggggctaataagttagaagacctgacctacgcctatacagggagaaggcagccgatcccagctaatggaatacaagaggagcaaaccccaaagggaacatacccaagcacgcccccaggatagagcgtgcagacaacacgacccactgccaggacacaattgttggacaacaccgggcacactagataccattgtacacacaaagagcttgaccccccaaagaagcgaatacaaggacacccagcgcccaagaatattaacacacggcgcgaagaaaatgagacagatagagacgggaaccagagcgcaagaggatgatcgagcatgcaaaatcgcaggataaatgacctgcatacatacggatggaagagcggacccaagtccaaccagcggaaacgaggccgggccgaaagaaggcacaagaagcaccgga

SEQ ID NO: 590705 - DNA, 342 bp, Homo sapiens
cttacagatttttaggaaataaaaagactttctaaataggaaataaaaatattttcttactttcagggaataaaaatatttgttaggaaacaaaaagacgtctgatggaaacaaatcaggattttaaggtggaatgcctaatgatttctcaacaaaacttttgcaaaactactcttatttgatgagagaaatgagcagaaacattgtgtggtgaagaaggcttccctggtgaacttttcctgagcatttttctgctaaagcttcggctaactttctcaaaacactctcataataagcagatgttattgttctttggccctccagaaaatcatcaatcaaaat

SEQ ID NO: 590706 - DNA, 443 bp, Homo sapiens
  misc_feature (283)..(283): n is a, c, g, or t
  misc_feature (411)..(411): n is a, c, g, or t
  misc_feature (439)..(439): n is a, c, g, or t
tgtgtgcctactaagtctctctctcctgctcctttatatgaagatgtgcctgcgtccccattcgccttctgctctgccatgattgtaagtttcctgaggcctccccagccatgcttcctaaacagcctgcagaacttgttgctttccagtccacacttcaaacccgagagtatttacaagcatggggaatagagacctaaaatgaagattctgcactcgtgcaaatctattctcaaaaagagcacgtgtctttgagcctgtctgtgttgccggttgactgtgncagttccctgaatcttcctgtggaacgcaaggctcatcgaaagacaacaaatatcttgatgctctcatatacaatattattattaaaacgcaaaagcagctgtatcattttgcaataatatcagcttngtactttgtaaataaagttgtgaagaangaaa

SEQ ID NO: 590707 - DNA, 236 bp, Homo sapiens
ttacttttgactgctctagttttatacacagttgaagactcttaataaacatgccctatatcttatgcaagtactgcatacatcaaagatctgcttaaaaggcaacgtactagacatcagctaatttactgcataattacattctcaacagcaacagtctgtatattctgaatatttaatagctgtgttcttaatgaaacttgttaagcactggaacttccacttcggggaagtca

SEQ ID NO: 590708 - DNA, 118 bp, Homo sapiens
ctgcttctgctatctgccatagccgccactgatggcacagtgcccctccaatggagatcctcttggagccccccaggccatacagactgcttcctgcttctgcccctcaccaagtacc

SEQ ID NO: 590709 - DNA, 678 bp, Homo sapiens
  misc_feature (50)..(50): n is a, c, g, or t
  misc_feature (146)..(146): n is a, c, g, or t
  misc_feature (162)..(162): n is a, c, g, or t
  misc_feature (173)..(173): n is a, c, g, or t
  misc_feature (180)..(180): n is a, c, g, or t
  misc_feature (184)..(184): n is a, c, g, or t
  misc_feature (678)..(678): n is a, c, g, or t
gcggagggaaccatgcgaggttctgagaattgcggcgagggtcgcctcgnagagacggtttctagaggaattctgaaatccccaccacttcctccctccgggggatttgatcccctatgggccaccgctaacagcatcatcgtgcntggatgatgatgacgnaagatgaagcnagctgcntcangccagggtccctctccatcctacttcgtcccaatgcggtcctcacctggggcttgaagccccatagcgtcctctgagtccgtcatggggccagaggaagtcagtagttcggagcggcgaagcaaatgctacaagctgtgagcaatagagaagctgttcgaacgagttccttggaacttctgtaagatgctacgtacagcagtaccaccctggaggtggtcccattcctctataaccggcagcaacgtgcccactctctgtgtttggcctcgtgcggagttctgcaacatcctctctagggtcctgtctcgggcccggagccggccagccaagctctatgtctacatcaagtgagctctgcaactgttctcaaggcccactcagccaaaaagaagctgaacttgtgcccctgtccgccaaccacctccaatgagccctcgtgggaataaccctcgcaaacacctctccttggaccccaacaaatgctgaaaacan

SEQ ID NO: 590710 - DNA, 116 bp, Homo sapiens
  misc_feature (6)..(6): n is a, c, g, or t
gagtangcaggcttgtatccttcccttcagtgatagtaagtcacctgcagttccctggcagttctagaggtggcgtcagggagctagcgattagagtcgagagacttagagcacca

SEQ ID NO: 590711 - DNA, 334 bp, Homo sapiens
cggtgttatctcgagctcactgcacctctgcctcccaggattcaagcattctcctgcctcaactgccaagtagctgggattacagacatgcaccagtacgcccagctaatttttgtatttttagtagagacagagttttaccgtgttggccaggctgggctcgaactcctgacctcgggtgatccgcgtgcctctgactcccaaagtgttgggattacaagcattagccaccatgcccgggctgcttttccattcttaagtgtacatgctctattttagagcccttaaatagcctagtcttttttgcctagaatattcttcacctcttctcttc

SEQ ID NO: 590712 - DNA, 774 bp, Homo sapiens
ggtgatgtggcttctgatgggaaaaaggaacccactcacgactacacacgctgtgacaacaacagactggacagtgcttcagcagcacgcaaagacacaacagcttaaaacacggtggaccaacgactcgacggaaccttgactacaagacacaccgaacgcacgcgttgggaaccactgggaacttaacaacactgacggacacacacaacaagacacccacggatgctgaactcattctgacggaaccgctgactgactcccaaccaacacgactaccaacggtgacacaaccgcagaactggtcaaacaggctgactgacgacaccaaaggacccgacgttacttacaagtacaccaaggaactgacggtactacgacattttggaccccacttaattcaggaccccaattgtataccctgattaggggttacttagatcgctaattgatgactacgtcttacataacacaggggggtatattaacctagtaacacggctatgtgcttacacatcctttgttatcattagccacaacatttggcgcgcaccatggttttgacaaaacaagacaaaattacctatccacattttagccacgggacaaggcccacaagtatccccgttcgcatttaaattccaagacacacgtttccacacggacaaacctttatccatatggacacattacaaaagtatggggccacggcatacggtcaccctgccaacggacccacgggcaagggaccccgcgcaccacacttttacacgg

SEQ ID NO: 590713 - DNA, 210 bp, Homo sapiens
  misc_feature (15)..(15): n is a, c, g, or t
  misc_feature (81)..(81): n is a, c, g, or t
  misc_feature (87)..(87): n is a, c, g, or t
  misc_feature (91)..(91): n is a, c, g, or t
  misc_feature (207)..(207): n is a, c, g, or t
ttagtaaggtcttgntgttatttttcatcgtatcaggtattgttgctattagagaaaaaagtaggataacttgcaacattnagctcngggntttcctaccacattttagagatttaccgtttccatatatttaacatccctggttacataatggacatttgtcttttaatgttttttcaatgtggggtaaataaaacattttgtctncta

SEQ ID NO: 590714 - DNA, 824 bp, Homo sapiens
cgtctctccccggagagcatgagcttcatcactcgctccaccttctccaccagctaccggtccctgggctctgtccaggcgcccagttacgagcgcccgggcaggtcagaagcgcggcagcgtactatgcaggcgcatgggggctctggttgcccgagatctcctgctgtcccgctcgccaccagcttcagtggtgcgagtctatggtgtgtccggagggcgtccctggtccatcgctgtggtatagtcctggtgggtctgtgcagggaatgggaggcatccagaacgagaaggagaccatgcaaatagtccgtgaatcgactccgcctgtgcactacttgacctggaacaagagtgagagagccgtggatgaccgagaacccggaggctgtagagcaaaatccgggagcacttggcatgaagagagggagccccaggtcatagacatggagccattagcttcaggatcatcgacggacctgagggctcagactcttcgccaatactgtggaccaactgccccgcatcgtactgcgggattgacaatgccgcgtcattggctgctgatggacttgtacgagtcgagttttgatgacagagctggtcaatgcagccgtgatcgtgtggacgagacggacgatccagtgggcctccggcggaggttcacttgttgaccaccaagtgttcactacagacttgctgctgggagaccacgagaatcgagggctcctcaggggcggggctgctcttcatgaagatagaaaccccgattgagggaagtcgcatgggcgtgcaacgcccggattgcccagctctggggtgac

SEQ ID NO: 590715 - DNA, 392 bp, Homo sapiens
tcatgagcctttagacattcccgcgcccgcaaagactgagacggcgtcctgctccaagtcctagacgaactctttaatgaacgtttagatctgatgttcaggtgtcatgttcttccagccttctgccttaatgtatggctacatgccggagtcgggtctctcacgccgagtacttgtgccaactgaaggtcggctgcctgaagtcgtcaagagtcacccagcccgccgccttttcgacgaacacatcttttttcgtcgtgccctagtagcttttgagtgtaattcaggaggtcggtcgcgatggcctgccccggccaatatgtcttggcgagatctgtggcgatcgataggaccaagaagtcgttgtcctgggactgcagctttcccagagc

SEQ ID NO: 590716 - DNA, 172 bp, Homo sapiens
ccctctttcatcttccttcgtcaccgtcttctccttcttattactttcttcttccttctccttccttcgtcttcttctccttctcctcctccttccttctccttcgttcttcttctccttcttttctttttcttccttcttcttctccctcctccccttctgtcgtcttatc

SEQ ID NO: 590717 - DNA, 108 bp, Homo sapiens
agagcatgtggagtacatgtcagaaacctggggtcaagagcagagagcctgagagctgagggtccgtatatgtggttggggcatgcccttccttctttctctttcttt

SEQ ID NO: 590718 - DNA, 954 bp, Homo sapiens
  misc_feature (1)..(1): n is a, c, g, or t
  misc_feature (63)..(63): n is a, c, g, or t
  misc_feature (67)..(67): n is a, c, g, or t
  misc_feature (73)..(73): n is a, c, g, or t
  misc_feature (76)..(76): n is a, c, g, or t
  misc_feature (164)..(164): n is a, c, g, or t
  misc_feature (245)..(245): n is a, c, g, or t
  misc_feature (264)..(264): n is a, c, g, or t
  misc_feature (278)..(278): n is a, c, g, or t
  misc_feature (462)..(462): n is a, c, g, or t
  misc_feature (468)..(468): n is a, c, g, or t
  misc_feature (487)..(487): n is a, c, g, or t
  misc_feature (558)..(558): n is a, c, g, or t
  misc_feature (569)..(569): n is a, c, g, or t
  misc_feature (677)..(677): n is a, c, g, or t
  misc_feature (707)..(707): n is a, c, g, or t
  misc_feature (720)..(720): n is a, c, g, or t
  misc_feature (738)..(738): n is a, c, g, or t
  misc_feature (769)..(769): n is a, c, g, or t
  misc_feature (869)..(869): n is a, c, g, or t
  misc_feature (876)..(876): n is a, c, g, or t
  misc_feature (931)..(931): n is a, c, g, or t
  misc_feature (933)..(933): n is a, c, g, or t
naaacactaggtgatgggttgagggtggaggtgggggacaaaggtgcgccgtgcacagaagtnagcngcagcngcntgctccccgcactgaggactcggcctggactgcagtacctccaaatcaacacgcagcaagaggggagtgcagggagggccctgaacancaagcctctgaaaggctaagggacaaagctccagctgtcccaggaaaaccagcaataaataaaagtgagggacggccccanccacacatattaactagtnacccatcttcactntggaggactgaagaattgcgacgatgaccccaaagaggccaatggcgctgccaaagatcttcacgatgagaatttattacaaagaggctggggttctgagcatcggccagggcagcaccactgcccacgatgcccacgcagactaccacagaagaggtaagaaaggactacggtgaggccagcnccaaanatggagtggcctgcatggnagtaccgatggccgagggcctgggggtctgtggaactgaaaggctcagccatgtggctaatgacaatagcnatgatgaagcngtagatggccacagcctcacagaagaggaggctgaacaggttcttggtcttgatcctgggggccttcactactccaccaatgaaggaggagctggtaatatagatgcnccaggctgccccaaccacagaaagggaganagctaggccaatncccaggttggaccacatnaagggcgaagtctccgtaaggaccatgcaanaacaaagcggaacccaaaacaaaaatggtgtagcagaatcccacggccagcgcgcaggcccagaaggccacgaagaccccggagtagagcagttctagcnccgtaanggcggcgacggcggcgggggtaggaacggcggggccggagctacaaacgcgttcnancttacaccgtccgttccgcag

SEQ ID NO: 590719 - DNA, 600 bp, Homo sapiens
aacaagacgtgagtttacaaagtcctaaaatggaggccaagagttggaccgcgtggactatgacatacagaaaaagactgtataccctctctatataactcaaaccgtccatagagaagctgtttctccatacacagaaacacacttgaaagagtctcaaatattttcaggcacatcttataggacatgtgcttctctcaggaatggaaggcatccaaatgagataaacaaagtgtgcaggatttacttaccattctcttccaacgggcaaataatgaaggtgcacaagtaaatgcgctcaagtgttctctagggcaccctcacagcgcatactttgaagaataggcttaccagattcatgagcactatacctttttaagccgcgattaccgtaaatgccacactatatggaatatgcttctcggttaaaaatgtaagcctagggtataacctccctcttatgtttaaacgcattgctaattcccagcttttcacagcttcccttgtttcatattcctgtgcgcgttccagcgtgcaatatgcgcgctgtgtatcaagagtctcgctcatggtgagtcgaaaagaacacctacaagacag

SEQ ID NO: 590720 - DNA, 534 bp, Homo sapiens
ctgtgataatataggactttagagtggagacgcctttcctgacaagtctagggttgattttatgtatttgctaagatttattaaaataaaaaatggcatattctataaggaaaaataatattaatggtattttaattaagcttaagcaataaataatggttatcacataatttttatttattattctttaccttatttcagggtctgtcttactgtgaagtttcaataaaatgcttagaactacattttcctggccaggtgcagtggctcatgcctgtaatcccagcactttgggaggccaaggcaagtagatcacttgaggccaggagttcaagaacaccctggtcaacatggcaaaaccctgtgtctactacagattaaaaaaaaaaaaaaatcatccgggcatggtggcacacgcctgtaatcctagctactcaggagaatcacttgaacccaggaggcagaggttgcagtgagctgagatcatgccattgcactccagcctgggcaacaagagcaaaactctgtcttaaa

SEQ ID NO: 590721 - DNA, 290 bp, Homo sapiens
tgtttgtaaacagctgttaaattcatcatgtcttaagtttaaattatttgagttccattttgtcctctgatcaattgactcatccattcatttgacaagaatgtagagggaaaaattacatgccaggaatctgggttctgtaggcaatattaacaacaaaaaaagacagttgaggaccctgagaagcacctgcactgataatgcattagagggtgatgtatgtcaagtcttctatagtctcaaatttaagaataccatcatagcatattttttactccattaaaaaaaaa

SEQ ID NO: 590722 - DNA, 784 bp, Homo sapiens
ggccctgggagctggcatgtggaacctgactcccatgaactccggacgtgtgctggctgcatgtgagtcgcagccatgttcctggttaactcgttcttgaatggtggctgggtggcttggtgtgctggtgggggaggctgggggcctgggtggggggcctgggaaatgtgcttggatgtgcctgatcatgctgtgggcctggggtgcgttgtggtgcggcggatgggctggcgtgctgtgcagggtggtggacgtgcgtggcgtgtgtggcttcgatgtgacttgtgtcgattgctgcatcccttaggcagtcaggtcatcatgcgccatcaagacagaaggctggcttgcgcaagtacaaacgcctgagaagcccccctgaccacacatctgcatcacatttacctcccaaacatttgaaagtgccaaaaccagagaatgttgagggacggtccggtaccatgcttcctgggagacacttcttttggagcgcaagattatggcttgggatgacttgaaagaattgtgaagagtcaagccggcccaatagaaattcattgaaagcatatattcaaagtaaacgggttttgtatgaaaaagagaacaacgctcttgattctagacagacattgataggagttattgtggactttgaccaacaaatatgtacgcagaaattgcgtggacatgtgaattggaataggcggaaacctacaagggaaaagctggggccttatgcgggaactccaagtactttgttggacaaaatataaaaaaagagtgg

SEQ ID NO: 590723 - DNA, 418 bp, Homo sapiens
  misc_feature (27)..(27): n is a, c, g, or t
  misc_feature (67)..(67): n is a, c, g, or t
  misc_feature (88)..(88): n is a, c, g, or t
  misc_feature (104)..(104): n is a, c, g, or t
  misc_feature (115)..(115): n is a, c, g, or t
cattggccccgtggggataattatatnaaaaccctcccgggagtaccccccctacacacctttccangataaccaaccaaacccccanggaattattgaaaagngggatgaaccnggagttttggggattgacctattttccaagggatttaaaatttgtaataaggttcctcaaagcaaagaggttttgggtctcatcatgagaaagtaagacagataatagaatatgaaactgccccacatagtaaattaccgactgaaaacaaacctgagtacaagtaagtaattttcttctttcaaattcagggaagggtgttggaaacatgacaattaggagaattattacaaagcttatgtattccagagctcatccagagaattctgtttagaaagatctttcagattaattcacgctata

SEQ ID NO: 590724 - DNA, 206 bp, Homo sapiens
aaaaaaaggaaaaacccccccctttattccttcatttcataaaccatttttgggtttttgtgtgggctggggcagcccaactgtggtttttttttcccaagacaatttttaattcccatgtccggtatgttcaaagtcaaaaaactcctctttgtaaacaaattgggtaattgcccaaagcagcctttataaatcaccctaacata

SEQ ID NO: 590725 - DNA, 397 bp, Homo sapiens
  misc_feature (87)..(87): n is a, c, g, or t
  misc_feature (89)..(89): n is a, c, g, or t
  misc_feature (103)..(103): n is a, c, g, or t
  misc_feature (106)..(106): n is a, c, g, or t
  misc_feature (181)..(181): n is a, c, g, or t
  misc_feature (188)..(188): n is a, c, g, or t
  misc_feature (196)..(196): n is a, c, g, or t
  misc_feature (202)..(202): n is a, c, g, or t
  misc_feature (230)..(230): n is a, c, g, or t
  misc_feature (256)..(256): n is a, c, g, or t
  misc_feature (268)..(268): n is a, c, g, or t
  misc_feature (275)..(275): n is a, c, g, or t
  misc_feature (285)..(285): n is a, c, g, or t
  misc_feature (291)..(291): n is a, c, g, or t
  misc_feature (299)..(300): n is a, c, g, or t
  misc_feature (305)..(305): n is a, c, g, or t
  misc_feature (307)..(308): n is a, c, g, or t
  misc_feature (322)..(322): n is a, c, g, or t
  misc_feature (331)..(331): n is a, c, g, or t
  misc_feature (335)..(336): n is a, c, g, or t
  misc_feature (339)..(339): n is a, c, g, or t
  misc_feature (368)..(368): n is a, c, g, or t
  misc_feature (375)..(376): n is a, c, g, or t
ccggtcccccttgccttttttgtcaaagggtttttttcccggggcattcccctggggtgggggggccattggcccccgggggacaantnccaggccccccctnccntgtttgggtccggggggtccttttttcttttccgcaaggttccccttggccagggccggttgcccccgggggaanttttttntttgcccntggtgnctgggggttttccccaccccttcccgcnggggggccttttcctttttccgggtnaatgggttgggnggccggnaaaccccccnttcccngggttttnnggttncnngggggttttttgcncgttccccntttnnatnttttccgggggccccgccttggaattaanccccccnnggttcccttggccccttggga

SEQ ID NO: 590726 - DNA, 396 bp, Homo sapiens
ggcataaagcaggctgccgctatagtggcaactggctcaggtctcttccacgctcacgcctatgggagtgtgtttctttgatctttgagataagcttgctgtctgttcattctttgggtacacactgagtttatgagctgtaacactcttcgtgaagctctggagcctcaaatcctgaggccaccgatgacatgaacccatgggaggactgagtaactccagaagcgcatgcctttacggagggtggtaaatactcacggtggaacagtctggaggttccattccctgaaggccggtggagaacacaaaatccacccgaagggaagaaaattccaaaaaaggttttggaaacattcagaagacaagggttgcaggggactcttctaaaaggtccga

SEQ ID NO: 590727 - DNA, 463 bp, Homo sapiens
ccggtcttcctttgtctcaaacaaaacacaacaacaaaagttactgcaagggtcctatcaggagatgatgaaggactgacaggtacagcatttaccaatggcctactctatgctgtccctgggtgaaattcctgcaagagaggaggaagaatacaaaaactaatggcattagctgggcatggtggctcatgcctgtagtcccagctactcgggaggctgaggtggagaatcacttgaacccaggaggcggaggttgcagtgagtcgagatagcaccactgcactccagcctgggcgacagaatgagatcctgtctcaaaagaaagaaagagagagagagagagagaaagaaagaaagaaagaaagaaagaaagaaagaaagaaagaaagaaagaaagaaagaaagaaagaaagaaaagaaattgacaggaggctaaacgagttttcctagacaaagggaaaca

SEQ ID NO: 590728 - DNA, 81 bp, Homo sapiens
ccctcatgttcacactcctatcccccattctcgtctcatcctacaacatttggatcattaccgcgttttcctcttaataag

SEQ ID NO: 590729 - DNA, 789 bp, Homo sapiens
cgatgttgctatcattagttgagaaattgtcagaagaaatcatggagataatgcgaaatttaagtagtatacaggcctttggagggcagctagagagcttgaaaatcttattggaatctcctggtgctcacatttcttaaaaagagaaatggcgaacacccacaaactatgaccgaacggcgataaccaaaactggctgacaaagaagacagggaccttctctccaaggcattccgcgctcttggccgccgcaggaacccctcaagcccattttaaagtgggggcttctacaaagaaacagcacctgctctgagcaccgaagctcgtgcacgtgcgcctacctatctccaagggaaacaagaaccctgttgcatgggggcgcggcccccggaaccaatgtggccgcgtgcgggtcctggctccccgccccaccccgcaccgcccgcaccgcgctcacaccagtgtcctaccaccgggcgcccccgacgcgcacccccggtgcgccgcaatgcgaccaccccgccccccccaccggagcagcccgccccgcgccacgacacgcacagggcccccacgccagcctccccctcccccacccccccccccccccacgcctccgccccccgcccgtcgacctatcccgtcccccgctgtccgcccccccgtcccatgcgctcgcccgccctgcccccttccacccactcacgccctacctcacctccctccagcacccctcctcgtccacccttttccaactctccgctcccgctccctcgccaacccgtgcgc

SEQ ID NO: 590730 - DNA, 127 bp, Homo sapiens
gaggatctttagccgaatgtatgcgctcgatctcgtctggctcaggtgacaggtcagcatctggggagtgatacgctcggcgttggcgggatgcattggtcggagcagcactcaccggcttggcgtg

SEQ ID NO: 590731 - DNA, 139 bp, Homo sapiens
tattgctaggtctaggtctctggattagcacatgccaggtctactggcatagaagcaaagaatgacacaaaagatacgaacatgttataaaaggcagcgtctaacttacttggcaaatgtgcttgctattattggtttg

SEQ ID NO: 590732 - DNA, 207 bp, Homo sapiens
gggcttatgctgaggagagagctgagcctcagggtgggtttcctgttcccagtgctaccctgcataggggctccttcccaggctctgggcagcgaagaaggggtaggctgggaggggctgccgcagttgtttcacttgggcatggacgtcagacggactcaagacaccaagctttcccatacaccgtgtctctgactcttctttcac

SEQ ID NO: 590733 - DNA, 174 bp, Homo sapiens
  misc_feature (168)..(168): n is a, c, g, or t
aactggcatgggccaagctctgcgtaatagtgaacggttttttggtctggaaggaggctcatgtgagcaccatggttgaaaaggacaccgacggtggtggtctggagagcgggtacccaagagccatatttggttagatgtaatcaacccattttggtgacccactgnaaatga

SEQ ID NO: 590734 - DNA, 418 bp, Homo sapiens
caattaaaaggagcaggttatacagtaccaagagtaccattaccagtctcgactgggagatcaaaaaccatcgttcagctcaacatcacgcagtccagaccatgtgttcaagaacaccatatctgtcaaggctagtctgtagactacaggcagctcgcggttactatttgcaaaaatgatgactgtgtgctagaaagataattctcagcggaccaaatggaaagtgatcagccccacaggaaacgagagcaatggtgccgtcagtctgcttcctcatccccccacccaataaggatgccattgagctggccagcagggtcgaacaatcttatcagaaggtcatggcccttagccatcagctgcatgtcaccaccacaagcctcatctcttggaactatctgcgtaaagaccttgacct

SEQ ID NO: 590735 - DNA, 178 bp, Homo sapiens
tgatgagctcgtaccgactgcatctgtgctcaggatttattaaaacgatggcacatcggatgggcacggtggctcacacctgtaatcccagcactttgggaggctgagatgagcgggtcactggaggtcaggagtttgagactagcctggccaaaatggtgaacaccttttctctact

SEQ ID NO: 590736 - DNA, 513 bp, Homo sapiens
  misc_feature (54)..(54): n is a, c, g, or t
  misc_feature (96)..(96): n is a, c, g, or t
  misc_feature (105)..(105): n is a, c, g, or t
  misc_feature (116)..(116): n is a, c, g, or t
  misc_feature (169)..(170): n is a, c, g, or t
  misc_feature (174)..(176): n is a, c, g, or t
  misc_feature (186)..(186): n is a, c, g, or t
  misc_feature (188)..(188): n is a, c, g, or t
  misc_feature (190)..(190): n is a, c, g, or t
  misc_feature (212)..(212): n is a, c, g, or t
  misc_feature (215)..(215): n is a, c, g, or t
  misc_feature (219)..(219): n is a, c, g, or t
  misc_feature (241)..(241): n is a, c, g, or t
  misc_feature (253)..(253): n is a, c, g, or t
  misc_feature (257)..(257): n is a, c, g, or t
  misc_feature (261)..(261): n is a, c, g, or t
  misc_feature (266)..(266): n is a, c, g, or t
  misc_feature (275)..(276): n is a, c, g, or t
  misc_feature (341)..(341): n is a, c, g, or t
  misc_feature (347)..(347): n is a, c, g, or t
  misc_feature (350)..(350): n is a, c, g, or t
  misc_feature (371)..(371): n is a, c, g, or t
  misc_feature (380)..(380): n is a, c, g, or t
  misc_feature (387)..(387): n is a, c, g, or t
  misc_feature (415)..(415): n is a, c, g, or t
  misc_feature (511)..(511): n is a, c, g, or t
ttttgccaacttccgcccagggattttttcacaaccaaactaaaaatgacttantacatgggaacatcaatgcaaaaagtagaatttgtaaactcnagcccccanattagttactnctcctggttacgggaccttgcccacgagcacctgatgcctcagtgaagtttgnnagannntctgctattntntnccggcagcgaagacatatgccngcnattntgcttccccgacaatttgcatngaaatggccccntgcnaganccttnaaaaaaagnnaaattgcaaagcctcaacacagattcacctcaatccccagagcacaaatgtatataatgggagcnaaggtnggnctgggcattgaacttccagcnatgcaactngcagggnacaatttcaagtgtggaaaccatctgtnggcaagctcttttaaaaacatgaattttagacaccgtaaattctactgcagacacttttgcattactgtttgaatttcagaagggcaccacaaggnac

SEQ ID NO: 590737 - DNA, 110 bp, Homo sapiens
aaccagggtggggggggtttttaaccccgggtggggggggaggggggggttttacggccccgtggcccttgttttactttttttttgaaaaaaaaaccaccttgttttta

SEQ ID NO: 590738 - DNA, 264 bp, Homo sapiens
tattgtcgtgctgggttactgcgtggttacgtgccctcctaagttcttaatacacttttaaaagtacactttagatttgggagtagtttccaatttctggaaaagtgcaaagatagccaagagtgttccctgggtgccctcacaccactatcctccatgtgttgatggtcttatgtctacctcaggtacgttgtgttgtagcgtaagaaacccacgtgacaagcggcctcacgtgacaagcggcctgggctaccgacgctcgaa

SEQ ID NO: 590739 - DNA, 453 bp, Homo sapiens
  misc_feature (167)..(167): n is a, c, g, or t
aggtttcattatgtagacatgattgatgaagtcattggccattggtgattgaactcaacctccaaacccctctctcttccttggaggctggcgggtggagctgaagtttccaaacttctaatcaaggcttggtctttttggtggccagcccctatcctaaagctatntaggtgccagccaagagttgcctcattaaaacaaaagatggtagtcctagcactttgggagggtgaggtgggcggatcacttgagatcaggagttcgagacctgaccaacatagtgaaaccctgtctctactaaaaattagctgggtgtggtggtgtgcacctgtagtcctgttactcgggacactgaggcaggagaatcgcttgaatccgggaggcagagtttgcaatgagctgagactgcaccactgcactccaacctgggcaacagaatgagactctgtcttt

SEQ ID NO: 590740 - DNA, 1114 bp, Homo sapiens
ctgtggttcccgttcttttgcccaatacctttgtttcccccttcgagtgtggtctcttgggggttagagggccccgtggttttccattgtgtttttagcgccccttggtccccccccgcgttttgccaacccccttgtggaccccagccctgttggcccgggcgagtgcccccccccacttattgggcttattcttgggtgggcccagtgaccccctgggggaccatttcctgtcttccaaaccggggcccccgaaatgtggttcccgggagtgtgtccaaccccaaggagtacctgccccctcgcctggccaaataggcctccccgggattatatttccagggagctttttgtcccaagccgctttcaagccagcccttgaatgcctataaaatgtgtttttgagaaaagttacctctaaaagagtggtttttttcccgaggagcccaagcccctcgagggacttggagttttccccgtggcctcagactttcactgagtcctgaaatttccccgctgtaaatgttaataaagagaggcgagattttttgtgtggccctctgacccctcggttctttttcacccctctgttttggacttatttccacgctaataatggttttgggaattttttctgttaaaatgggtgtaaattttcctcaaatacccggtaatgtaacaccccaaaaaaatttgccctgcacatgcccggtcccaaatttttctctgattataaagaatgcgtcctttaaaagacacccaagaagttattcctatgaacaccttaattctttttttatattttgaaattttaaatccaatccctttatataagaccctacgcccgtggaaaacccgtgtacctttttataaaaatttcctgaaatattaaatctcttttagaaattttctctttaatgtgtgaagaccaccaagtatgggggaagaccacgcccatccaaaactaacatttttgtagatagcccatttctcatttcttttataacctgtttctcaccgccccatatgtattcttacccaaagagaatggttttaggctcccgtgttatacttttttttatatatatatataaaaattaactttacgtagtga

SEQ ID NO: 590741 - DNA, 200 bp, Homo sapiens
ccccggagaacgaggcgaacgcggaagagcgccaggaccgaccatgaatcctacctagagaagtagtcctctcaggaaaggagaagcgccactcaagtacttgaaacccaagaccttagagaaattaggtccaagatatatatatgttcagttgtatatgtataaaaataactttactggatttttagcgggggaacagg

SEQ ID NO: 590742 - DNA, 249 bp, Homo sapiens
tttaacctaatcgcggaagacgcttggtcactggagcttctagtggggagtatacctgtggaatggactcactttccatttttggaaacataattccaggtcacgacagcccagtgagggccatgacgtggtcacataatgacatgtggatgttgacagcagaccacggaggatatgtgaaatattggcagtcgaacatgaacaacgtctagatgttccaggcacataaggaggcgattaggggttagt

SEQ ID NO: 590743 - DNA, 154 bp, Homo sapiens
tagctgtactgcactccttatgtatgagggtaaagatataatacagtttattaaaactcttttattatcagtttatatcatccattacatctggcaatgcgcagtggttttatatgtgtgtaaaataatgtatatatcatcttataatggacta

SEQ ID NO: 590744 - DNA, 209 bp, Homo sapiens
atggtaccgccaagcggggaggtcgagggctggcgtaggagacggcgaagacgagcgaatcaccgtacgcctcggcgccggtgcggtgaccggtggcgaggacgaacgcggcgaactcggcgcgtgtgaccgtcgtcgccgcgatcgcgaatggagcgatatccacctcacggaccggcccctcaccgtcctccgggtaggcgagggaa

SEQ ID NO: 590745 - DNA, 769 bp, Homo sapiens
  misc_feature (718)..(718): n is a, c, g, or t
caccgcactgggcgtcggtggggggagcgtaccatccatggcaagacgcctcctgctcatcaacggcgccaagatgcccatcctggggttgggtacctggaagtcccgtacaatgcaggtgattgaagccgtgcaggtgtgcatagacgtcgagatcacgcacatcaactgtctccatgtggaccacaatgagactgaggtgggcgtgcgcattcaggacatgatcagggagcccgtggtgaaacttgataagctcttcatcgtaagtgaactgtggtgcacttaccatgagaagggtctggggtaaagagcctggcagaagacactcagcgatctgaagctgaactaactggacccctaccttatatactggacgactggatcgaaacctgggaaggaattcttcccattggagagagcgggctatgcgtttcatagggacaccaacactttgaaacgtgggctgccatgtaaaagccgatggctcaagggatggtgaaagccactgagcatattaaattttaacctttcctggggaaaatcccttaaaaaccctggtttgaggataaccctgagttaaccaataaaaggccccccttgttcatcaggagaaggtatacaatatggcaggccaaaaaaaattgggacccattaagacactaggctttttgcacggctgggaaaaaagagaaccttaaaatcgtgggggccgtggtangcgattctgtctaacccataaaaaaatccggggggggccgtgtccataaag

SEQ ID NO: 590746 - DNA, 342 bp, Homo sapiens
  misc_feature (29)..(29): n is a, c, g, or t
  misc_feature (31)..(31): n is a, c, g, or t
  misc_feature (253)..(253): n is a, c, g, or t
  misc_feature (312)..(312): n is a, c, g, or t
  misc_feature (316)..(316): n is a, c, g, or t
  misc_feature (319)..(320): n is a, c, g, or t
  misc_feature (327)..(327): n is a, c, g, or t
caggaaacagctatacgattgtgacccanangtccttctatccaaaataatccccatcaatttctgtcctatagaattccacactaaatgtaaataaaacccaaggctttaacaatggatactttaatgccattggaaaacagtgtgctttaggaatgtgagaatttgagacagacccaaaggtggggcaacaaaaagaccccatgaggcatggatgctagggaaatggtgagagcactgaaaacaaactttnaggactttactttttaatccagaattaagcctacctgtgtcctctcaaaaacctgtatntatnttnntctttanggatccattataata

SEQ ID NO: 590747 - DNA, 346 bp, Homo sapiens
ggatccggttgcagtgagccgagattgcaccactgccctccagcctgggcaacagagcgagactgtgtctcaaaaaacaaaaacaccactaatagctataagaaaaaataattgactgggcacagtggctcacacctgtaatccccgaactttgggaggccgaggtgggtggatcacaaggtcaagagttcaagaccagcctggccaacatagtgaaaccctgttctctactaaaaatacaaaaattagccaggcatgggtgtcgtgcgcctgtagtctcagatactaggaaggctgaggcaggagaatcgctttgaacccgggaagcagcagttgtggtgaactg

SEQ ID NO: 590748 - DNA, 169 bp, Homo sapiens
gtaccgcacagcgacggcaagtcaatgcatgcatgacgtgctctccccttgttgtcggcggccgcctggtcactgccacggctcgtgaaaattagtctaggaatcaactatttatgtgtcaaatttatgggtattattcattgcataaaccagactaataacaagggcg

SEQ ID NO: 590749 - DNA, 410 bp, Homo sapiens
gtcgaccagggctgggcgcaatggctcacacctgtaatcccaacactttgggaggtcaaggtgggcagatcacttgaggtcaggagttcgagactagcctggccaacatggtgaaaccccatctctactaaaaatacaaaaattagcccagcgtggtggtgtttgcctgtaattccagctactcaggtggctgaggcaggagaatctcttgaaggtaggaggcacaggttgcagtgagccaagattgcgctgcagcactctagcctgggcaacagagcaagactgtgtctcaaaaaataagaaaaaaatttactgaagaccccaaagagcttttgttacgtgtattaaatctatcaatatttactgtattataaattataacaagcagtttaccgttaagaactgctgta

SEQ ID NO: 590750 - DNA, 111 bp, Homo sapiens
ccctaatattgctgtgagtggtgactggtaaatactcctcacagcagcgggaatgatcaagacctattaatcctgggtgtgggtggctctcgcgagaaacaatcagagaca

SEQ ID NO: 590751 - DNA, 735 bp, Homo sapiens
gacgccgtgtgcagcgggggggcccggaggccctgtgtggccctgtggatgtgggaaccgcgtgtggcttccgcgtgaggtttcggcagtggcattcggggcctggtggtcgcggtccgtggactggggccggggccgaggccgcgtgagctcgcggtagtgcaacggccgacgtgataaggagtggattgcccgtcaccaagttgggccgctttggtcaaggacatgaagatcaagtccctggaggagatctatctcttctccctgccctattagaggaatcagcagatcatatgatttctctcctgggcgagcctctctcagggatgaggtttttgatacggattatgcccagctgcagaaagcagaaccctgttgccggccagtgcaccagcgtttcaacggtcatttgttgctatcggtggtactacaatggccacgatcgtgtctgggtcgttaagtcgctccaaggtacgtgtcggccaccgccatcgcgtggggccagtcatccttggccaatgctctccatcgtccccgttgcgcagaggctactgggcgcggaacaagatccggcaagccccacactgtcccttgcaattgtgacaggcctgcgtgcggctcttgtgcttgttacgcctcatccctgcggcccagggtgcactggcatctgtctcctgcacctgtgcctatgaagctgctcatgatggctggtatccgatgactgctacactcagc

SEQ ID NO: 590752 - DNA, 129 bp, Homo sapiens
gaggatccgtgacagcacagaggaggtggacagcacagagaggaacagaaaggataaggatgctaaattccgtctgcattctaatagagagccgagattcaccgatttggctcgcatattataaagacc

SEQ ID NO: 590753 - DNA, 305 bp, Homo sapiens
tccactagtgtaggctgataacgaggacggtagtgcgagaccagactgaccactatggtgaatgccggcacatgctgaacacacaaacctgagctggtcacggaggagcatgcctgtaatgacatctactcatgaggctgagactgatgtaatgctagagccccatagtcagagatagcagggagccatgatagcgcgactgcactgcagcctggatgacagagctagagtccatctcatgtgattgcccgcttggtctttccgttctgaaaacggaaactacattttgacagctacttggccca

SEQ ID NO: 590754 - DNA, 462 bp, Homo sapiens
  misc_feature (84)..(84): n is a, c, g, or t
  misc_feature (210)..(210): n is a, c, g, or t
  misc_feature (243)..(243): n is a, c, g, or t
  misc_feature (253)..(254): n is a, c, g, or t
  misc_feature (267)..(267): n is a, c, g, or t
  misc_feature (287)..(288): n is a, c, g, or t
  misc_feature (299)..(300): n is a, c, g, or t
  misc_feature (424)..(424): n is a, c, g, or t
gcaaacgcagaaggactgcctcactgagcaaccaagagtgtcagttgtacccgagcgcgttctcagacgagcagcaagtacctncgtggtggactttccacggctgaactgaggcaggcattcttagctgagacaccaagaggtggttaaagccatattggagtagcgaggaatctgattccaagcaaaaaccaggctccatctactctnttgaagcttctgcccagctgtgcattgtgttcntcaggagaanncccgcgtcatacnctttgatctatagcgcttcnnccctaggtctnntcagaagcatcaagttttaacttgtggacattggattcggtggaacagcaatcatgactgttggcaagagtagcacagatcgctgcatgcacaatttgaactatcagacatgagcatgtatccntgcaagatggcccgaatcttcatcggcacctttaagcg

SEQ ID NO: 590755 - DNA, 351 bp, Homo sapiens
tagtttttaacagcatattttttacaaaggaaaaaaaaaagccagatgtggtggctcatacctgtaatcccagcacttttggggaccgaggcaggtagattgcttgagtcctggagtttgagaccagcctgggcaacatgataaaactctgtctctaccaaaaatacaaaaaattagcgaggcatggtggtgcacacctgtattcccagctattcgggaggctgagctagtgaggattaaccgagcctgtgaggttgaagctgcagtgagctgtgattgtgccgctgaattccagcctgggtgacaaagtgagatcctgtctcaaaacaaaaacaaaaacaaaaacaagaa

SEQ ID NO: 590756 - DNA, 688 bp, Homo sapiens
  misc_feature (1)..(1): n is a, c, g, or t
ngtaattttcatccttaaacacccaagaaggttcttgtggtccaggttggttttagggcggtgtcagcatctttgggtgtccttgaacccaagttccgttaagaaaatggccttcaggcacccaggtgctcaagttgcccttcaagggcgtaactttctccagggacctcttaaagccgaagcctcatattagcctgtctaagctgtataagatctctctcctaaaggttctcaaaaaggggctgcataaattgaattagatgatgatggtggaccacacgtgccgcaatagcattcaggacggtttcaggtccaattaataacaaaaaggcatggctctcgcccttctggtcaactttgtaaactcctttctcccaggtattgttgcaaaagtcccagatgtcctttatgtaacagatgcattccataaggcctctcttcaggtacatgaggaacgcagtacagcaggttcaagatgcgtggttgtgaaagatgggcgttcgataaacttaagcagggtaacattcttgaaccaacaggcctcttttggttttaaaaagacaagttcctctgtacacaatagtcctcatgggcatagtattcaacccctgtgttaagtttaatgttctaaagcgttgccggcttccaatttttggtgtgtgctcagaagtaaaaataaatacaaact

SEQ ID NO: 590757 - DNA, 393 bp, Homo sapiens
cccgggctgcaggaattggcaccaagagatagagaattacagaacctgcgatccattctggaaatactactactatggatatgactacattgacttcaacacagaaatcccaccctgtgtcccatgtgaatcaactgcccagataaccaagcagatgtgataggcagaaccagtctacgtgcattgctcctaggcttacctggaggacgattgccctgcgactctgcagaagtacctgatatacagcataaatattctgcaccggcaggatcctacctctgtgatggtcatcagtcaccaagcccacgcaggaagaaactggcgccttgcctactactactacctagtgggagatgttctctacactggtggcacttaccagccctgggtggg

SEQ ID NO: 590758 - DNA, 177 bp, Homo sapiens
gcggctccaggggcgggggtcccagaattttttctacagtggtttcaggcggctcgccccggttactttcatggcgatcgcgccggagatcgcgcggatgaagcgcacgtaggcttttcggctcggaacgtcgaagttcatgtggatgtggttgtagttcaccgcgtagcggatgag

SEQ ID NO: 590759 - DNA, 544 bp, Homo sapiens
  misc_feature (459)..(459): n is a, c, g, or t
ctctgggtgattttttcatttaattaagttttaaaatcacagtaaatgtcattatctctatcaagattgagattaataaacgtattcagagtgttaattatttaagcacttacaaaaggaaaattgcaaaactgcaatgggtaatgaatctaatagtaagtctaaatagagaattatttaatttacttcctgtaattgatgaaacaaatatagagaatgttttttaaccagtacatgtattattacacccccattttggagtacacactctagggcctttcttctaaatattacaattaaccatttttcttccctatgctcaggccctttaactcctcagtgaattaatttaaatgggtaattatcttcaactatccaatgacgttgttcttttcctgtctgcctgtcctcatcccaaatttaacaagtgcttattttagtttagatcacgagtgtttngcagtatttttgactccgttcttaatgccataatttttttcccaatctttttaaacttacgaagcagtttcatataaatgatctt

SEQ ID NO: 590760 - DNA, 516 bp, Homo sapiens
  misc_feature (459)..(459): n is a, c, g, or t
ctctgggtgattttttcatttaattaagttttaaaatcacagtaaatgtcattatctctatcaagattgagattaataaacgtattcagagtgttaattatttaagcacttacaaaaggaaaattgcaaaactgcaatgggtaatgaatctaatagtaagtctaaatagagaattatttaatttacttcctgtaattgatgaaacaaatatagagaatgttttttaaccagtacatgtattattacacccccattttggagtacacactctagggcctttcttctaaatattacaattaaccatttttcttccctatgctcaggccctttaactcctcagtgaattaatttaaatgggtaattatcttcaactatccaatgacgttgttcttttcctgtctgcctgtcctcatcccaaatttaacaagtgcttattttagtttagatcacgagtgtttngcagtgagccaatatctcgccattgcactccagcctggatgacagagcgagactcag

SEQ ID NO: 590761 - DNA, 373 bp, Homo sapiens
  misc_feature (13)..(13): n is a, c, g, or t
  misc_feature (16)..(16): n is a, c, g, or t
  misc_feature (71)..(71): n is a, c, g, or t
  misc_feature (139)..(139): n is a, c, g, or t
  misc_feature (195)..(195): n is a, c, g, or t
  misc_feature (261)..(261): n is a, c, g, or t
  misc_feature (327)..(327): n is a, c, g, or t
  misc_feature (337)..(337): n is a, c, g, or t
  misc_feature (343)..(343): n is a, c, g, or t
ggcgcaggtggtnacncctgtaatcccaacaacactttggaggccccaggcaggcgggtcatgaggtcagnagattgagaccatcctggctaacacggtgaaaccctgtctctactaaaaatacaaaaaattagctggncgtgatggtgggcgcctgtagtcccagctactcgggaggctgaggcaggagaatgncgtgaacctgggaagcggagctcgcagtgagccgagatcacgccactgcactccagcctgggcaanagtgagactctgcataaagagcatacccatgtgtgtacctatctatctatctatctatctatctanctatctatcnatctgnatatagatatattaaaatgtaaatggtggc

SEQ ID NO: 590762 - DNA, 155 bp, Homo sapiens
agcgctcggatccccatctctttcttctttttcttcttcttctgcttggggttggtgacgcgacgacacgctagactcccgaacaacggcgtaaggtttgggaggctcacggagctggtgtttagcttctcgggcacgacgctgaggatcaaaag

SEQ ID NO: 590763 - DNA, 227 bp, Homo sapiens
cacgacatcagatagctattaaacaccagcatcttctaaaattaggcagcgttatcatagccgccaaggctcatatagatgacttatgacccctttatccaccgcatataaaatgccttgcggcaatcgtgtagatcgctcgcaccccagccgccattaaagcacgtcaatcggcaaacattttgacgttagggttgattccgtgcgccccgcagggcacccactcg

SEQ ID NO: 590764 - DNA, 362 bp, Homo sapiens
  misc_feature (155)..(155): n is a, c, g, or t
  misc_feature (192)..(192): n is a, c, g, or t
  misc_feature (201)..(201): n is a, c, g, or t
tcctccccacggtgagacatcactacagccacactccatctgcccacagtgagacatcactgcagccacactccatctgcacacggtgacacatcactgcagccacactccatctgcacacggtgagacatcactgcagccacactccatctgcncacagtgagacaccactgcagccacactccatctgcncacagtganacatcactgcagccacactccatctgcacacggtgacacatcactgcagggtagaaactcccccatctcccatgcagcccccagcggccgccatcacaggtctcactgtctcgccgtgtgtgtgtaacctgctttctccccagctcccacttcgtgggcag

SEQ ID NO: 590765 - DNA, 332 bp, Homo sapiens
  misc_feature (56)..(57): n is a, c, g, or t
tgccctgctctgttccccccaggtggagtgcagtggcacgatctcggctcactgcnnaccccccccctcggttcaagcgattctcctgcctcagcctctggagtagctgggattacaggtgcccaccacctcgcccagctaatttttgtatttttagtggagatgggattttgttggccagggtggtcttgaactcctgacctcagatgatccacctgcctcggcctcccaaagtgctgggattacaggcatgagctaccacaccaggctttctttgttttcttctagaaggtttagaatttacctttcttcttttttttccctccctccct

SEQ ID NO: 590766 - DNA, 264 bp, Homo sapiens
  misc_feature (179)..(179): n is a, c, g, or t
acaccaggcatcgcatccatcaggcaaggtcagcagagcagcaacagtttggtattgcaacgtggcagcacctgcaggtcagcatccatgcaatgcaccacagtcccagcccacacatgcaaggcaggggccaccatctgcacttccagcgcacatgtggccatcattcacagggcaanacattcaatcctccagtcaacacacattgtagtcgttttcatcacaagcgcattctcaacatgaggcccaatggcacagcacaac

SEQ ID NO: 590767 - DNA, 457 bp, Homo sapiens
  misc_feature (450)..(450): n is a, c, g, or t
atcctatgtttgaaccatgcccaaatgtggtcttgctgcggatgcattctgctgtaatctgtgggtcacatgttcactcctgggagtatggaccggttgcgaattttatggacgacatctggatagtacctcagtcctgcctagcgttatgtcatcgcgcctgatgctacgcgagacactgctgaattctgctggatggaacgatacctgtgaccgttgcatataatttgtggcactatctgagatgaccatgaacctctgccggtgctataagcgcaatgcaggcttttatcacaagcatgctgtcagtgtgacctttaaggtatgccccctgactaacccactatctgtgaagatccatgccagtagactatgggagataacctgttacacagagtgcttacgatgtgagctgagacaatgcgcttgcgcactatgctctaggacaangtatgtg

SEQ ID NO: 590768 - DNA, 1871 bp, Homo sapiens
  misc_feature (402)..(402): n is a, c, g, or t
gtacacgagtctctccaatctgcaaacttggtctattagcttgaccgagctctggccataagacgagcttccgacagtgagtcattctgatgaatgattgacgtacctgaatttctgttgtcatgcttggcagtggcggcgaatcgttgcgaaagactcttcatgtggacaagtggcgcacctatgtagtcctgggtttcatgcatctgtactgtaagcgtggatagcataatggtgtttacggagtatcttgcgtctctgtccctgtctatgcctgtgtgatgtaccaagcatgcaatgaaaatttattacaaatggctcaacaagtcgctgcacggtagtcgacacggtttctgtgcgaggagcctatcttgtgagttggcccgaagcaagtaggatgcnaagcgacgcccttgtgtcgtagcatacgcgccgctgtctactctatcggtaaagtgagtacttcggctcatggcgcttgtgctactgcgagggacactctgaggcctgtgaagactggttgtcttccacgatgagtcttttgcgttacaacccaacgacccaggttcgcttctcgttggagaagtccttttacactcctcagcggtgtctagcttcctatgttatcatccactggttccatgccaaagcccaactactaaggcacgcattttttcctactccaataacgctctatccccttctcctacgtctctagatctaagtacatttccctccgtggcggtttgatagatagcactatcacgatcaacgccaaataatatgtccttgttcacccaccgagggcaaagagccaacagtcttatgggaatctatacggaacatggcgcacttttatagccacggtaaactttgccctaataattgcttagaattgcaaaagcccaacggaccgcaagtgggccacctttccctgggcacttctgagccgctttgaccttccggaacaagtcgctttgacagacacctccctcgtgcattgagccgaaatttagagctcgccccttcaacatctttcaagccctttgaagcaactatcttttaaccaacgccaaggcgcgggccgcgccttaaccttaacgccccacggtcaatgaccactctcttggtgccactccagcgtgcgtcccgcgcatcgggcgtgccccctctgcgcgcggacttccacctctggttggacacgcccgctcactcacccgacacggcgggtatccccctccgcgccctccgcattcagcacgcgcgccacctctgcgtctacgggcggtctcctcccgggcagacgcgtctcgccgtacaacgtcgcgcagctcgccctgtatccccgcgagccctcttcaacaattctccgctctcaccacgcgtccctgttagagggtccctcacctctttcttcttctcggcgccgccgcctctctgtgatgccactcattctcctccctcgcaggaggagtgccccacacaaggaaaatcacgctcaaggcacgcgttccgccaaacgataccacacgtgccggcgacaccaatcacgggggaacgtccaccaagaattgctcaaccctcggccgacgtgtttcaatcacggtgggacaatgaaagaacaacaaattgccgcccacaagcgatcgtctgcctgtcacacacccatcacgcgccgcagagcaataacacgaacgagcgagcaccagcacgaatgatctcgcccacacgcacacgacgacttctcagcacagcacagaaccaagccgaacttcgcgcagccgtcaaccaaccacgcacgggcggactaaccaccactcgcacacctctaacatccagtacgaacatccgaggcacacacgaaccactca

SEQ ID NO: 590769 - DNA, 569 bp, Homo sapiens
tcggtctacctgtttgtaaaatattatttctctttcccttatgaagcttaattaggctggatacgaaattctaggtcgaaaattcttttctttaagaatgtagaatattggccccactctcttctggcttgtagagtttctgcagagagatctgctgttagtctgataggcttggctttgtgggtaacccaacctttccctctggctgcccttaacattttttcctttatttcaacttgggtgaatctgacgattatgtgtctttgggttgctcttcttgaggagcatcgctgtggtgttctctgtatttcctgaatttgagtgttggcctgtcttgctaggttggggaagttctcctggataatatcccgaagagtgttttccagctcctttccattctcccagtcactttcaggtacaccaatcaaacgtagatttggtcttttcatatagtctcatgtttcttagaggctttgttcattctcctttttcattcttttttctctaatctggtcttgacacttcatttcattaagtcaagacaaggtagagccgaggggtaccgagct

SEQ ID NO: 590770 - DNA, 201 bp, Homo sapiens
ctgactactggggaaggccaagctggacaggaggacagggctgctcaccggaagccatctacggagtggacagacgctgattactgatttatgaagaaccgcacgtcgctgattggccagcggtcggagcggcagggtttcacaaacttcttcacgaggtgcacaaacaggtgtctgacatctttattgggggggagcgcc

SEQ ID NO: 590771 - DNA, 1254 bp, Homo sapiens
gagctgggttattaggcgtggcgcgagggtgctgagtttcttgtcgcgcccgcgtcgtcccaggctcctctgtgactaccatgtattcgtcgccccatcgttgggcttctctttcgtccgctcaggcctcgctttgtctccgctcatatcaccccggtcacgcattaggagtctggccccaagtctgttcgtggagcggcccaggtgtagccggtacactgcggtgcaagtagtcctgtgtgagcactctaccatacgaccagtatgggagcgtgcagcatcgatctcagtgcatattgatcctctgatcggaacgaaactaaatactgtgggcctatggactgacttgccacgataactaacctcagatataaaacactcgaagaagcccagctacttctagcatcatccgatactcggtgtgacgtgttggacatgtcacgggcatggcggttacctctttggagagactgggaactctgctccaatagattcaacctccaatggtacgaagatgacccagccattctgcaaactaacatgaacacactttaacctctattgaaatttttaactcaatttatttgtatccatgaaggatcagagaggatcatctggctctcatgtatcagacccatgcgtcgtggatgctgcaatgttgtgcagacgtaggtctccggagctcagcgtgctaaaacttcctgctcatcaccggcgagttcatcggccaaattcgtgctgcacatcaactccatctcgacagatagccttggagcacttatcaaacgtcgccacgtcgacccaacgccccggctctaaatgttgcaagtacgtgaacattttacactagcgtcaattaagctactcactagcgattatggtggaggacatattagagtggatggaatgccctagacagcaataaccaattcaccatgtcacctcatgcgtttcagaccatacccttcaagatccatcaagtctcttcagtagcgcaattcccaatggacccgcacaattgtttacattaaatatcccctcacaagaaagaaatgccaagaaatccctacgcagggaaccttcggagaaagcaaattaccaccgccaatggaccatttgtaccaatcgacgccaaagttacagcacgatgacaccgttaacgagagacacactatgggaccggaacaacgtttataggatacccaaggcttgatcccaaaggcttacagaggaatttgaccgagggtggatagc

SEQ ID NO: 590772 - DNA, 151 bp, Homo sapiens
tgtcaccttgtcacaggaatattttgagcatggagatactaattgaagttgcggaaatgttaagagatttaaatcttggtgaaatgaaaagtggagctaccagtgttggtcacgtatccttatgcattggtagggcgaaggctagatcata

SEQ ID NO: 590773 - DNA, 694 bp, Homo sapiens
  misc_feature (78)..(78): n is a, c, g, or t
tagcttttaggcctgtgtatttctgtttgtgggttgtgcccccccgcacacgtgctgctttccaaggaagttcccttnaaaaaaaaaaaaaaaaaaaaagcacataggcacatacctagtgctgtttctttcctcttcagcttgtttgtggttgctctgtagtgtcttaatagactttgtccagagtttatagttgttatctgctggagagttggggttttaacctgaggctttttgccactactggtggaaatctacactgctcgcccttttaagtctttttttatcctctaagtttcctctccagtcactcattcttattctctgccctcctgctaaccaagtcatttattccaccttctggattttgctaatgccatccacgtagtgtcaacgttcctctgttctcccagttacctataaaccggtggttggctgtagtagtttcttaagattcaggcttaatttcaggaatgggaaagatccactatttcataggttgtgtggtgtttttttaatcgaaaaccactttaaaagttttaatttttggtcatgttagcagctaatgctcagtgcctacatccactaattagcagttgtaaaatggtgatagtctaactcagtagttttccaagtacagtttgggacttgtaagggatccttgagaccttttcagaggttctttaaagttaaa

SEQ ID NO: 590774 - DNA, 164 bp, Homo sapiens
  misc_feature (144)..(144): n is a, c, g, or t
ttgttctctatgaattagccgcagtactttgacatctgatgcccggacacgagcataatcaaactgttacaggcttcaggctgactgtgctgtactgatgtgctgctggtgatgtgaattgagctgtctcagaatggcgacccngggctgcctactggctacac

SEQ ID NO: 590775 - DNA, 513 bp, Homo sapiens
ccccacagtattcatttcttggtctacgcctgtgactccagctacaggaaagttttccaccaaagtcacgctttgtacagatgctggagcgaacaccgacccccgccccatcaggtatgttggcatttatctgagaagttcgctgttgtcttagtgcgctgtctaatccaggtttctcagccttggtaccgttgacattttgggctggatgattttgtgttgtaggggttgtcctgtgcactgtgtaggatgtttagcaagcgtccctggccttaactggttagacaccagtagcacttccaccagttatgacaaaccaaagtatctccacatgttgcccatggcccctggggggacaaatcagcccaagttgagggctcttggcctaactgaataattcttgctggagttatcggggtgtggggatcgggtagtgtagaagagtggtaaaggcctgaacaccgtctgggactgaatctcagccgtgctatttactacttgggtaatgttgga

SEQ ID NO: 590776 - DNA, 275 bp, Homo sapiens
aggtatcccccccctccccgggtaatgttaacattgacattatcttctttattattctactttgagtgctgtctccatgtttgatgtatctgagataggttgacctccacaggtagactctagagtatggctggcgacttagagatggggagcagcagcaatctcttatccgacatccacctcttgagtcagatttgaactctctcagtctcttgcactcaaagcttgttacgatagttaagcgtgcattatttaacttccaatttccatatccc

SEQ ID NO: 590777 - DNA, 281 bp, Homo sapiens
tgcctaagccacccaagtagctggaattacagtgtgtgccaccctgctcagctaatttttgtatctttagttagagttggggtttctccatgttggccaggctggtatcaaactcctggactcaagcaatctgcccaccttggcctccccagagtgccaggattacaggcatgacccatcttgcctggtcagtttttttttttttaaatccagttaatgctgggtgccatgactcacacctgtaatgccagtgctttggaaggctgaggcgggaggatcac

SEQ ID NO: 590778 - DNA, 514 bp, Homo sapiens
aaaccaattttttgaggccttgcggtatccgcccccaataaaagcaattccaacctttaaaaaaaaaaggggaaaaaaaaagaaaaaaaaaaaaaaaaaaaaaaaaaaaaaaaaaaaaaaattacggaaaaaaaaaaaaaaaaaaaaaaaaaaaaaccatgtgggccgcctgggcccaatcgattttaaactcaacaaagttaatgcatggggccgaatttcgagccaactgggcaaattccccctatagggagtggtttaaaaattaacgggccgtggtttaaaaacgccgggacgggaaaaacccgtggtttcccaaattaaatcccctttgaaaaaatccccttttcgccacctgggtaaaaacaaaaaaggcccgaacctaatcgcccttccaaaaaattggcaaaccctgaatgggaaatggaaaatggaaccgtaaaaattttgtaaaaattccggtaaaattttggtaaaacaaactaatttttaaacaatgggccgtcggtccttt

SEQ ID NO: 590779 - DNA, 285 bp, Homo sapiens
gagagcgcgaagtagagaacaataatgaacaattattgtatgaacactagttagagacagctaatcacaaacaacctgcgggcacaatgacctcattccacacgtagacacccttcaacaggaccctataaaactttcctccagcccttgcctctttgcaggtagccccttctctgctgagctgcccactgcaacatatttacacaatttctctaataaatctgcccttctttacctacaactatcttggtaaatggctttaccacctgcaaaactgaccctagg

SEQ ID NO: 590780 - DNA, 259 bp, Homo sapiens
caatagagtcggtggaggagggagacaaacaccacctgacactactgcagaagtaggaggacaaactagaaccggcacctgagctagaacctgatgccaaatgagaatatccccgagtcggcggctgagctggtgcagctgggcttcattagtttttgcagaccagagccggtcgacttctctgctagaagagaccttgaacaagtacaattttgccaggatcagtaccctcaactcagccgctgccggcgctgcagac

SEQ ID NO: 590781 - DNA, 746 bp, Homo sapiens
gatttttagttatgtaactgatatttgttagatttctgatcttcattttactcatccaagtacggaatcaatattgaaaggctcttctgccattctgtatatctcagattgagttctgttcaatactagtctgtaaaaggatttagtagatattttggggaaggtgtccttgattaaatagatttgggaaactataacaataatcctctttggaaatatcacagtgcatattatattttaaatgccccagtgattcctgtagttgagaagtttgtttaaatgtgtttaacctagcattttctttctctgtgggacatctgttaatatctcaagagacattaggattctgaggaacataatatgggaagctctacattagattaaggtgatttaagaatgtcactacttgtttatatttgtgtccttgggatgttgagagggagtgagaatactaaaatatgtgttataatttcctgttgttttacatattttttattaatcctgaaaaattaatatcagctgaagaattacttgtagtaatctttaaataatttggctcttaatgacttattagatagttagaaccttctatgttcactgactagatcaaagtaactttgatatgcttattgacaaccatgggagatgttttaataaggagatagtctaagtaattcttagtatacatagaattgaaaatattactttggtaggaatatgaaagataataataacttaaagaaaaa

SEQ ID NO: 590782 - DNA, 208 bp, Homo sapiens
attgccctagggtgtccaagaggccaccatatagagctcaccttttatggacaggtgggagatgtctgaacgcaaccacatgttgcccggtgacaggggctgtgctgaccaggacacggagagtgacttgccttctgaggctgagctagtcactcatacgcccaggtaggcatgcctacctgggcgtatggcagccaaggttaggcgg

SEQ ID NO: 590783 - DNA, 1304 bp, Homo sapiens
gatgtgtgtgtgtgttgggttgtgatgtggtgtgatcgtcgtgtgtggttatatgttcgtggcttgttgtcgtttcatcgtggtcgtctgtggttgatgagttgggtgggtgattgtgcggagtcctggtgggttgagcttgtgtgttgtgtggattcctcgtactgtgttgtctgttgtgggtgctctttatatctcaactgtgatgagtgtgattccgactgtcgtcctatctcactgtctgtcttgtcctctggtggttctctctgtgtgtgtctggtgtgcgggcgtgtgtcttcggtgttgatcagatgttgttcctgttgtgagctcagcgctgtgtggtgtgtgtgagccgttctggaatatgcagtccgttgttctcgtgttcttctgtcggtgggttgtcggtggtgcggccctggggcctgtggttgtatgccgcgtgcctgtggtgatgggtgatctcttgtgtttttatgtgtatggtgaagttgactgctgctagcctctgggatgaggtgatatggctcacttcgttagcggtaggcgtagatcccccagggaaggtggagctgttacaatggtatataagttcaatctgtaatgttgcgactgagtttgatgtgttaagagtaatcattgtggttacttgttgtgtttgtaaattgctgttggtttgtggtttgatgcagatgactgtggaatggaagcaccttttgcgtgttctcactaacctacacagctctgtgcagaggcgttcaggtgttactcagctgcatagttacgcagatgtaatgcacattacttggcgtatctttaagttggattcaaatggccatttttctccaattttggtaaattggatatgctttttgttgtacaaatacgaccattaacctcagttaaatttttgtgtgttttcctgttgtgatgctgtctatttgcattgagtgtaagtcatttgaactgaatggtataactcctaaagctttctctgctccagtgtgatttttattaaatatttttcacttggcttatttttacacaactgggaacataaagtgcctgtattgtgtcaaaagctgtcactcttgtttcttagtggttcagagaagcttcatcttatgtctcataatgacgttctatctctatgttcatacaggaaagacaaagtgtacgtgaatgctcgctgtctgatagggttccagctccatatatatagaaagatcgggggtgggatgggatggagtgagccccatccagttagttggactagtttaaattcatgcttttccggttta

SEQ ID NO: 590784 - DNA, 887 bp, Homo sapiens
  misc_feature (8)..(9): n is a, c, g, or t
  misc_feature (16)..(16): n is a, c, g, or t
  misc_feature (22)..(22): n is a, c, g, or t
cattgaanntcccttngctagngacgcgcgccattgtgttggtatccgggacttcggccattatggccgggggcatctcgaatcgccgagcgacttaggagtgggagctgacatctgacccgagtacccattagtctgccttgtgccttggtgcttcaagctaaatcgaaatgcctaacggttggcctgaaaggtactacggactgcccaaggcccaggccaattgccgttcgccgatcgccgagtgccagttcccagttccccgtgttcatcgtcacctgacacctaggacgtccaacgaccaaccatggacctctactcccgactgccactgcgcacacatcatgcattccgtaacccctgacctactaggtccttcaactgacgcgtcatgcgtcttaaggcttaagggtataaccgattaccacttgcaacttgctactcgctatgatgaagaatggagaactgtaatcaaggatacaggctccaatggctgtgggaggccacacatcccacattctctgatcgctaataggggacacggacaactgactactggctgcctggagcccgggatacctgatgactcaagactctaaatcatctgacaactgtccatgagtgcacgattccatgtgacttggataaatacacaaatcctcatttttggctattttgaaatgatcatggatgcaagtttgaaagtctatttcgccctttccaccttcccaaatttcgggttttaagccttaaccagttttaacggggaccttaaaggttcctataagctcttgaattgtggagttttgggttttgttaacggttttccgaaaaccagcttttttaaatttaatccgctccataagtccaaggctgctttgtggctt

SEQ ID NO: 590785 - DNA, 101 bp, Homo sapiens
tctccttccagagctagaaacatcagggtgtcccaacccagtaggtgtaacgtcaccttgactgcaattcttccccagtcacacgcaacatttagacatcg

SEQ ID NO: 590786 - DNA, 122 bp, Homo sapiens
taaaagttctctttgtgacccttcatttctgaaagtctaaaaatacaatttgagaatgtctataatacattctctcctgtctcttcacggttacgtctgttattgctgaaatacaccacatt

SEQ ID NO: 590787 - DNA, 146 bp, Homo sapiens
ttagccacctcccacagtgagaaaaacaaaacaaaccaaagggtcttaattaaacaggatgaacatgaacaataaatacttaaatagacatcacgacatcctacagttctcgacaccagataaacataacagtattaataataaag

SEQ ID NO: 590788 - DNA, 170 bp, Homo sapiens
  misc_feature (108)..(108): n is a, c, g, or t
  misc_feature (113)..(113): n is a, c, g, or t
  misc_feature (140)..(140): n is a, c, g, or t
  misc_feature (160)..(160): n is a, c, g, or t
gtgaagcgcagctagctgcgaaaaattaatgtgaattgcaggacacaaagatgggaacaaaagacctggggcctccttgaattgtaaagggcaggaagaaaggacaanagcanaaaaagtaactattggggtgctaggcnaggtatccgggtgacaaaanaactgtacac

SEQ ID NO: 590789 - DNA, 508 bp, Homo sapiens
tctcccgaatcccggacatggcatcctgtaacaggctgcggaacacccaactaacgcggtttgctgaagactctactcaacccgcgaccctgtcctatcagaacgagagtcttgttccctgccctgaagctggcagttcagtcccttattctgccctgttggaagccctgctgaaccctcaactattgactgctgcagacagcttatcttcctaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgc

SEQ ID NO: 590790 - DNA, 326 bp, Homo sapiens
  misc_feature (72)..(72): n is a, c, g, or t
  misc_feature (128)..(128): n is a, c, g, or t
  misc_feature (144)..(145): n is a, c, g, or t
  misc_feature (149)..(149): n is a, c, g, or t
  misc_feature (151)..(153): n is a, c, g, or t
  misc_feature (156)..(156): n is a, c, g, or t
  misc_feature (160)..(162): n is a, c, g, or t
  misc_feature (184)..(184): n is a, c, g, or t
  misc_feature (189)..(189): n is a, c, g, or t
  misc_feature (193)..(193): n is a, c, g, or t
  misc_feature (200)..(200): n is a, c, g, or t
  misc_feature (212)..(212): n is a, c, g, or t
  misc_feature (218)..(218): n is a, c, g, or t
  misc_feature (265)..(265): n is a, c, g, or t
  misc_feature (297)..(297): n is a, c, g, or t
  misc_feature (302)..(302): n is a, c, g, or t
tggaaggcgggaccccctctggtggcgggaccccctcttgcggtggtcttgcggggccagccgggacctgtnactttattatttaaggagtgtgtgtgtagagtcgctggcttattaacagtattgtntgtgggttgggttttnntttntnnnttntttnnnaagtcccttcatttcaatcctngactntttntcccctncccttgcccagntctgtngaatgctgctgtgcgcgtgtgagggccgctctgaacacagggccctngggttgtgtgaactgaaattctccctgtattngtganactcgcaggagtccccatctgtag

SEQ ID NO: 590791 - DNA, 739 bp, Homo sapiens
gggttccccctcccccttttatgagtgtgtgtccccgcttttgtgaggtgtggcgggtttctccacaccccgcatgtgtcacactgtcccctgtctcgtgtttcacttgtctgggaatacaaccacacacgccgtgggagccccccctgggtcccccccgtcggaccactctttcggtgctttcgtgggaagggagaggggcacaccataggggggaatggcctagttgggaggccacgagagaagaaaaagagagtggcgctgtgagtatcacttgtgagagagaattggcacaccttgggccacaatgccactggacgtttctctcgtctctcccacagagcgcgcacagagacttgccttggtctgtcacaggtgtttatactttagctctaaaggcgttcttctcttgtgtgattaactcgtgtgtaataatgataatagataaaaaagtgtgtcgtgattaacacacggctctgaagagccacctcttggagtaggtagaaaagctctgtgtcacttaggtgaggttgtttgtctgtcacacacctgtggcacccagttcactttgagttgatggaaatatttcacgtgaccccacatggaatgccctatcgcgtttttttcaaccactctttatgctattactcatatctgatttatagaaatgaatttctccttttggccaagcgtaccccattccatatgggtataattaaagactttatgtccaactgta

SEQ ID NO: 590792 - DNA, 970 bp, Homo sapiens
ggtccggctcgtgggcaccgtcctagggggttgttgcgcgggtcgacagtgcccccatgaacgggcggcagcccagtctgggggagctctcggcgctctgaacggtcgggccagtgccggcgagaccggtgtgatctgtgctccccctagcggcctatatcgagatcgcgccggtgtacagctatcaactggcaagatctggtgtaggctggacagagagctgcctactagagtgactaacaggagggcttcaaccttgcgagtgatgatcacgccgctggacgagtgtatccagaaggagcatgccgcgcagcgcacgctggcgtggcgctgccgtgcgtgcgtcgacctcaacagatgagaaaacggtgactgctcattagcgcgggaggtccaagaaatagcaagcatgggactatggcgctaggcacaatcgctggcgcgcaagtgctttcgttggccatggacgggcggacatccggcgaagtaaaatcggccatagcgatccgagccgcagcaagcgtatgcactagcaacacgggcaacgatcggctttaccaatggatggaaccgtacgtgggccgagccagtagagaaaggaccctctgacaacatgaagcgtagcaacgcgtaactgacaggcaagacggctacgaactctgatgcgcctatcgtacgcgctcgccgctaggcgaccaagtgcgtgactcactgtgtgcccactacctggtcaaagtatggcatcaaattaaagaggcctctatgcgtagagtaatgccagaagcacggtctcacggttcgaattgcgcatgaacaggatcccaaacagtacatcttggactgacgagatgagctaccagaagacaacccagtacttacatctttctcaactggacacagcctcctggtagacttggggcggccaaaaccctggcacagggaagacctgaggccagcccagaacctgaat

SEQ ID NO: 590793 - DNA, 1191 bp, Homo sapiens
gggtcggcgggatggccccgccgatgctcctagttgtgccggtttgtgtcctgctggtcccttctctgtgtgaggccctgatcccgtgccggtgcctcaggcccgcacctatgccacctcgcgggggctccggcggggcctgcgctggttcaccgtgcaaattcggcctctgttgggtggctgggggggatccccttgagttgctttggagccaggcgactgcaacggcacctcttggccttggtgagttaaccctggagaacgctggagaagttgtgccttcctttggcgacacttccccgggcggggatcataaacgctgttggccgaagcgttcgtatccaggccgtttacccttggcattagctggggacaacccttgggcttaacccaatctcgagacacatctgcgtctgcgaacggtggaaacccctggacgcactattggactatatcaatccacacgcggtaagtagggcggccaagaaagaaaatatgcaaagcttgcctctgtgggaccactttcacaaggcccaccactatatgtaacccctattagggcagggggactattccgcacctatcacgcgtatgtcgcagtaccatacatttgcggagtgcgcctgcgactgggatatggcacgaaaccacaacaatattgctggcatagcgtaatcccctcgtggtaccccgtggatgggggacaaacccatgagtaacccggcacgggcagcaccaaaggaaagtattcctgagagagtcccccacatttgagagagggggccacaggggcaacaaatttccccaaatgctggaccaggggacaattccacaaggtgaacgtgcgccctggtatatataccccacaatactgcgcctcgatagggtgtagcccgaaaagacgttgtgggccaccttggacacacccaacataggcagacgcagggggaatttcgtaggtggttgctccgcaggaccttaatgaggggaaccagagggctcactgcgaaagttacgttcgcaagttatcaacaccacaggggtttggggctcacgcgaagattgtagacacagcgtgctgttcaacgtcgtgacactgcagttcggccattattattggcgacccgatacgaggcaccattctaataccccggggagagcaccaagaagggtaagccgccgcgtcatatg

SEQ ID NO: 590794 - DNA, 531 bp, Homo sapiens
  misc_feature (468)..(468): n is a, c, g, or t
acagagcataccctgctgcacttctttctttaacgctgtcttctgctgaatgattgaaacagtcgctatctggttttctgctcctgccttgtagaagccactcagcagacagaggcctcctggtaggactctctaatggcttcccttcttactctgaataaaagctaaaggcttaaaagggagccaggaggccttccgtggcctgcctttcccaaccagtctacatcatattctacttcttcaactctggccaccctatctctgtgccactcctcaagcctgctgtgcatgctcctgccatgggacattttcacacactgttcttcctgcctagaaagcctttccctcagatgtgtgtggctatgactccacctatacccatctatagcatcgtcttgctcttccacctcttccagatttatactcaaatttcactttgccatgaagcctcttttgaccactctcttntaaattgcagaccaaaccattccacacccccttttcttaggggtatggctctgatcgggtacc

SEQ ID NO: 590795 - DNA, 865 bp, Homo sapiens
gccatctcacttctaaggaatactgagtatatcgctcacacctcatatccttcctactatgcctagaaggaataatactatcggctgttcattatagctactctcataaccctcaacaccgcactccctcttagccaatatgtgcctatgccatactagtctttgccgcctgcagaaggcaggcggggggctagccctactatgtctcgaagtctccaacacgatatggggcctagactacgtacataagcctaagacctactccgaatgctaagaaccgtaaatcgtcgccaacgaattatattactaccaactgacatgactttccaagaaagacacataattggaatcaacacaaccacccacagcctaattattagcgatcatccctctactgatttttgtaaggcaaatcaacaagcaacctatttatgctgttcgcccaaccttttccgtccgaccccgctaaggaagccccctctcctaattactaactacctgactcctacccctcacagatcatggcacagccaaccgccacttatcgcagtgaaccactatcactgaaaaaaactcctacctctctataactagtctccgctagcaaactctccttaggttataacattcacacgccacagaagctaagtcatattccatatcttcttcgaaaccacaacttatacccacctggaatatcatcacccgagaggcaacagccagaacgcctgaacgcagggacatacttctatccgtcaacctcgagagcattcacggctttcctcgccataattgaaaaccgggggccgtagaacctaccattcgggcaccatacaggccagcatatgaaagggcacaatagaga

SEQ ID NO: 590796 - DNA, 86 bp, Homo sapiens
aaaagggccggattccaaaatttaaaagaatttttttttcccttttaaaaaaatttttttttgttttttactcccgggcgtggcca

SEQ ID NO: 590797 - DNA, 644 bp, Homo sapiens
agcaacatggttgtttatttcacctgggtgcaggtgggctgagtccgaaaagagagtcagcgaagggagataggggtggggccgttttataggatttgggaaggtaatggaaaattacagtcaaagggggttgttctctggtgggcaggggcgggggtcacaaggtgctcagtgggggagcttctgagccaggagaaggaaattcccagggttaatcactcagttaagttggggcaggaacaaatcacaatggtggaatgtcgtcagttaaggcggggcagggccttttcacttcttttgtgattcttcagttacttcaggccatctgggcgtataggtgcaaatcacaggggatgcgatggcttggcttgggctcagaggcctgacattcctgccttcttcggatttgagattggtgagatgtttcttgggctgatcagtctgaggacctgaggtcgtaggtggatctttctcatggagcaaagagcaggaggacggaggattgatctcccaagggaggtcccccgatccgagtcacggcaccaaatttcatgtgcgtccgtgtgaagagaccaccaaacagggctttgtgtgagcaacatggttgtttatttcacctgggtgcaagtgggctcgtgccgaat

SEQ ID NO: 590798 - DNA, 687 bp, Homo sapiens
  misc_feature (1)..(1): n is a, c, g, or t
  misc_feature (595)..(595): n is a, c, g, or t
  misc_feature (597)..(597): n is a, c, g, or t
  misc_feature (621)..(621): n is a, c, g, or t
  misc_feature (623)..(623): n is a, c, g, or t
  misc_feature (626)..(626): n is a, c, g, or t
  misc_feature (635)..(635): n is a, c, g, or t
  misc_feature (642)..(642): n is a, c, g, or t
  misc_feature (653)..(653): n is a, c, g, or t
nattcatccccaacactaccacattgggaatcatatttcaacaggagtttcacaggaaaaaaccatatccaaactggtagcacacaaatttcagggattaggatgtggacatcttcgggggccattatgctacctaccacagtggtatgtgaaagtttggcaggagaagagattaatatttataaatttagaatttttagagcctaatggtttttcttaattattggaaaatatttattatattaataggtcaaaaaaattcacatgattatcttaatagacgccaaaaatttatttgagaccatatttgataatatcgatttttaaaaagtattcagttgtagtaaaacaaatcacaacataaaattgaccacttaaccatttctaagggtacagtttagcactgttaagtatattcacattgttttgcaacttaatattcatttttatactttttatacactagaaatcaagtattaatatattttcttgacataatagtatttatctgaaaccaacatttgcaatattaatgtaagttaatgttactcattagtgaaatactagagatgtcccactaaaggaaggaaagacntntcattttggaattctcaacatggntnagnaaataaatntaatacngaaagcacacnttttgtaactatagtatcaaatccaggatgctga

SEQ ID NO: 590799 - DNA, 901 bp, Homo sapiens
  misc_feature (179)..(179): n is a, c, g, or t
  misc_feature (181)..(181): n is a, c, g, or t
  misc_feature (222)..(222): n is a, c, g, or t
  misc_feature (241)..(241): n is a, c, g, or t
  misc_feature (245)..(245): n is a, c, g, or t
  misc_feature (252)..(252): n is a, c, g, or t
  misc_feature (254)..(254): n is a, c, g, or t
  misc_feature (308)..(308): n is a, c, g, or t
gactaggtcgcggcgacatggccaaacgtaccaagcaaagtctgggactcgtcgcgtaagatagcggagaaccctgcctagtgtggcgcactccgcgtccgtgagaaactgcgtgaacgaaagacttgaaagtcatgcacacgcatcgcgcacagatacgacgttgtcgtcgttgtcgnangtgtgcagaatagcctagagtagtgaccgcaggaacgaagncgtgatgtggcgtagtctngagncacctgngntgcgtatcgcctgtcactgtaacgcaacaggtgtgcgtgagcgaggtggcctgnggaacgttacaaggtgaggtctaggttcccttggtgggtaattttggcaaagttggtggtttgggacccaacattaaggggcccaaaatttccaagggtttggcttggcttgggaattggtggctaaggttttaaacaacttttctcaaggaactgagaagaataatggatgccttggtattttcaggattcttccggggggggttaattttcagtctattggaaggagtaacacgcaaaactaccaaaatagaagtcggaaactctaattcacagactactttagaattgtgatggtcacgtggggcacatggttgtgaacattgtcatgatactgtgcaggtccattagtggggctgaatctactgaacgttgatttgcactgcaagtttgataaagaataggtgaaggggtcagttagttcaaaactgtatttggaacttgaggccatcagtgaccaccacagtttcgtctttctgaacagtattagacttgctgcaggtttcgtgaatctgcaactcagtatcacctggactagggcgatactacaaaacactatacgtacaaacgtagcatctagacctgtgttggca

SEQ ID NO: 590800 - DNA, 544 bp, Homo sapiens
atggagagcagagtttcaacatataaatttgaagggggaggacacaaacattaagaagtctatagcaactagtgtccagctttgtttatttttaatacctcacaccagcatattgtgagttctctataaataattggtgctgattaacaatatgtatgaatgtggcctttgccctgaagctattatatatgtaaccagaccccgctatggtcagagaatatccacaaagataatagtatcttgcatctgaataatgttttatacttttactttgctttttctttatgtaaaaaaaaaaaaagtacttttaatgacatagacaaatgcttgtgcaatattgccaaatgaaaattccggacacttgccttttaaagctgaatatttctacattgtaaaacccagtaattcaactcctagatatatgccctagagaaactcttacacatatgcaccaggagttataagtaagaatcttcatagcagcacagttcatattagcaaaaaacttgaaacaagccaaatatctgttaaccaaaaaaaaaaa

SEQ ID NO: 590801 - DNA, 170 bp, Homo sapiens
cttgggattaagggggtgggcccccaacccttttccccctggggttattgccgggatttatcattactgcaaaaacctgttttgttgtggtggggggcaggccctgtgggtgttggttgagggttttgttgtcctggggccccccattaaagggcagttccccccgggca

SEQ ID NO: 590802 - DNA, 174 bp, Homo sapiens
  misc_feature (161)..(161): n is a, c, g, or t
  misc_feature (174)..(174): n is a, c, g, or t
ttatcatgcacagggtatattccaaacatgacaggagctagagttattacattagaaattcatggggtttatggcctcatcctgatagtcactagagtttcaatgataatacttgacttttctaagtggttttcttcaccactacaggaatttacaggggnggggtgagggttn

SEQ ID NO: 590803 - DNA, 921 bp, Homo sapiens
ctggaacctttttccgtccaccaaactcgtatgggtcgagaaccccctctaaagtctaacgggaaaccttttgttaaagctttctgtcccactcttaagggactccctctttgccccaaagaccgaatattttccaacgatcatcaaagagctctatatgccccccgtgagacccaaccttgtcctccccgattttcggcacatacgcgtctgttaagaaacttctttccaacaaccccgcctgatcaatacactttgacagaacactgtcccccccaaatagtcccaaaaattacacgcctctgttttcgtacaccccactcccggatgtgggttaaccacacagaccccgcactaaggttaaacctttaaagttaataagaccacccccccttaacccagcggcataccctcaacgactctttaccagccattctcttgtatactaccgccaagaagaaaatttttcccaggtagtagacaacctgaatagcaagaaaattttaacaatagccctacttgttcataagcatcaagtaacttagcttatgtcccccctccccccaccaacggcaagatagaactccacgatttaaaaatcatgtggtagttacttattctttttttgcctcacaacaaatttattaaccactcctagtactgcaacaaattaaccccataaaacgggcggctttgtgtcaatcgggcctatccgaaccccacgcctgcttttggccccacaccccacaatgaacccccgaccttccttggaatagaaatacaattcaccaatgaatgtttatacccaccatcatcacaaattttctttttatcaataactggagatatgttcgccattgccctctggggtaaaccgggaaaacgtttcggctattcaaaaaagtgcccccacccaaaaca

SEQ ID NO: 590804 - DNA, 199 bp, Homo sapiens
atgtgtgcatgtctaggcatccttgactacttaggaggctgaggaggagaatcgcttgaaccaggggacggtgaacggttgcagtgagccaagactcatgccattgccctccacgcctgggccacaatgagttacaattccatttcaaaaaaacaagacaaagaaaagaaaagaaaaacacggctgggcatggtggctc

SEQ ID NO: 590805 - DNA, 725 bp, Homo sapiens
ggaagacgcggcggcgcgggatgggggcggcgcagtgcctcccggtgccacaggtctgccatcatggattgttctcgcagaagcaaatggcacctttgccttaaaccttgtgaaaacactgggtaaatgacaactcgaagaatgtgtgcttctcaccacatgagcatgtcctgtgccctggccatgtgtctacatgggggcaaagggaaacacctgctgcacagatggcccagattctttctttcaattaaaagtggcggtggctggagactagtccacgcagggcattccacgttctctttctcacgcgaagtgaacaagtactggcacgcagtacttgcttaggatggccaacaggctcttggggcgcatagaagtcttgtgatttcctctcgatcttttagagcattcctgccaaatattctaccaagcagagatggtggagcttgacgttatcgagcgccgtagagaagtccagaaaacacataaatcacctggtgtagctgacaagaccgaaggtataattgcggagttgctctctccgggctcaggtggatccagttgacaaggctggttctggtgaatgctggtctatttcactaggaaactgggactgaacagtttgaccaaggagaatcaccgatggagagactgtccaaagtcagccagaatgaggagaaacctgtgcacatgatgtcaacgctggtctacttgtaacgaagacc

SEQ ID NO: 590806 - DNA, 352 bp, Homo sapiens
acagggtccggccggccacttggttttctggacatgctttggactgtgagccgagcctctatgaatcatcacttcagcctctgattggtcctgggccaaactttcacttcagcccctgattggtcttgggccaaaatttcacttcagcctctgattggtcccaggctaaggtcccgggccaagcgaagtcgtgctatctccaagacagctcacagaccagtgagcacattcttcctcttcccagttcacaaaacccccagattcagcctcctagttggcaaccctctttcgggtcccctctctgctggggagagctttcttcttttgcttattaaacttctgttccaaactc

SEQ ID NO: 590807 - DNA, 153 bp, Homo sapiens
cgggtgatgatgtgctgactgtaacataggtaactgcgtcagagggttggtgtacagattattcatcacccaggtattaggcccattaactattagttatttttcctgatcctctccttcctcctaccccctccaaccttttcaacaggaccc

SEQ ID NO: 590808 - DNA, 90 bp, Homo sapiens
aagacagcagcatatatctctgcagcgttgaaggactgacagggatcaccggggagctgttttttggagaaggctctaggctgaccgtac

SEQ ID NO: 590809 - DNA, 181 bp, Homo sapiens
gctaagtacttgaggatcttacgctgccggtgccagcggttatcgatcaagactgcagccgccgtgtccaactgcgccagacgccggtcaaaggggcactgctggaaacacccaggtagctacgagtgtctgtgcaagcccgagttcacaggtctcacctgtatcaagcaagcgcgcgttg

SEQ ID NO: 590810 - DNA, 1084 bp, Homo sapiens
agcggagggcggtgagttcgccagccgggaggaggggccggggacggtggcgtgctgatggccggtactgaacccgcgcggtattaatcgatgtggagggcggcagcggggcgctactcgcaggtccccgcaggtctgtttgtgtgctccgcgcatcgtgctgctaggggtggtagcgcgtggtggttcctgtgtgccatctagtgtgcgtatgcctgtctagaaaggcggccggggcgcgtgctggcgggggcggtagctcgccgtcgggcccctcatgctgtgatcacccccttctgacaggcacagcgcgcttgctccgttactccttcgaggctatactcagtcggacagcgctcgtcatcggagaatctctacactgaaacgaacagggcacggaggaattttgagcaagtcaaagtcgagagataggggagctggtccgaaagttttcgtgcacgatcgtcaaactcgttgtcaagagctcgggggaagatagctcacctcgatttacatttcatcctagttaatttgaccaacccaaaggatgggaatcggctatattggatcaaccaagaattacatgagcattgggaaaaacacaacctcgagggtttgtaatctttgccagcagccctttttggccccgtgcggggttggactgatttgaatactgcgggatagcatggttaaacgcgagactacacggcgcagccttaccaaccggactcattggaagagttgggaacgctttgagagcagaccttacacccatagaaaacgtttcagcggaggtaaagtgcctcggtgagctttagaatattttgtccccagcctctatttaggttcactcccgagagtactttaacgagatttgacattgaacagccagaagtgacatattcgcagaaaagggttctcttttcgaaggagagaactcgagatcccagaggccagaaccggaggacgcaatttttgcccagttcaacaacggttttgagaccacccagggggaacccccagtgagaatccagaatgttctccccttggcacaacgtaggggtgaagacggggcccagggaac

SEQ ID NO: 590811 - DNA, 366 bp, Homo sapiens
gaacaagcgcgctgggtatattagccatgctgcagctgtactaaggtgatccagacacactacggctgagctttctaaggagtagggattacagctgctaaccgcagctgccggccttatggtggcccacctaaccctgaatgttactgaggcccccaggatgtacacagagtactgtcctgtcatgatcatcacgtatcatgctactgagcacatggtataccgcacttaacgcgcacaacagagcctgctgtaagtgtataatacattcttatccttactagccgatgggggactaccacccgcgtatatgttctggcctgtgctgtgactggactgctggacgagcactttctgcttatgggc

SEQ ID NO: 590812 - DNA, 173 bp, Homo sapiens
tgatgatcccggtcggcactgaagcgtggtcaggcgggagttgtagggctcaccacggctgtgagactggggggctgggtaaatggcaaactctagcttggacttcttggcggtaatccacgtgagagcctgtccatgagcagagatgcgaacccgggcttcagtgcctaacc

SEQ ID NO: 590813 - DNA, 200 bp, Homo sapiens
gatttgttgctgatcccgacaccctttcatactcacgctgaacgtgactgactgaaaacaaactttctttggtacccgagatgtgtgcacagaacttactccctctaataaaaccccaagggagagctggtatagggtggtatagggcggtatagagctggtatagccgtgctatacgctgataccaccgatcagcagaa

SEQ ID NO: 590814 - DNA, 128 bp, Homo sapiens
cacgagggccttcgtaaaggttgcatctccgtcccttcgctcccggggaaccgcgggaaaaaaaaaaatccaacacccaagccccgcgggtaaccccttcccaaaaggtctccccgcccgaatttggc

SEQ ID NO: 590815 - DNA, 326 bp, Homo sapiens
aggactgcagaacgcgctaagagaactactgccattaacatgggtacaggagtggagatctcctggataggagtaggattacgacagaagatggctggaagaattgtgaatcttgtagtacagaaacttgaaagagagactacccattgtaacatcagtcacagcattatcttaaatagcgaagatagagaaatactccactaatgaagagcatgaatatagcatccaaaacacgaacaacaggaacattttagaaatgacacacatactcaaagcaaaaaactaccatgaaacatggatctatgtccatcaagaaagcacaaaag

SEQ ID NO: 590816 - DNA, 647 bp, Homo sapiens
atcacttgaggccaggagtttgagacaggcctgggcaacatagcaagacccttggctctattaaaagtataaaaaatacgccagacgtggtggctcatgcctgtaatcccagcactttggaaggctgaagcaggtggattgcttgagaccaggagtttgagaccagcctggccaacacagagaaaccccatttatgctaaaaatacaaaaatcagcctggtgcggtggcacacccattagtcctagctactcaagaggctgaagcataagaattgtgtgaacccaggaggcggaggttgcagtgagccaagattgggcccctccattccagcctgagagacacagcaacactcttgtcttgataaataaataaataaataaataaataaaaaaaaaaaaaaaaaaaaaaaaaaaaaaaaaaaaaaaaaaaaaaaaaaaaaaaaaaaaaaaaaaaaaaatgcgcccgaatttggggctaattggccaaattggccttatgggagggcggattacaatttcatgtgcccgggggttaacaacgttggggctgtggaaaaccttggggtaacccaacttaaatgcctttggaacaaaatccccttttggcaagttggcggatcgaggccccaacgggggcttttcccacg

SEQ ID NO: 590817 - DNA, 411 bp, Homo sapiens
gcaattacgaggacaggtcaatcacttatgccaacgggaacgttgtcccgtagtaacctagcacatctccatacacatgtgtctggatccctgcttcggggtcccgcttccatcggaaagtaatgacctggtgaagtgcatccccttaatgaaaacagcgaggcccttgaatgccgcaggctcagctccttcatggtgaaggagaatgaacagcagccagaccacaccagccggggtaccacagaggccttgcagactcagccaagatatcttgatctccaaagacacagagccagtagaattaaactgtaatttttcttgtcaaggaaaagaaaaagtgagctgtaccatctgtggtcataaattccctcgaaagagccaatggatggaagcgtcgcgcatgggtaccga

SEQ ID NO: 590818 - DNA, 150 bp, Homo sapiens
tatgtgatttccatataatttcctattatactattattgtacgtcatcagatcccgaacctctataagttagctgccctctgagatgtgagacgtgttcctaatatacaattgcctacttaaaatattttctatgtccatggtagttcgt

SEQ ID NO: 590819 - DNA, 592 bp, Homo sapiens
ggtgcgcggggctgtcgtgttccagtccgtgttccccgtcgctggagtgcagcttaagtgcgaatcatttcttggtctccatgcggtccacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacagctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcatataaa

SEQ ID NO: 590820 - DNA, 168 bp, Homo sapiens
accgcgggggccccctttttgcaagcctccccggtccccaaaatgaatttcatttggggggtttgggttttttattttttgaaagggtcatttgtataattttaaaggcccatgatagtagtttcaaattggaaaaagggaaataaaataattcagtttgcggcccca

SEQ ID NO: 590821 - DNA, 865 bp, Homo sapiens
  misc_feature (201)..(201): n is a, c, g, or t
tggaggggccccaggggtttaaaggggcccccctttttccacccaacctcccaccttggggttcgagggggctgggttacaaaccccctgtttttttaggagaccgaaaacccccccccggttcctgtaaaaattaagtcccaggtccacaggtaaaggcttgatttggggcccaccccaagggagtgtggcctggaggcnagagcgagcctaaaccctgtaggagcagcgccacggttgccaggatccacttcgctgccttctctttggtcttcaagttaaaggtccagacataggtggggccgcggatgcgtgttttgtacacgggacactcatagatgttcttggtctccatgcggtccacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacagctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcatataaa

SEQ ID NO: 590822 - DNA, 898 bp, Homo sapiens
gctctgtacataacaatgatgacagcagtactttaataggtgtatttccgacgtgaacttatatacatcgagagaggctgcattagggaaactgatgtataggaagacccattagttccctagctctctccctgcagggaagatgctatcgtcattgtatgcctcttaacagcagcactggccattcatagttgataaatcagtgtggtactacctttgggactgcccagaaacacttatatgatctggtgtttcgcattacctaggaagggcgcaaaagattcagcgtggtcatccaaaatctgtatgtaagactgatcttcatttcttcctcccacaccttctcctctctgggaaatacataatgctatcttccatctgacttacaaggcgcgagaggataccgctagacttgattgggactgagggatcttagggtggctaggagggccagacccttgtgctaaagatctcaagacatcgtatgcgtcgagttcctagcctatgtggtggcactccagaaactggtgcgtgccccggcataggctcatcatttctcgacgggtctcccatctctgaccaacttgcagcgttcagctacatacataccttgcagcatatgaactgactagtgtggtcactccagaagcccttatatatcccccaggttctgaaccattggtagcaatgctaacctgcaattaccattgaaacttctctggacacctgttggacatcctcacagttcactttacgcttctcttttccgaccatagaagtactccgcctcaaagaagcgtgtcccaaggtcaggcctgggccctaccccgctaataaccggctcccagaccacttagcggaaacgcggtcagatacacatagtactaaggacgccata

SEQ ID NO: 590823 - DNA, 704 bp, Homo sapiens
tgtgctgtggctcaggcctgtaattccagcactttgggaggccgaggtgggtggatcaggagttcgagaccagcctggccaacatgggaaaccccgtctctactaaaaatacattagttgtcggtgctgacgagcacctgcaatcacagctattcgtaaggccgcgccacgggaaccactagaccccagcattaggccttcgcacccgtccgagcttacgctatcgcactctagtgtgccatatcacgcgagtccctctctcagtcacttcgaccgtcctaccgaccccactttgctaatccatgctaagcgtgtacaccgccatcccagcatctagatcgatagcgacctacctcgctcagccgcttagcgatccctacgatcctgtacgtccacggcctcgctctgcctctaccttcccaccgcccctctactcacgcactcttccgatgcgtcaccttctcgcctcccccctctacctcttgtcccactatctcatcctcctctcctagcatctgacggtcacttctcgtctctctacccctacttcggctacttccgcctctactgcatgccctcgttctttcctcttccttctctgcctagccttttcctcctctccatctctcccctccctgctccgtccctccttttcccctcgccctcctcctctccccctcctcccctcccttctctctccttcg

SEQ ID NO: 590824 - DNA, 695 bp, Homo sapiens
  misc_feature (609)..(609): n is a, c, g, or t
ggtgcgcggggctgtcgtgttccagtccgtgttccccgtcgctggagtgcagcttaagtgcgaatcatttcttggtctccatgcggtccacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacagctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcatataaatattgcctttaaccagnctgctattatttctactcgccctatttaatggtgtttttatttcctgtctgaaatctcaaaataaacaaacatggagagcttaaaa

SEQ ID NO: 590825 - DNA, 1146 bp, Homo sapiens
  misc_feature (1146)..(1146): n is a, c, g, or t
ggtgcgcggggctgtcgtgttccagtccgtgttccccgtcgctggagtgcagcttaagtgcgaatcatttcttggtctccatgcggtccacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacagctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcatataaaaaaaaaaaaaaaaaaaaaaaaaaaaaaagggggggcgcggcccaaaaattctcccccgggggggcccaagtttccgccggataccccgagcttcctctggttcccaaaggggcccccatatgaggaggagccgaaattaaataagccaaggacagcgggccgcgcaagcgatactaacaagcgcccgcgaacgtgggcaaaacgcggccgacagcccgggggaaccccggggaaaaggaaccactatactgtcgtggggggggtgggccaccacatatgtgggggacacaaaagttacccccttcaacagaagaatttttaaaagagcgtccctaaggggggcacactttatatacaaacacttttctcacagcggtgtgtatctatccgcggtgttgaaaacaccttcagcccgtggcatatatgtgcccgtaggccagcggccttgagaaagaaagattcgtgagcgcctaccccgggcgttgagtgaactctcctgctgaaaccactcttttcattcacccccgggaagccctcgcgtggaacaacccggn

SEQ ID NO: 590826 - DNA, 276 bp, Homo sapiens
  misc_feature (46)..(46): n is a, c, g, or t
  misc_feature (76)..(76): n is a, c, g, or t
accctgcctcgatgtcctgccgcgcgttgtcatcagcggcgggatngggagactgtgagccaatgatattaagtangggttaacctcgcgctgaccgaaagttaacgatttcgttaacttccactctttcgcaatgatgaattcagagcttccaatccaatgcaaggctgatggagcgcgggtctccccaatacacgccgttataaaagccgacacgatcgtaatattttttatcaaataggttgttgatattaattgatgctggcaagtggtcat

SEQ ID NO: 590827 - DNA, 137 bp, Homo sapiens
actccgctgtgatgagcattttgaaaaggtgcccgacatcattggtcattagggaaatacaaatcaaaaccacagatgagagccaggtcgtggtggctcatgcctgttactctcggtactttgggaggtcgaggccg

SEQ ID NO: 590828 - DNA, 307 bp, Homo sapiens
gatcgaatgctgtcctgctaggctatcgtgatgaaccaatccatcacaccacctacaccccgccaatgtcccaacgcttccgcggctatctgcctgtagtggtcgacgttgaaacgggaggctttaactggaaccaccacgccctgctagagatcgcctgtatcccaattgaaatggacgacactggaaggctctaccccggagaagtcaccagcacccatgtcattccagcacctggttaccgatatcgacccaaatcactggaagtcactgggatcatactcgaccatccgtttcgcttcgccaa

SEQ ID NO: 590829 - DNA, 199 bp, Homo sapiens
ggccaatatggacacagccatgaacccgtcccttgtgaaactcagctcagaaggggacagaactgacttctgttcctgtctctgctccagtgacccttttcctgcaaaggggcctgaggaacttagtggcttttctttcatgttgacctgggcctcttgcctgtagatagatttgtgttcctggacaaagaggaacttg

SEQ ID NO: 590830 - DNA, 317 bp, Homo sapiens
ggaatcctggttttgcctttatgttgcccgctgcagcgatgcattgggagttgggagaccctcactctagtatactctctgtggcccgtttcacccggcttaatcttggaccagtggctgaactctccgacctcagcttcctgcctgtaacatgagaaggctccctacatgctctctagaccttttcaataacagcggaatacgattggaggctctccagttcccccccggggacaggttaatcttcagccacgtctagccaacgtgaggcagcagcccgcccgctcagcaggcacacactgagggcggcggcgcca

SEQ ID NO: 590831 - DNA, 250 bp, Homo sapiens
  misc_feature (80)..(80): n is a, c, g, or t
gatccccaagcagttcccatgactcatcaagccacatgacttctccacaatgcacgttcttaccttagccacgatagtcncagccacacgttactaaagggttgactcaaaggatattgtacgggaataaaccaattaccagggggaccggttacttccaatccagggccaaattcagcaacaggtcctccaacccagtgctgttatcagatcacaggctcagggccaattcctttcccgagggctaatc

SEQ ID NO: 590832 - DNA, 356 bp, Homo sapiens
gcccaaacccactccaccttaccaccagacaaccttagccaaaccatttacccaaataaaggataggcgataggaattgaaaccttgcgaaatagatataggtccccaaggggaagagtgagaaaattataaaccaggaatatatatgcgcaggcgtataccccatatcctactattgcatatgggagtatatttcgagaaattactattcgcaggagagacccactacggctagagactctcactacaccagcagatggctactcatgatggactacagcataactagaggcaacacccagtttactctgctagacacagctacgatagcagaaggactatgctgcgatgagcag

SEQ ID NO: 590833 - DNA, 186 bp, Homo sapiens
  misc_feature (68)..(68): n is a, c, g, or t
cacccctaccgagcaatatgaatggctaactcttccgcatacaagaagagacgtacagataactaccnccaacttcaaatggtgcgacttcagggaaagatcaccttcttcccccaccatccccttcctattccccattccactgagagccacatccattgcccaataaaatcctccacatatacc

SEQ ID NO: 590834 - DNA, 158 bp, Homo sapiens
cgtgctcactggtgtcactgagctgccccaagatcatcttgttgcaattggataggaccccctggaggacccggggggccgggccgccctctggggccgggaggacccctcggaccttgcaatcccatgtcccaccactgccttcgtgcgggggatct

SEQ ID NO: 590835 - DNA, 116 bp, Homo sapiens
caacgatcggggagtggctttgggtgcgtgtccgggtcgtgtgatgatggaacacggtgtatgctgtgagtcatggctgaaggcataacgctgacctgggattgcgactgcagtgc

SEQ ID NO: 590836 - DNA, 681 bp, Homo sapiens
ggccgcgatgacgtcactgcaaggcgccggggaacccgtggctgcgttcggcgggcttcccgggtaccaaaaatggctgtggtagcgatttctacctgcgctactttcgtagggcacaagggcacgttgggcacgagtttctggagtcgaatttcggccggacggaaagcttagatatgccaaacaacagcaattacaaacatgatgtgatgatcagaacacagaggcttatgtgcacaagagtgtattggacgactgacagcagacttatggattgacggtgacattaccaaacagaagatgatgcttgtggggcctcccccctgatagtggtttggccgacagggaggcttgacaagtggtaattgtggggatgagcacttatatctttttacccacattcaaaaataggtcctcttatttgatgtaaatcaggtcaaaaggatcttgaagggccttcgagtatttacatatttggtacacagagttgaacatgttaagttgcagtcttaatgtggattacacttcaagattaacccaatttaaatggtatgttcaggctgtggtataatacataagggatggaagggggtatcggcaattaccggatggggtctcatgcaatggtgacgcaacaaaaaatttgatgtaactggaacagacaacacagcaaacaccaca

SEQ ID NO: 590837 - DNA, 362 bp, Homo sapiens
tctgacggatgttcaggcgagtcggacgtcgtacagagcactcgtccatgtcacgcattccagcaggtatcccgtctgtagtagaagccctgcttgcagtagcactacgtagccaggctgcgtgtcacgcacttgcactccttgcaaatctccgacccgaacaacatgcactcgtacgatgtctagcggggtgacacaacacactggtgggtatgggatgcctgtcagttgacgatgttgtaagtccttgggtgtagcccatttccgtctgggcagaaggcttgtggaactctggtcagcaggtgggaactctggtcaagaggtgggaactctggtcagagattgggacctctggtcagagg

SEQ ID NO: 590838 - DNA, 1219 bp, Homo sapiens
  misc_feature (779)..(779): n is a, c, g, or t
cggcagcatctggttggtgtgggggcggtgatctccggctcggcgtgtgggtatggcggggcgttgtggggctcagtgagatgcgttgtggcgcgagtcgcggggtggtctcccgctgatgtgcggggtattgttgcacgcacgccgccgtccccgaggtgtgtgtcggcgcggtcgggccccgggcgtcgaggttcgctcctgttgtggtttgtctcgctggttacagacgagtggtcggttgccggggccctggtggccgcgtggcccattggcgcgcgtcgcggtggggggcgcgtgtgatggagtgctcgcggggctgtttcgtccatataccttttgagatgtgcccccgtgtgtcacagtggggtcccagggggtgtgctccaggcgaccccttgtgagcagtcgggccggttcggtgctcagcagtgccataaactttggccccccgtgtggcggagtcagtagtgcgccgcagtgcgtgtgcccctcgccttaatcgtaacctttgttccgcgagtgttggcgaatcgtgtagccctctataccaggcacgttgaggttggattttaacccgaaccccagctacgccaaatctttagccatacctccctctcagttaccccacactagggagaaataatagccggttttaccggtacaaccctgtacattgcccgttgtgttaaatgttaacgtaaggtagatagttatgtctccatacgtacttaccgccattctctatctacgtccacgttaaactcccagccaccccngacccttactacttattctccgccacctgagaaccagcttaaccatgactacaccacccttgaattcccatcccccctccttctcccttaggaggcctgccccccgcctataccgcgctttttggccccaaatgggccacattatcgcaagaaattccccacaaaacccatatgccgtcagtcatctcccacccactcattaggccacccactcaccccctcctgtaacccttctaactttctaacctaacgcgctacatgttactgccaccgctcacattcaccacctacttccgccactattctaacacacgtgaaaaataaaatgaccacgtgttgaaacatacccaaacccacccccacttcctgccccaccaccttcatcgcccttaccacgctactcctacctatttccccttttactcactaataattttata

SEQ ID NO: 590839 - DNA, 358 bp, Homo sapiens
atgtgggtctgtttctccgcggattgtagccagctaatcccttcctaccagccaacagtgagtgggtcgagtagtgagcaccctggggctgggtggtgaggactgcgtactgtggggcggcccttcccaactcttggctgtgcccagcagcacctctggggcacaagggcaggccctctttagagagaaccagggaatccaaacctgagatgtcggggcttctttgtcacggttagacagaatatttgagacctaagatcgtgcataacaggaacatgacagcatcgattctctagccgagcaaaagcgtaaaaaaggaccctacagcaagtaccttatctaactcatccttatgtaa

SEQ ID NO: 590840 - DNA, 760 bp, Homo sapiens
agatcacgaggtcaggagttcgagaccatcctggccaacatggtgaaaccccgtctctactaaaaatataaaaattagctgggtgtggtggcaggagcctgtaatcccagctacacaggaggctgaggcacgagaatcactgtgaactcaggagatggaggtttcagtgagccaagatcacacacatgcactccagcctgcaacagagcgagactccatctcaaaaaaaaaaaaaaggtaggaaagaaagggattcctttaaatggggaaagaaaattcttaaaatttggggtggaggccggtttatagaattaaggcggttctcgaaagggtcctatggtaggcgggaataaaggtctaaatcctctcccttaagggggagaacacaagggtcccatttggagcgggatctaaatgggctgggttctggtcagtagaattacccattggtggttacccaattttgtggtgaagaatggcccatggctatcatattctaattataactccccattaggttttgagagggtacttgaagtggcattatggtgaaattacggatattggtattgtgaaccaattactttgagggaactttacaggtttcttttaaacgttctatggtgcgcgtgcaattacttttataaccgtgctggtgtggagagaaggtatggtgcagaaaaatttatgggtgcggacaatcggagggggagggggttattaggggccgtggtacctggaggaaggaccagaatgagcg

SEQ ID NO: 590841 - DNA, 863 bp, Homo sapiens
attctagaggccgaggcgggtggattgcttgagaccaggcgttcaagaccagcctggccaacatggtgaaaccccgtctctactaaaaatacaaaggttagctgggcgtggtgacgcgtgcctgtgatcccagctactcagaaggctgagacagcagaatcgcttgaacccaggaggtggaggttgcagtgagccgagatggcaccactgtactccagcctaaggctacatagtgagactctgtctcacaaaaaaaaaaaaaaaaaaaaggcaggtacttctgggcaactaaatttgtttttgggcccaaagagggggctagccaagggggtcggggttaatccatttcagtaattaataatccccagggtgggggcttcctaacataagggggttcctcccagggtgttgcacaggggcctaagcctttctaatggggtgtcccacccaacattttcggtgcgatcacatggtttccttctgggccttaaaaatccggcatcagaaacaccaaggtcgactacaatagcgcgtactaataaagaaaaaagttccggtaatagaagcttcttgccttgagaaataaaggtaacagggaggccctacgggggtcggaacccgcgggcaccggatatacgggatactaaccagtgttgaacgtggggccctgagaaaagtgtaaacccccctacggggggtatttgtccttcccttacctgcaaggaaggcgtggttcaattttccagccagtgttacgttgaatgggtgggttaacactcttccggtaaaacgggggcgccgtacccacaggggaatgtccgggaacgttgaatccgtccaagaccaaaaaattgcgcatatgg

SEQ ID NO: 590842 - DNA, 918 bp, Homo sapiens
ggctaatccagtcggtgccgattacccagaccgtcgccatggccgcctatgaattggtgctgatcctggcacggtggagagcgcatggaacctgggataatccgctattaacaggtgttacgacgccgaactgagtcctgcggccctcgatgaggcggaggcgcggtggtctggctgctacagtagcatgcgtggctaatgagtttgacatctgcttcactgtcagtgcgagaagagagcgatctcggacgcctctggactagtgctagaatgccagttgcatcagatgtggctgccagtggtgaggagcttgagcgcctcgaatgagcggcactatgggggtctaaggccggtctcaatataaagcagaaatctgctgcgaaggcttggtgaggcccagggtgaagattcttggacggcgcttcctattgatgttcccagcacctccgatggaggcccgaccatcctttctacagacaacatcagtaaggatcgcaggtatgcagacctcacagaacgatcagctagccctcctgtgagagtctgaaggatactagttgccagagctctgacccttctggaatgaagaaatagttccccagatcaaggagggtgaaacgtgtactgattgcagccatggcaacagcctccggggcattgtcaagcatctggagggtctctctgaagaggctatcatggagctgaacctgtcgaagtggtattcgcatagtctatgaattggactagaactttgaaggctattaaggccattgcgattctgggggactgaagagaacggtgcgcaaggcattggaagctgtgggtgcccagggcatgggcaccgaagtgtaaggccgggggaagataattgtcccccggagaaccctctccggccgacttgtcctctttgccctacag

SEQ ID NO: 590843 - DNA, 487 bp, Homo sapiens
gcaaggggtatctccttctctgtctttggggtgagtctgcctcacagggataagatgctccgtgcactcatagtggccagtcctcaccgccacatgcagcgcgggctggagcaacttatctcgggcgctaatttttgctcctttattcagcaacaattttaaaacatccaggtttcctccacggcttgcccagtgaatggctgtggattcaagcatatcacggaattcgatctgggctccagcttccattaacttctccacaattgccaaatgtccttccaagcatgctctatgaagagctgtccgtttatactcatcacaaacatctggattgttcttgtctgacaagaatttttctactactggcagtttattctccagagcagccttcagaaacgtaggcacatccacaggttccgtaatgatttcagggtctgggttcctttacaactggaactttagttttcctgtatttttcccttttctt

SEQ ID NO: 590844 - DNA, 255 bp, Homo sapiens
  misc_feature (33)..(33): n is a, c, g, or t
  misc_feature (37)..(37): n is a, c, g, or t
ggtcgaccagaacattcagatcaaggttcttangacncctgaagttgtcacgtgttaaccagaaaacagatctgccaggtgcggtggttcacacctgtaatcccaacacattgggaggtcgaggctggtcttgaactcctaacttcaagagatccacccacctcagcctctgaaagtgctgggattacaggcgtgaggcaatgtgcccagacttttttttttttttgacttgagggtctcactctgtcacccatt

SEQ ID NO: 590845 - DNA, 550 bp, Homo sapiens
agccatgccggttccaaggggttcccgctgcagtcgtgtgcaggtctatcggacgcaacgaagacagtgacagctgtggcgcactgctaaatcgcggcaagtggtctcatcaaggtggaacgggcgggcccgtggtagatgagtgagccgcgcagcgctacgaggtacaagcctgtctggaagccagattctgcgttcgtcggcaaggagcgatttgctaggtgtaggacaatccgtgtccggtgtaaagggtggctgggtcacgtgcgtccaggatttatgctatccgtcgagtccgatcgtccatagagccctggtggcactattacctagaaatatgtggatgaggcttccaagaaggagatcaaagacatcctcatcacagtatgaccggacccggctggtagctgaccctcgtcggctgcgagtccaatagagttgtggaggccctggtgcccgcgctcgctaaccgagaaatcctaccgatcagcccatcgtgactcaaaactcactttgtatatataaacagtttggagggacttttatctgc

SEQ ID NO: 590846 - DNA, 409 bp, Homo sapiens
atgttgagaaaacagtcaaatttaaccatttggagattattggaattcttggaatgagcaatatgcaaaaccttttcaaaaataacatattctggactactggatggatgttctgttttcagttcattattcatcaatagagatggagattattgatcttgagtatcctcgcttctatgtctgcgcatgtgaacatcggatgtatttgaatatactcaattaagatacagactgcgtgtcattctggctagattagaagctaagtcacttactgagtaacattgtgcaactttattcctgcgagtactatatcggtcaaaaaaagttttgctggtgataccattaaaactttattctgtgagagactttttactgtaaagagtctagaaactgtcattctcgtgccgga

SEQ ID NO: 590847 - DNA, 125 bp, Homo sapiens
  misc_feature (53)..(54): n is a, c, g, or t
aatgggttttaacatttcgatttaagaatagactatcttaaatatgatgctgnnacatctgagaggcaggagataggtctcaggcaccagagatccggggaaatatatatgggcattttgtggtt

SEQ ID NO: 590848 - DNA, 337 bp, Homo sapiens
  misc_feature (327)..(327): n is a, c, g, or t
acctctgcctcccaaagtgctgggattacagtcatgagccagcgcatctggccaccttattttctactactggctcaatgtaatggctccatctcaggaacagccaatgaaagagatgcacaggacaagaaacaggaccttgccctgtcactcaggatggagttcagtggtccaattatggctcattgtagcctcaaactcccaggctcaagcagtcctaccatgtcagccttcccagtagctgggattacagttgaagcacctgtcctgcgagcttaggggtgctacaagttgaccactgcactccagcctgggcgacagagcaanactcggtctc

SEQ ID NO: 590849 - DNA, 734 bp, Homo sapiens
  misc_feature (273)..(273): n is a, c, g, or t
gggagaaatgaaaatctattctgaattaattctactcagcttctgggcagcatattttaaagactggcagaagagagagcatcacttttttagtgaaaaacacgggtcactataaataatgtagtttaaaagcaataaaaattttgtttcacttattctggcatttagtaatgggtacttgagatttgccttctaacctgaacattctttagactaagaaatggccttggattatgtgcttctcgaaacatctgtgataaaggaccatttttntttccttttgaattccatcagggactgatactttggaaagtgttgaggggaggagggatcgtggcatgtgacctctaaaggaaggtgagattgtggccaataccttggaagacttggtaatctttcctttggatcccagaaccagttggcaaacaggttggcactgggcctcaagttgggcgtttgatgaaccttaagggctggattggtgtttccagattccatccagggaatacacatttcctttgaaggtggttttcttaagcccgcctttttggcccaatttggggttccaataaatcccgggccctggggaattttccttcaagtttcggggaaatgtgccatgaatgcccttaacaaatccccccctcgggggattgaccccagaccctgttttccctgagggtactggcaaacccccttggttttcagggcttcgtggttacactcccttcttt

SEQ ID NO: 590850 - DNA, 425 bp, Homo sapiens
tgtaggaagttagacacaagcggccttaagttccttgtctccagactctgttctcctgtctcacgtgttcccacctgtctggtatgcagtcagctcggactagagagcagaagagcagaatgtcccctgaggccaaattgactttcagaggttgggagggactaaagccagcagcacatggctgtcccctccctctttcagagaacagcagcatggtcctcagtaccccgaactctccctccctgcatcctgttgttgacaaaaagagtcaaaactctggctccgaatacatctcttcaaatattttacaaatgtgagtgaccatggactgtgacacagccctcagtaagtcctgagaacatgtgccatggtggtcggggtgcagctggttttatacattttagggagacatgagacttcgatca

SEQ ID NO: 590851 - DNA, 320 bp, Homo sapiens
ccaacaaactctcaagccatgcgggcccctttgccacacccatcgtggtgccaggactggatcccggtacacagaccatcttacaggagttcttggttcccaactatttgattggctgtgtgaacggtcgccagggcagcaagatcagcgagatcctgcatatatcatgggcacatatcaagatctggaaccatgctcaggtccctggtgatctggtatatcaccatcattgtctcttaggtaattatcgaccctgcctatttccctatcactagtatgattagaaacggtcaaaatttacctttgggggtacacacaat

SEQ ID NO: 590852 - DNA, 507 bp, Homo sapiens
  misc_feature (29)..(29): n is a, c, g, or t
  misc_feature (44)..(44): n is a, c, g, or t
  misc_feature (53)..(53): n is a, c, g, or t
  misc_feature (65)..(65): n is a, c, g, or t
  misc_feature (113)..(114): n is a, c, g, or t
  misc_feature (153)..(153): n is a, c, g, or t
  misc_feature (171)..(171): n is a, c, g, or t
  misc_feature (181)..(181): n is a, c, g, or t
  misc_feature (193)..(195): n is a, c, g, or t
  misc_feature (281)..(281): n is a, c, g, or t
  misc_feature (320)..(320): n is a, c, g, or t
  misc_feature (361)..(361): n is a, c, g, or t
  misc_feature (377)..(377): n is a, c, g, or t
  misc_feature (415)..(415): n is a, c, g, or t
  misc_feature (419)..(419): n is a, c, g, or t
  misc_feature (444)..(444): n is a, c, g, or t
  misc_feature (456)..(456): n is a, c, g, or t
  misc_feature (459)..(459): n is a, c, g, or t
  misc_feature (468)..(468): n is a, c, g, or t
  misc_feature (470)..(470): n is a, c, g, or t
  misc_feature (474)..(474): n is a, c, g, or t
  misc_feature (477)..(477): n is a, c, g, or t
  misc_feature (484)..(487): n is a, c, g, or t
  misc_feature (504)..(504): n is a, c, g, or t
gagaacccaccatggtgctgtctcctgcngacaagaccaacgtnaaggccgcntggggtaaggtnggggcgcacgctggcgagtatggtgcggaggccctggagaggtgaggnnccctcccctgctccgacccggggtcctcgcccgcccggncccacaggccaccctcanccgtcctggncccgggcccaannnccacccctcactctgcttctccccgcaggatgttcctgtccttccccaccaccaagacctacttcccgcacttcgaactgagccangggtctgcccaggttaagggccacgggaagaaggtgggngacgcgctgaacaaagccgtggcgcacgtggaagacatgcncaacgcgctgtgcgcnctgagggaactggaaggggagaaggttggggtggaagnggtnaagttcaagctcctaagccactgcntgctggtgaccntgnccgcccaantnctcntcnagttaannnntgcggtgaaagaataantgg

SEQ ID NO: 590853 - DNA, 330 bp, Homo sapiens
taatattttaggcaggtcatatttaacctcctcaggtgtggtgttatggagtctaaaacaagaagctgatagctgccctagcttagcgcacaaggtatgctcagaggaatcaaatgagtgtactgacttgtggatgacagcttggaaacatctggagatgctggatatgcaatcatgaaggtcttgagggattctgcttgggagatggttgtctatgtggtcttgtgtgggctatgaggataagagagctgtattattagcagtcagggaagggtttgtatccttaattcattattatccttcctcgaggaggaagtcgttgtatgtgat

SEQ ID NO: 590854 - DNA, 299 bp, Homo sapiens
  misc_feature (286)..(286): n is a, c, g, or t
taggaatcccaaaggtgggatcctccctcatggctttggcacagtgtaatccaggggtgtaaatgggggaactgtgaatacttgaactttgttccccccccctccatgctcctcacctgtttaggtttcctcagggtggggggtgacagtgccttttttattgggcccagcctagggttttgggggtcaggggggaaaagttttttattcacccaaatgcagggaggggaggcaaatggagcccataggcccccccctatcctttgagggtttggaaataaactgngcaatccccccca

SEQ ID NO: 590855 - DNA, 222 bp, Homo sapiens
tcaaaagaatttggaataaactttgaagttttggttttacttatttttttccccaaattgttgctatttttttggatttgaaacaaaatctttttaaaacattgtttttgttgtcaaagccccaaccggacattttggggtgtgaaatgtaatttcttggaatctgtaatttgtacttaattttcaggcttgtatttaatttaataaataggtgttttttta

SEQ ID NO: 590856 - DNA, 114 bp, Homo sapiens
agaaacatctcaaggcaatgatctaagcttctaccttaagataacagaaaagaatgagcaaactaaatccaaaataagcagaaagaaagaaagtaataaggagcagtaacagct

SEQ ID NO: 590857 - DNA, 318 bp, Homo sapiens
  misc_feature (230)..(230): n is a, c, g, or t
  misc_feature (301)..(301): n is a, c, g, or t
agactcctggcaggcatggaggcagaacttccagtgttttccacagtggccccactggaggggcaggggagaggataggaggttaggtgggggaagcaaggaggaggagagggaggaggccacgggaggtggtcttgggtggggcctccctttgcccgcaggtggtgatgggcagctgaccacctgcaccaagtgtcgaggtggctctagtgactatggggacgcaggcntcccgggccaccgcaatggctttctcacagttggtcctttggatccaactggatttggggtgtgaggtggntgaggagaggccccaag

SEQ ID NO: 590858 - DNA, 139 bp, Homo sapiens
atatccaatcatgtgcttctggaacttagtgactggattatatactggatatatgctgcatccataccatgtgtattcttggcaaatcaggtaactggatagttatacatctactttcatttccgatatatatagcact

SEQ ID NO: 590859 - DNA, 412 bp, Homo sapiens
tggctttcaacaacacatccattgagggttggctgtgggctatgctccacttcttcatggtgagacccacgctgtagagcacctggcctctgagacgttactgttttcatggcagaaggaaacatgagaatggtgaagccataaaatggcgcttaaagcttttcctcctaggtggcacaggtgacttgagctctcatttcattggccaaagcagataatacagctagatgtcaacagctcaagaatatatcatcctacaggcagcaacagcaaacaaaacactcagtgatgaataggttgtagcatttatcagaatgcaggtgactaccaaaaaagatgtggaaaatatttctaacccttccattttcccagacatgtgattactattaaattgtgagtaaatcttcaaaaa

SEQ ID NO: 590860 - DNA, 500 bp, Homo sapiens
cgtatctgcagtgtctacattcacggattcagtcagttgtggatcaaaaatacagtcgtctcaaggtatctgtgggagattgattccagaacccccaacggataccaaaatctgtgtatgctcaagaaccttatataaaatggtataatagttagttgtatgtaacctatgcacatcctcctgtatactttagatgatctctgggttatttataatacctaatacagtgtaaatggtttgtaagtggttatactgtatttagggaataatgacaaaaaaaactgtgtacatgttcaatacagatgcaactattcatttctttttcccagctattttcaatctgtgaatggttgaatccacagatgtagaacccactgatatgaaggactgattgtgttggaaaaacaaataacaatacaacaataaaaaatgatacaaataaaaaaccaacatagtctgtcaaggactgtactgtaaaatataattttaacatccagtgt

SEQ ID NO: 590861 - DNA, 378 bp, Homo sapiens
ttcatgtatgagatgaggacatgctgaagctaaaatattaactgggaaacgtaagctataaatgcttattcagtatgatcacttcttttcttgagacggagtctcagtatgtcacacaggcttgagtgcaatggtgcaacctcggctcactgcaacctctgcctcctgggttcaagagattctcctgcctcagcctcccaagtagcggggattacaagcgctcgccaccacgcccggctaatttttgtatttttagtagagacagggtttcaccatgttgcccaggctgttctctaactcctgggttcaagtgatctgcctgcctcggtttcccaaagtgttgggattacaggtgtgagccatcgcacctggctagac

SEQ ID NO: 590862 - DNA, 395 bp, Homo sapiens
ttttattctctcaggagataccaacatgtgatattcgtctctctagcgcctggcttatctcacataacataatgagcccccagttccatccatgtaactagcaaatgacaggggtaaaataacgtaaagggcctaatactgttacactgtgtatatataccacatttacttaatccattcatctgttgtggacacttaggttgacttccatattttggctatggctatagtgaatagtgctgagataaacatgagagtgtagatatctattcaaatatattgatttcctgtcttatagatatatatccagtactggaattgcaggatcataagaacgttctattttctatttcttaaggaacctccatactcttcttcatagtgactgtactaat

SEQ ID NO: 590863 - DNA, 1219 bp, Homo sapiens
  misc_feature (354)..(354): n is a, c, g, or t
  misc_feature (435)..(435): n is a, c, g, or t
  misc_feature (475)..(475): n is a, c, g, or t
  misc_feature (484)..(484): n is a, c, g, or t
  misc_feature (563)..(563): n is a, c, g, or t
  misc_feature (600)..(600): n is a, c, g, or t
  misc_feature (654)..(654): n is a, c, g, or t
  misc_feature (736)..(736): n is a, c, g, or t
cacaccagataagactattggaatcactgagtatcctaatatattgcgagcagcagtgactctcgtcctcctatcggctcagtctctaacgccttccatgaatttctgacgctcgagcatgggcgcagaccagggcgaaccctctctagggtagatcgagatccatctattcttgacacagcggtctctcgcgtcactacgcctcactgcattgtgtagtaattacactcttcattcgactagataattactccattcagtaattcgggaggagctttctgtgcgacagcgtggatcgtaagatatcctcgcctacacctaagtgcgagtgcctccccccgatatattcgagcngcttctctcgctcggctatgtatagaccaaacgagtagagcgcatttcgtggacgtcttctactcgtcgctctctctatcntctgcataacctcccgttgcatcgagcaagatctgtcgcntattagagntgtggagtgcgctcgagggatagcccatgggagacagagggttaagagaccatgggtcctacgcgctatacccttctangcatgtggaacagtatcttccctaatccctgggtgangcgcttcccgtgcacgacacttaagactcatgctgttctgccctattatcaacnctgaagactagagtggtcctgccctactaagtgcgttaaaggcgcgcgcgcatacgagatgtgtaccattcgagcgaaacanagttattcgagattagtagacaatccccgcatgcacgatagatcctcgatagtacctaacaacgcctccttctgtatcaggtctagattcccggtccttaagtcgacaatgtaggatccttacgtttcttccctgattctcatctacctaggtctcataggcttgacgtggcggattcgtcctaatagcgtaacgttaatcaggatggcgtgaaacccgtgcaagctatcctaggcctttcttgtcggaggccccggcccgggaggggacgggagacccccccaatttcgtattaaccggagggaaccattaatttcctggattgatttcccggtcccaccccttggaaggtttcattatttcctttagtccttaagccaagggctctcgggaagtgaaatcactcccccattagtttggtaagtttactttactcccgggaccaaataagaaaccatgttttggaataccctaagggtaatg

SEQ ID NO: 590864 - DNA, 1000 bp, Homo sapiens
catggaaggaatcatggatggatccgatgaagttatacgtgtacctcaaagcatggctatttagaaagtctaccgcatgatttgtggcagcaaagtgagcactagtagggagcaaagatgacacaacttgcctccttctacttcctccaaagcttggtcttacaggcgagagcggtgcagcaggtggacttgtatacgacttctatagcttggatatgcggccgttccacatcttaccagagaagtgtcagctgtgcaatgtgtctggaggggtgggagagaggaattctgtgagcctgttacatttcggtgaccgacgacgatgggcaggagcgaacttgattttccactagttaaattgtgcatatgggtgaagcaagtcagccatagtacacatcagcaatcatcgctatgcagctatgggtaagggacatgtgggactttactgtgcatctttcgaggcagaagccttgagactcaagccatcccaagcctttcaccaatgaggtacaagccctgggggctagctaatcttgaactgttttcttgatgacaggagcgtatgtgaaaagcatcaaacagtgagcatgacagggatgggtcgtctcatacagatcggcacgggggttagaaagccagagccaggtgaacatctgggggtgcctggtgtacccaggtcctataggaatggaacggtgtgaactgctcggaagtccatggggagatccttgttaagccaaaccgaggaaaggccctgtaagatttcacagagttcaacaacaagtgtgcagacctgcgtgtcataaaatgtgtctcacacaaggtactgggtcttgagagataacaagagggggggcaagtcgacagaaaaacacacactcgggagtgtgaacgaaaacaagagattcatcacggtatcagacaagacgatcagaaaagaatgcctccctcctcttctcccgcgcttccgctacatattttctcaagaagagaagagcac

SEQ ID NO: 590865 - DNA, 784 bp, Homo sapiens
  misc_feature (151)..(151): n is a, c, g, or t
tttttttttttggatttaatttaattttattccatttaaattataacttaaatagcgacactgtggataggggcaaccatacggtacagctcagtcccagaagctttcttccttacggagggacagcccctcaaaccaagcgtggaacccncaagccacgtttataattttctcaaaacaatctcagttgtgaaagccagggcccacaaaagtacgtgtgttctctaaaagttacgaaatctcgacgttattatctcatcttctgtggttatagtgaaccacgagatacacgagggaggccaaaggtggtttccacactccaaatagaactctttccacttctccaaactctcgctgtgtggacagtgtctccaatttcttatggggcttttacaagggagaagaacttagaacgaggcaaaggcccgaaggggcaaatgtggcttaatagcggccacactatagacaagtgcagggtgtgggggagtaagtgctgtaaacgttcaacccctctcaaacgaaggggggagaatgttgtggccccccaagcgaggggggacagcgtgtgttatattctccgggccaagaaggcccgtggggtttttccattaaaacgcgtgtgtatagccgtggaaagccatgtggtgtgaagcaccattttctgtgggacgcctcagagccgtgtgttcggggcatatcaggatcattctctccacacacacaggttacaagcagcgctttctgtggttagttcgcccttataggtggtcttggcgggaatatt

SEQ ID NO: 590866 - DNA, 191 bp, Homo sapiens
gtgttgtctggaccacggctagcgggccgacttgattggcagcgtccactcggaagccctggaaactagatgaccactgcaaagactaagatggtggcgatgagattcatgaggttgggaagattctgcgcggtagaacgtcctcccgtaagggctcggaccttgtcttgtgcgtgtggccagcatgatgg

SEQ ID NO: 590867 - DNA, 629 bp, Homo sapiens
  misc_feature (62)..(62): n is a, c, g, or t
  misc_feature (122)..(122): n is a, c, g, or t
  misc_feature (210)..(210): n is a, c, g, or t
  misc_feature (391)..(391): n is a, c, g, or t
  misc_feature (410)..(410): n is a, c, g, or t
  misc_feature (460)..(460): n is a, c, g, or t
  misc_feature (498)..(498): n is a, c, g, or t
  misc_feature (505)..(505): n is a, c, g, or t
  misc_feature (520)..(520): n is a, c, g, or t
  misc_feature (539)..(539): n is a, c, g, or t
  misc_feature (569)..(569): n is a, c, g, or t
  misc_feature (602)..(602): n is a, c, g, or t
  misc_feature (626)..(626): n is a, c, g, or t
  misc_feature (629)..(629): n is a, c, g, or t
gaaaaaaaaaaaaaaaatagcgctcggagcgctcttgcggccacaggcgcggcgtcctcggnggcgggcggcagctagcgggagccgggacgccggtgcagccgcagcgcgcggaggaaccngggtgtgccgggagctgggcggccacgtccggacgggaccagacccctcgtagcgcattgcggcgacctcgccttccccggccgcgancgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggangggggcacaagatctgganaccccgggtggcggacggaccctccccccgccccgcctccggggcaccanctccggctccattgttcccgcccgggctggaagcgccnaacaccnaacgccgccggggantcaaacgccggccgcgganctcttgcgaccccgccaggaacccaaacanaacccggggggcggcgggccggaacccgggaanccgggcacaccccgctcgcacaanccn

SEQ ID NO: 590868 - DNA, 368 bp, Homo sapiens
acatcgcggctcgcgtgcccatcatatatcgacgagattctatgacaggtatactggtcatcccactaaggttacgcgtgccggcaggtcatgtacatgatcagtaccactcagagccacagatgacacgaggtcaaaactgatctgtccatcgggatttgggatactcaataggtgtgcaagtcctgggcgggctggagccggtcacagtcagaaccgttagtgtgcagaggtccacggctccattcctctcaatatccagtaaaagattccggggtacactcatccctccatatacacccagtactcgggggcaggacggtcttatctttctaacagaatatagctctttccatacccagtgagtc

SEQ ID NO: 590869 - DNA, 102 bp, Homo sapiens
tacagccatggatcgaattcttttcccgataggtttcaattgattgaatgttcatatgacatgagtgaggcgcaatcgcatccaagcctgcatgcttgtaga

SEQ ID NO: 590870 - DNA, 220 bp, Homo sapiens
  misc_feature (70)..(70): n is a, c, g, or t
  misc_feature (136)..(136): n is a, c, g, or t
tgtaatagagtaatccactaggaccatcaccagaatggaaatggggatgccaaaatccccaatgatgcgncgagccttgccacccaagaagcggctgttcctgaactttcgtaggaagaaggcaatgaggaaggtnccaagcatgagaatgagggacagcagagccgtgttgggctggttcctcgggcccggcggcccctcagtggggggcagggcgctc

SEQ ID NO: 590871 - DNA, 160 bp, Homo sapiens
taggctaacccattccgcgatgagtgagctttctggagttacggcatcacgacagttctcgtttatcagcagataactgaatctaccctggatgtgagtgaatgcgggtgctctctgagcatgccattatcgtatacatctctgtgcgctgcaagatgag

SEQ ID NO: 590872 - DNA, 134 bp, Homo sapiens
tcgagtgagaggagcagcggtagtaaacttaggagagtctgcaatagtagtgctcataatgtgtacttaaaaaaaaaattcccaatctgatcacttcacccttctgctgaaatcctttcctgttctccactaat

SEQ ID NO: 590873 - DNA, 445 bp, Homo sapiens
tctagaggtactcctcagctgaaaaagaggagattctacactgcgaacccaggcgtggagcagcgtgctggtacaccgaggcactgtggcctgctgcactggaggaggggccatccagttgcatgaaacaaatgagaatgggatgcagaggacgtcaggtagaaagacccgagctgatggggccatgttcggcttgaaagagggagggagacgcttgtgggcactccctgttttcactatttcttggtccccttgtaaatattcgagtggtataagctttaaacaagcatcgtctggctaaaagtcgcttgcgcaattgtcgttccgacacaacgggcctggaactcggaacaggtaaaggctatcgggtgagacatggctaattgttggctttcaaagtctttgtcgctgtcctttgtaaacgtcctctccttctcgtcctcat

SEQ ID NO: 590874 - DNA, 364 bp, Homo sapiens
gcggtgcttttccccctatgcctgagtcttcttcaccctgcttttgctcttataaatcttttctgtttccctggcctttgtccagagacaggccttgtttggctttggggagagaagcctgagggtcatttatcacttgaacagtgggaatgggggattgagcggtagtttttttgctgtcaccatggcaaaggtctgtgcacagcttacctacattggaagatagctggccccatgttcctattaattgccccaccgttgactaactgtccacgctcacgacttgctccacttcattgatgaacggacaagaatctcgtgcagcaggacaggacccttctcggcgactaaacacagcgacatg

SEQ ID NO: 590875 - DNA, 379 bp, Homo sapiens
taaaacttactttaatgatctctgtgcttttccttataagaataaaacatggcagctaatcttcatgaaaaccagaaggatcggacaaaaatcacatttatttcaccagctccggaaacagacagagaagtgaattcaagctcaagatacgatttcaatgatcacctgacacacaaagacaaggggtggacagtggaagtggggctcctcaatttaaaaagaccgcaagtaactggaaaatctttaggctataatattctatgtacatcacgtaggaaatgagccaatttacaagatgccaataagagttacttacaatcaaacaatccttcacagaaagaatagtcctaacctggtcaaacccagaccagagcaggtt

SEQ ID NO: 590876 - DNA, 219 bp, Homo sapiens
  misc_feature (21)..(21): n is a, c, g, or t
  misc_feature (23)..(23): n is a, c, g, or t
  misc_feature (25)..(25): n is a, c, g, or t
  misc_feature (27)..(27): n is a, c, g, or t
ctctctctctctctctctctntntntntctctctctctctcgtcaaggcaaagagaatgtcaaggcaaagatccaagataaggaaggcattcctcctgatcggcaaagatcaacctctgctgatcaggaggaaaacagctggaagatggtcgtaccctgtctgactacaacatccagaaagagtccaccttgcacctggtactccgtctcagaggtggg

SEQ ID NO: 590877 - DNA, 90 bp, Homo sapiens
tagaggatccacagagtctcctcgtcttgctcaaaacttcagtggctcccagtgcttcaagataaagttgttctccttgacctagtacag

SEQ ID NO: 590878 - DNA, 1194 bp, Homo sapiens
ctacacccacttattccgcattactatgtttattactcgacaaccatgcagtcgctacgttcattacaaaccaagtagacgcgctggacctgtacagccgtaatccagtcataacgaattactgcaggccacgctagcgtcaatgtctactctaattgggagagctgccacccttatgcaatgatcaatccattgcaacctatcccatctacgacttatcatcgttcacaacttctagattactatctggatctatccttatggaaatccgcatgatcggaaccgtataatcctaatgccttatcgttattcacgatcttcctagttaaggtccttctaccttgctgcgtatcaatcaacaataagtgcaccctaaccatattctagcactgccatatcagtatatgtgaaaacccgagtcgcatgacctccttaacacggggcccgtcatccagcccatccatacatgaccgtctctgtgcacttatgcctcaatagtgtactcatcaacaattcgcatcgtccgatagagcggcatcctcgagtacgtaaggcctactaatccaacgagcactaactcatatacgcaattgatggacgcgtactgtcaatcacgagtaaagcagcattaccaaagggcacacatcacagcatctgtccaaaaaaggccttcgatacgggataatcctatatattacctcagaagtttctgtgcgttcgcaggatctggctgagccttttaccactccagcctagcccctatcctcattaggagggcacggtgcccaacacgagtaaccgctcaattccctagaagtccgatccttaaacaacagtcggcttcctcgcctcgagggagagatcagtcccgtgagtcgccatacttctatggcacaacgacgcgaccaatatcacgcctcgcattacattcgtggtctccagtccctcccaaaaagctctaacaactccaggttccattgccatccgcaggaccacggtacactattttcacacagcttcccgatcacgccatggcgccaccacccccatgctcacccgcacaatctcccccacacactggcgtccccccgccccatcaccacaccaacccgtcccctcaagtggtacacgccacacagagctcgacccgcaccacgagcccacccctccactattaccacgacgacaacagac

SEQ ID NO: 590879 - DNA, 1254 bp, Homo sapiens
cagcccgcgcgggtactgtgtgagtctgcgtctggtgggacggggacgggcgcggtggaaggttgataggcgctgtgggtttgagcttggtgcgttgtgcgcgttgagggggttatgttgttcggtgtcctgtgtgtttgtatatgggatagtgtgtgcttggctgtgctgaggtgtgtgctcgggtgtgttattggcgtggtcagatgcgtcttggagttttcgtgaggcgcctttgtgtgtccccgggcgcggggatgacgttgtgttggtcgtggtgtgcttgtgggagccacacgtgggaactgcggttggaaaatattatagaagggctaaatgtgggggcccatcctcccttgacgggatttgtatgatgtctagtgagggacgcgacgtatgtgggggcttgcgtttcctgtcgtgcatctgagagtgtacggtgttatggcgtgcactatgccgtttctcaaaaaagtttccttgttgaggcatagcatcaggagtctgaggtcgctctttggtcattacccttgggaatattaagtgtgttcatcaggctggtgttgttagttagtaaacagctgtgttaataattagagtactggttcttaagtgatatcagttattgttagggtatgatgttaagactattgatttcacctatacagtgaggatataggtttataagagatacttcatccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattttgtgtagtcaagtcaccatgctgaatgtacactgattcctttatgatgactgcttaactccccactgcctgtcccagagaggctttccaatgtagtctcagtaattcctgttactttacagacaggaaagttgcgagaaactttaatgatatctaaactctgaaaacctatgagcaaatgggtgctgaatacaaaaattataaagccacatattcattgtcataaatcaaagcagacttattaactgattattataaaattacaaacatgatatattcagcaaccttcaaagtataacatcttataaa

SEQ ID NO: 590880 - DNA, 1338 bp, Homo sapiens
cagcccgcgcgggtactgtgtgagtctgcgtctggtgggacggggacgggcgcggtggaaggttgataggcgctgtgggtttgagcttggtgcgttgtgcgcgttgagggggttatgttgttcggtgtcctgtgtgtttgtatatgggatagtgtgtgcttggctgtgctgaggtgtgtgctcgggtgtgttattggcgtggtcagatgcgtcttggagttttcgtgaggcgcctttgtgtgtccccgggcgcggggatgacgttgtgttggtcgtggtgtgcttgtgggagccacacgtgggaactgcggttggaaaatattatagaagggctaaatgtgggggcccatcctcccttgacgggatttgtatgatgtctagtgagggacgcgacgtatgtgggggcttgcgtttcctgtcgtgcatctgagagtgtacggtgttatggcgtgcactatgccgtttctcaaaaaagtttccttgttgaggcatagcatcaggagtctgaggtcgctctttggtcattacccttgggaatattaagtgtgttcatcaggctggtgttgttagttagtaaacagctgtgttaataattagagtactggttcttaagtgatatcagttattgttagggtatgatgttaagactattgatttcacctatacagtgaggatataggtttataagagatacttcatccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagagagacatgcttctaaccactgaggtatgaggcatgtctctcttgagctacagtagaggggaagggattgttgtgtagtcaagtcaccatgctgaatgtacactgattcctttatgatgactgcttaactccccactgcctgtcccagagaggctttccaatgtagtctcagtaattcctgttactttacagacaggaaagttgcgagaaactttaatgatatctaaactctgaaaacctatgagcaaatgggtgctgaatacaaaaattataaagccacatattcattgtcataaatcaaagcagacttattaactgattattataaaattacaaacatgatatattcagcaaccttcaaagtataacatcttataaa

SEQ ID NO: 590881 - DNA, 115 bp, Homo sapiens
aatttttaaaaaacctggtggacgacggtgatcttggtccttttaaaaaccatggattagtccttttcagtactaatgtctactggacttccctgacaaacagatttagaatcta

SEQ ID NO: 590882 - DNA, 242 bp, Homo sapiens
  misc_feature (28)..(29): n is a, c, g, or t
  misc_feature (54)..(54): n is a, c, g, or t
  misc_feature (192)..(192): n is a, c, g, or t
  misc_feature (205)..(205): n is a, c, g, or t
aaactattcacattagcactaaacaagnnagcagtctactactgtcatcatttncctgagtgcccatttgctgtacagcataaactattacagcataaactattacagcataaactattacagcataaactattacagcataactatcagaaaaccaaaaaagaagatattcctcgtcagcttgtctacatnggtctaacttcanagatggttagtatcaatgtgcacataaaagaataaca

SEQ ID NO: 590883 - DNA, 139 bp, Homo sapiens
gcaggtgtctcctctatcattaggggccatcaatttcatcataagcaattatcaatataataccccgctggcatatacccaataccaaacgcccctcttcgtctgatccgtcctacgatcttgaattgacacatcttgt

SEQ ID NO: 590884 - DNA, 125 bp, Homo sapiens
tgacctacaggagcttataggttaattgcatctagtatggagagatatctgtatcatgggttacatttctccttaaagtgacaaacatcacacacacacacacacacacacacacacagacacac

SEQ ID NO: 590885 - DNA, 206 bp, Homo sapiens
cctaattacgagatggatgtttctcatagatatgtaaacatatataaaatagggtatgttactaaacagtcctcagtctctgcttaaaaacgacacacaaggagttcccgtcatggtgcagtggttaacgaatccgactaggaaccatgaggttgcaggttcaatccctggccttgctccagtgggttaaggatccagcgttgccg

SEQ ID NO: 590886 - DNA, 157 bp, Homo sapiens
gcactttgcctattgtgaggcgagtcgctcgccggtcggcttgattagatggcggtgcaaggagcctttcctcctgggcagcttggacacaccttgccagctagggcgccagatgcattacggtgctgtccagctggctcactcgggttgctgggct

SEQ ID NO: 590887 - DNA, 841 bp, Homo sapiens
tccaatgttcagttccctttaatgacccccatctccctgaaagggcaggtgcaggcagctaggtgatggcaaaaaatgttcacttgaagatcttgccctgattgaaggctttgcccacttgctggaaggcccccttcccaggaaaagtactctcgaaccagcgtctgggtctcctcgctgccaggactccagtttccgccagtgtgtatgactcgtagtccaccgtgccaattctgtggacctcagcggaaaggcaagcctcctgtggccctcggaagacccagacttccagaaatgtggagctgcatatggtgggtcccaaaaaggatgacactggcgaccggcatttctttccctcacgctttgttccagttcgcgtggaacactttccaggtgaatgaagaattgcagctcagtgagaggtcgtgagtgaagttctctctcagggaaagcgatactctgagttcacccacgagggcaccagccgtccttttcaaagtgctcccagaaaattatggcaggtgcccacagaagaaggtgtgtcctcatgggcagtcacttgcgcttaaattcatccaacacaagaggtactctggggcaggtgaagcgaaggggtccttggccttgggctcagcagccagcgcctgctcacattcatccatctcctcctcaggagcaggggcagccgccttttctcctccttccgttcagcctggggcttctgcttctcttcccgtgaaccctttctcttcccgtggtgtgtcctttcaggtggggctctctgcaaactttttagcatcacacttgggccatctttctcaccacagttttcattccccaa

SEQ ID NO: 590888 - DNA, 978 bp, Homo sapiens
ccgctataatactaaccgtctccaagggtcgtgctttctgtgggccgcaactgagtttgggcgggtctcaccccaacatctttgggcccttgacagatgatcaaagcctttcctctagtcttcagaggcgctattgtgcccgccgttccaagcctggctgggcaccagcgtgtgtgccgggaccttctagcataaatcttgagtgaacaccaccacgagaaagggcccagcacgggggtcagcaccccgggagaattgcgcaccacatggtgcttgaaaggaggaggatggttggcaggcccgttgcccccagatccatcccagcacaggaagcaaatgcttcggaaggaacgaggactttgggagaggctcggcaagaaacgggccccaggtccggcaccagcgagtgtacaaggttctgccttccgagacattttgaggtagagccactttgaggagcctcctctcctgactctagatgcccagacaccgagccccgagtctctgcggtagcccacttaccctaagccgggatggcgcatgtcggggcgccacacactgcccacacaccccagcactcccccaagtgcgcatggcccacaaacacaccagggcccatggcaccagcccaagtccccgccagggacatccccctggcgccggcccccaacccccagggcgcgggcaatgcacccatagggcaccccccagtgcaaccggcccctcaccaccagagggaggcaacagcgccaccagagtatgactcaacgcatgctgtacctcgatctggatctgccggggccccaacgcacactccaaccatagcacagcagcttcacagccagatccccacaacctcatcagactctcttcacccatttttgatactatcttcccccaccccccgctacccctagggggatgcagagttataagcccccaaacaggtcatgctcccattaaaatgattctacctac

SEQ ID NO: 590889 - DNA, 373 bp, Homo sapiens
tattaagtgaagatatttcattattgaccatcaccctcaaagtactccaaatatccacttacagattctacaaaaagagtgtttcaaagctgcttaatcaaaagaaatgttcaactatgtgcagatgaatgcacacatcagaaagaattttctaagaaagattctgtctagtttttatgggaagttacttccttttccaccataggcttcaaagccctccgaatgtccattgcagattctacaaaacagtgtttcaaaactgttcaatcaaaagaaatgttcaactctgtgagatgaatgcacacatcacaaagaagtttcacagaatgcttctgtctagtttttatgtgaagttatttccttttccaccgta

SEQ ID NO: 590890 - DNA, 338 bp, Homo sapiens
gagcatccaaaatatgtaaaagcaagggtgggcgtagtgctcttgcctgtgatcccagcattctgggaggccgaggcgggcagatcacttgagatcaggagttcgagaccaccctggccaacgtggtgaaacccgtctctactaaaaatacaaaactagctgggcatggtggcttttttgcacgcctgtagtcccagctactcgggaggctgaggcacgatcatacctcactgcagcctcttgggcttatgtgatcttacccctcggcctcttgagtagctggaactacaggctaaatttcctactttggtaaacatcagtagtggccaggtacttct

SEQ ID NO: 590891 - DNA, 325 bp, Homo sapiens
gcaatcactggggccctagctctactctcaagtacagagttatggttgtgtgtatcgaatgacaccgttagtgacccgataccatgcactccacctccttctccataagatatgaaacctaacaagtccctccaagctctgaaatgctgtaaacttacacacactccctgtattctccccggcgtatttcttccgttccattgcagtggacttacaggttttgcattccttatactgacctagggactaatcctgattttctcatactcaatctatagccatagtgtggcttaccacagtcctatttcagtgaagcaggaactgg

SEQ ID NO: 590892 - DNA, 343 bp, Homo sapiens
atgttcgatgatctggctccgctactgtaggtcagggctgccatccttcctcttccatcactcgcagttacctgaagctcggcgtcgtgattgtttagggggcttccgatgcgatcgggcagtgtcagtcttcagctgctaatccgagaagatctgggaaggagtcactcagagagccttgggccagagttctaggggctctggtagctggctgcctggtgagttgaacagtctgattttcagtggggtcctacacagataggacacggcttaggaggaatcctgggctgcgggcattccttgtccctgtggccatatttccggcacttgtagcaagcttctt

SEQ ID NO: 590893 - DNA, 152 bp, Homo sapiens
atcgggtctgggcacgggtggagatgggagtgctagtgtgcggtggtggccttaggagttcatgggaggggtagattggccggggcgcgggggcgtgatcgccggcaaaggaaccgatgagtccggggctgacggatacacaagccgcttca

SEQ ID NO: 590894 - DNA, 298 bp, Homo sapiens
  misc_feature (84)..(84): n is a, c, g, or t
  misc_feature (95)..(95): n is a, c, g, or t
  misc_feature (100)..(100): n is a, c, g, or t
  misc_feature (102)..(102): n is a, c, g, or t
  misc_feature (114)..(114): n is a, c, g, or t
  misc_feature (149)..(149): n is a, c, g, or t
  misc_feature (152)..(152): n is a, c, g, or t
  misc_feature (220)..(220): n is a, c, g, or t
agtctgtcatattataggtcaagaaacaaaagctgctgtctagtcatgttgtcaatacgtttgggtcagacgggaaaagggagnaagaaggaagnagagngnaaatactaactntctggaaaacacatttggcttaactgccaaataangcnttgcggagaatgaaaagcctataatcaggatttaggtgtgcaataaaacacagctgacaccagaccantccttaaatccatccggacccccctttttagaaaagggattaaggaacagggagggggaagtgtgatccttgctttcc

SEQ ID NO: 590895 - DNA, 419 bp, Homo sapiens
ccccccaaggttaatatgtgggccctccctgaaaccataattccctaatgtcaaagaggtttttaaaaaagcctacaaatttaaccacaattaccagaattgggtagagggtatgaaacacagaatgcaacctatcacatctgaacaaagttataatccccagcactttgggaggcccaaggagggtggatcacctgaggtcagaagttcaagaccagcctagtcaacatggtgaaaccctgtctctgctaaatatacaaaaattagccgggcgtggtggtgggcgcctgtaatcccagctactcgggagaggctgaggcaggagaatcacttgaacctaagaggcagaggttgcagtgagccgagatagtgccattgtgctcccgtctgggcaacaagagcgaaactttgcctcaaaa

SEQ ID NO: 590896 - DNA, 344 bp, Homo sapiens
attaaatttttaaccaatttttttccctttaaaggaagaggccccccgcccccgtttggaatttaaaaaggggatggttttaaccttaaaaaaattttggttttgaaattttttttccccccccttccccaataagtctgtttaaaaaggtggggcccctttgggcccctccccaaaaaccccggccatattccatgttttttaaatggggttgggaaatggggaaaatttttttttaatgattttcccaaggcccccaaaaccttttaatgatttttaaaaaggattttttttcccccccataaaatgaatcgaaaaaaataaagttttttccctaattttcc

SEQ ID NO: 590897 - DNA, 343 bp, Homo sapiens
  misc_feature (132)..(132): n is a, c, g, or t
  misc_feature (203)..(203): n is a, c, g, or t
  misc_feature (219)..(219): n is a, c, g, or t
  misc_feature (289)..(289): n is a, c, g, or t
cactaataaaacctagttgagttcccaaaagatttggaccaaatttccaattcagatattattagagatcatcaaaactcaaatctctttactggtttacaccaaatcacccaagcttccagcctaaaaccnacatgctcacatggttccacagtgctgtttatgtacaataaccagttctcaaaatggtaatcctgttagangccagaaccctcagcntctagcatgtgtgcttttcacagagataagtctcaaagtttggggttggtgaggagcccagtatacaggngttccacattaagtcataattggctttgtgttggacagtgtatgtcagctggtg

SEQ ID NO: 590898 - DNA, 820 bp, Homo sapiens
cccggttctggggtgggtgtgggtataatactaagttgagatgatatcatttacgggggaaggcgcttggtgaagtaggccttatttctctgggtcctttcgtacagggaggaatttgaagtagatagaaaccgaccgtggattactccggtctgaactcagatcacgtaggactttaatcgtgtgaacaaagcaaacctttaataggggggtgcaccatggggagtgtccgtgatccaacatcggaggtcgtaaaccctatgtgttgatatggactctagaaataggatgtgcgcgtgtatatccctagggttaactgtgtcccgtgggctcaagttatgggactcaatggagtatagtagtctcgcttggacggggtgaagtcttagcatgtacggcctcggaggtggggtccctgctccgaggtcgccccaaccgaaatttttaatggcaggttgggctagtttaggacctgggggttggtcaggtacggttggcattcaataaattaaagctccatagggtcttctcgtctggcggggttatgcccgcctcttcacgggcaggtcaatttcacgggttaacaagtaagagacagctgaaccctcggtggagccattcataccaggtccctattaagaggaaccaagtgatcatgctaccttggcacgggttaggggtaccgcggccgttacacagtgtgtcactgggcagggggggcctctactacgggtgacggaacaggtgaggtatgtgcaaccaggggggtcaattgccgcatccttactttttaccttacctttagacatcgtttgtgttg

SEQ ID NO: 590899 - DNA, 358 bp, Homo sapiens
tcgcggccgcgtcgacgtgactttcgcactggaggagatcgaatacagccgtggctgcaagggattgagcaggctgagcaactggctggcgccgaggctgatggggaattcgtgcagcaggtccagtagttgccggccccagagccaatccttgagccgggcctggttggcttcctcctgcaattcgtccagccagggactggggcagagcccgcagacccggcgcaaaatctccggggtgatccgggtgatatccaggtgatcgagcagggcttcgcgcaatctcatcggcgccttgagcgtgaccccgctgtcgccggtcgacgcggccgcgaatttagtagtagtaggcggccgc

SEQ ID NO: 590900 - DNA, 772 bp, Homo sapiens
  misc_feature (81)..(82): n is a, c, g, or t
  misc_feature (121)..(121): n is a, c, g, or t
  misc_feature (124)..(124): n is a, c, g, or t
  misc_feature (376)..(376): n is a, c, g, or t
ggtggcgcgcgagaaggtgggtgggcctccatttatacagaactgcagcgctttcgtgttggctttcctcccattatgtgnncggcagtcgtgcgaatgggctccggagaagcggaaggcnccngtccggcgaccaacatttccgtggggcgcggggcgttggcccacgaggccaaggcgcagacttctacaagtgatttgtgcagtgataacggcacaagcggcggggccccgcgcttggtgtgctcacaaaggttttcccacagggaaaattttgtgctgcgtgtgttttccctgtgagggggattacaataagaagaggaggttgtttgggacggaagagtaccacgtgaggcggttatataaggaccaaggnggttaacccacaggacattcgcggcattggaaggaggagaattaaacctccctttaaaaccaaatttatattagaccacattaggcatctctccgtgtcagcgtctcaaacctagttataaatagggctaaatattgtgtggggcaagggatcctttgggcttccttgggcaatgcaaggctccttagcattcttgcatgtgtgggccaagaaaataggttatcgcttgtatgaagggtttcttctgggagcaccatgtttgagaaccaggtgtttgtcaccaggttgcttttggagatactttaaaatgatggtacctgtgttgttctaagctgcaatctggttcaccttccatccatgcaaaaatggtcaaattcttgaatgaataagtcaagt

SEQ ID NO: 590901 - DNA, 538 bp, Homo sapiens
ttttttttttggagattgttctcatttccaaaatcgtcagacaccgatttctctgcgcttttcttgcctggtgtcaggacagggaaaagctatgcaggagacatggcctctagctctgttcaaactgtcaattctgctggggacccttagataaatctgttaacctctctgccctcagtttccccatctttaactcgagagtgtagatctaaatgctagaagagtactaagggactcttccagccactttttggcagggatcagacttcggagagtgaactcagggagcaaagaggtgaaactggagcagtgtgagggttaaagggaaggcggctgcggtgccgagcaggggagcacgtcgggggtacagcaccagggctggaggaatcggcttgccacaggtgggcgacctgggaccctctatgtcaggtggtacatgctgtacccacatgggccgtgtagagtcccacgggcccacaagtgcgggcgcgctggaagggccagaggcaccgtagagcgaggcacccgccgcggtcgc

SEQ ID NO: 590902 - DNA, 661 bp, Homo sapiens
ttctgttagtttcgcggacccacaaatttggtgggggtccccttgggggtatattgtcctcccccccacatttgcgttgttgtgggcgcacttccccgccgcgttgttttgaggagctgtcgttcaaccccgctcgttgttggtagtccgcttggtggcacgattatgtttctgtcggtccatctgagggttcattgttatcgtcccaccgcgcgcggtctggttctgttaaaaaaaatagcgtctgtcgactacaataatgcgcttttccccttctcctccgtgcaccacacacggttgtccacaaccatttgttctgtcccctcaaggataacatgtgctgtgggatctgtcccagcagctgctgtatcagagcggttacaaggtaacaaccagggcgggtctgattctctcacctcgattagtacgtcttttcttggaggaaaccacttttcacgcacggttaatgatgggagcaccgccaacagagacggcgttagcgaaacgctaggtacttatgggtcaggtagttatatgacttggctatgcgttgttgtgctgtttaacacaccttgaaaaaggttaaattttttttaaccaaaattttttttccttaaacccaatcgccccccaaacaaaacaaaaaaaacaaacataaaaa

SEQ ID NO: 590903 - DNA, 880 bp, Homo sapiens
acgcggcgaaaccaaaacagtcgccggtggttcacaaaaccacctcagaaaatgcttccagaggcacgtctggcctccacaaggtgacggcttttcatgcctccgactcgaacttgagtcgtccacagcactaggccgccgccagccctggtgctgatgctgcctatgtgtgacctgctgtgactgcctgcagcaatgcatgctccctgctccctgccacaccctgcctgagccatgcctgctgctggaacccactcccccacctgtggtgccctgcctccctgcctgccagcctgcccactgatttggtctgacttgtgtgcttgccctgtcgctgatgatgaatgtgctgtgtgcctccgtgcatggccgtgctgctcccatttggtgcctgggtgacttgtgctggctgtgctgtgctgctgcgctgtggcccctggctgatgcatgtggtgaacgcctggttgtgcctgctggcttgcgggaacctgtggctggtgatgtgcttgcctggtttctgtaacctgtcggctcctcctcgacttgactcagctgtggcttgtgaggccttggtgatctggcatctgggcccgcacccgacgctgggggacctgctcgtgagatgtgacggcctggctgggtgttggcagtgctgggggcttaagaaaggacgcaaggttaccattgttgacaagatattattatgggcaagcttaagacgtaggaaagccattggatcaacccctggctctacattttctaaccctgttcatgtgtatggaccatgggaagactgacccaaatggagcacaagaatatcgcagccacaacaggcaactcccggggttgaacggaattaattgtatccatacccaggcaa

SEQ ID NO: 590904 - DNA, 1683 bp, Homo sapiens
ggcgcctgcggggaatcggaagccggtatggtgagtgtgagacaggttagactcgactctagggacagattcttcaagcaatcactatgtcaacagacacaggtgtatcccttccttcatatgaggaagatcaggggaatcaaaactcattcgaaaagctaacagcaggccaccattcagtcacccgtaggcaatcagcgggttctggcaagccaatttggctagcatcatggcattcatcatcaacactgccagccagccaaggggcacatccttcaccacatgtccaattccatcgtggattccacacattgctggtgcttgcacacagccaccaacaggtgctaagtggcagagtcacggcgcagccacactggcaccgtggtgggcgaactgcgggcttcataccccacattgtattcggaggcgaaactctcttggggggcccacacaagctttaaaggccattaacgaaaacgaacacgacagactttgtcttggtacttatggagcgaccttatttggcattgcgcaaagaggacgccttgttgtgcatatacaagacgtcaacacggaccttggttactttatacattatcacttatgaacaacaggttatcacccattacattacactctgtgttcggcgcaccacaattacacaacctacaacttgtcgtgggtaacatgcggttcaacaccgacatgtgggtataaagacatatgtggtcccactgtttatagggcaccattacatttgggggactttaccccttttatccttgtgggccacaggtgacacttctggcacttcgtcggcctacttgggaattcgacaaccgccagtcaatgcttagaacctacacgttgcggcaacctacacacgcttcatacacctataccacacctctcaaaacgtagcgtcacatttagcccaagatagggcaaccaaggtagacaccagtgtatgaacaccatatttttaaccacactccactgtgtgtattcctacccaccgattaaagcacgttcggacacactagcttgccaatagtggcactgtattgagcaacacagttgtggtacccaccacccgttactcactagtaccaaagattcaatagtccaaccgtcaatatggcacaccgattatacgtgtacgctacacacggagcaaacgcaatatcaccagcggggtcgcgccgaacgtcacatgagtgaacgaggcaatcaatcacccgcgtgggtaagtgccaggagccagcacacatgttgccgcgacacatatttgtggacacactgttaggcacatcacagcgaggacctaatgaaggcaccccaagtataaagacaacacagcttaacggcaataccacatggacaatgagagagacagggatcaggcacgaatggtaaaaaaccagtggtccaaaacaaagtgccggtgcagacctaccacagtgtacaaagcgcccccacaaagtgcaactaatctacgcgtggatcacaccacacaccaacaacggctacacaaacacagcgcacacacacatataccacccacagcggcacagcaaacccacgacacacagcaggacagcacaacacacatagagcagaacaaccaacagagacaactaacacaccaccacccagcagcggcacaccaaagcaacacatggg

SEQ ID NO: 590905 - DNA, 368 bp, Homo sapiens
gtacgcatatttttatacttttgagacacaatctctactccattgtccaggctggagtagcagtggcacaatcttggctcacagcaacctaccacctacccgggttcaagtagattctatgggcctcagccatcctagagtagctgagggttacagtgtgcccgccagccacacctggactaaattttaatatttttcagaagagatggggtttcactatggaagccaggctggtcttgaactctagacctcaagtgatccacccaccttggcctctcaaagtgcggggattacaggcatgagccactgtgcctggcccagagccccagcaattcataccgtcaccttgcgggtgaggattacagtgt

SEQ ID NO: 590906 - DNA, 136 bp, Homo sapiens
tctacctcctcaatattgaaagctagatctcataccaggccagatcctaccttctcacacattgaaagacccagatccttatacctgagcagaccggcctggcttgctcaggtctgataagggtaggttcactggg

SEQ ID NO: 590907 - DNA, 101 bp, Homo sapiens
tacaatttttggaaagagaaattctcaccttcatggggggaaaacaaaacaaatcaacaacaaaaaaccaacaaaaagggtacctacctttttcacaaccg

SEQ ID NO: 590908 - DNA, 427 bp, Homo sapiens
  misc_feature (145)..(145): n is a, c, g, or t
  misc_feature (158)..(158): n is a, c, g, or t
  misc_feature (201)..(201): n is a, c, g, or t
gctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaanatctctgattggnaaagaaagggacagcaagaaaactgcttagagggatgctttangaccagaccctctttcctcaccctgtcattggtactggtaacgtgggacaagagagaaaataagtggggtatatgctggacatttttagacacacaagttaaaatggaaaaggcatagcacaattagctggtagcacatgtataaagagaaacatttggtatgttcttcagcactcgagagtttgtataaagagtacctttatcaatagtggtaaaagaaaaataa

SEQ ID NO: 590909 - DNA, 252 bp, Homo sapiens
tgatcagaggatcccgatatgctgctcaggtgaggataagggaatgactgatactcatgacatctagattgatgtgtgatctaacactgcttagatgtgcgttggctttctcttctttggattcacctattggcaataccttggtgggcaccaattataataacccccggtaatatccggttgggccccttctttttcaaaggtccaaggtggtacggaagttattttacccggttttgggaacggctatta

SEQ ID NO: 590910 - DNA, 498 bp, Homo sapiens
gatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacaaacaaacaaaagaggtggacgtggagtcctgataagtaagcaacaatgaggaaagggccccaggttggggagagtaattgttctgagaaatggctaactgcaaacaacccactggtacaacattctgttcccaaatatcttgctccacatatagccctggcagcacgaccttatctgcacaccttatccacatgtagtcccctccagcacgaccctttaaaactgcctcttggcggatagccccttctctgctgtgctgcccattgcactctttcaatgtatcttcatgctttctctaataaatctgccttcctttactcaaaaa

SEQ ID NO: 590911 - DNA, 150 bp, Homo sapiens
agcgtctgagatgagagtattagtcagttttgttgtgagtgttaggaaaagggcatacaggactaggcagcagataaggaaaatgattatgagggcgtgctcatgaaaggtaatcacgctcttctatgataggggaagtagcgtctagtc

SEQ ID NO: 590912 - DNA, 439 bp, Homo sapiens
tgctggctcgtactctagaggtatccccccgcagctgggcgcttggcagtgtggtgccagacatgtgaagacggcgtccgactgcggggcagttgaagcactgccgtgccgcaccgtttggaacaagcccacagtgaaatcccttccctgcgacatatgctaagacgttgtccccgcagctggtgatatgctgaaggacaacgccactgaggaggacatccttgtccacttggagaagacctgtgactcggtttccgaaaccgaacatgtctgcgtcatgcaaggagatagtggactcctacctccctgtcatcctgggactatcattaaaggagaaatgagccgtcctggggtggtgtgcgctgctctcaacctctgctagtctctccagaagcacctggcagagctgaatcaccataagcagcttgagtccggtaag

SEQ ID NO: 590913 - DNA, 143 bp, Homo sapiens
ccggcgagctgcttaagaagactatggtgcagagaatgcagctgtcttctggcgatgaactgcgggggagtaacagggaaacaacctggccctccagcactctcctctgctattcagcatcccctcctccgcttaccttccta

SEQ ID NO: 590914 - DNA, 128 bp, Homo sapiens
agcagtagaaaaaatggaaagaatctaaatgctgtgagtaatgaaatggctaaatatagcatatttgaacatgaattatgagacaactatcgtcaaagatgaacttaattctctatgtttatagctgg

SEQ ID NO: 590915 - DNA, 1273 bp, Homo sapiens
taggggggggcccttttttccccgggggccccacacaggggggacgaggagacacacccgggggggccccccccccccccgcgaggagaacaacaaaacaccttaaacaacactctctcgcgaggggggggcgacacaaagagaggggagagagggggcgcgcaaagagaggtgctgtcttctttctacaaaataaaacacaacactatataaaaaagagtgattataagggagagaaatatatataaaaaaatatgggtgtgtctaatattatattatctcacacacaaaacacagaagggttctctcctccccccgggggggaccagtggggagaagaagaggagagggcgcccttcctctctctctaagaacaaaagagagaggggggcggatctctatgagagagagggcggagagaggaattatccgagtgaaccacagaggagactctctctatataataggggaagggcactctctaagaagaacaaacaaagaagggcggacaacaagaacaccaccggcgcgccccaaaagctggaaaacacgtgggggagaaaaacaccccacaccccacccagaaggagggggagcacaccttccgcgcggcgcaccaactcaaacaagctctcgcagaggaactacatgcgcaccaaaaaacagatacaacacaacaaccacacacagaaaaaacacacaaaacaaagaaaaacacaaaacaaacgcgcgcccgcaacaaacaaaccactgcttgagtatacacagcgccggcgaacacacacaaagctcgtgccggcaaaaaacaaggggggtgaaagacaccaacaaacagaaccaaaaacagcgcgcccccacaaaagacaaactggcacgggcaaaccaaaaccatagaggagacccacgacaaacaccaaaaacaacccccaacagaaacagagccacaaagtcagtcaagaagcagggcaacaaacagaagaccaccagaaaaaagcggacaaacaccagaaaagaacattattcccccccgaaggaagacaaacgaccaacaaacaacacaaaggagcaggcgaagccacagaagaagccccatccagaagacaccagacaaaccacccagacaaaagttggcgcccacacaaccagctgagcgaaaagcgaataggagccaaccaccaaaaaagagacagacagagactggagcaaacacacacccccacaaaaagagcagaacacgcacacgagcacacacacaagaacgcgcaacaaagaa

SEQ ID NO: 590916 - DNA, 1442 bp, Homo sapiens
tttttctagtaagaaaataactcattctttcctccaatatgggatggagtaagagaacatttgttttaaatgctagccaagggtttttcattgaaattaattcaataaacacttaaatgtgtatcatgctggaactggggacacacagataaatatgacaaaatcctgtcctatttaaaattaaacaattctgttgatacaactagttgttaagttgtatctctaactcatgccaatgtattttagatgactaaagacttagatgtgaaagttcaaggtgcacacacacccaattcaaccaacccctaaaaaattagaagtaaatgtttatgaaaatctgaacaagaaagaatttctgagactggaaaacagaagaaattacaaaggaaaaggcatgtaataatataaaattaaataactacagtaaatgacataaaaattttgttaaaagtaaaaaacaaaagtggattaataatcttaatagataaaacgtccatagaaagtgataaagtaacactgaaacttcattattaagtaaatgtaaatattcagctgcatatcaaaagacaacagccttatttttaaagataatactgtgcctgcacagatttgggataacaaacatttgtatgctcttctatggattagaaaactcatgattgaaaatacctatcaaaagacctataaatgatcattcctttgatatcaaaacacattacacttccagggatttattttaaataatcctacatatatgaaaaaaatcaatggacaaagacatcacaggatacaaaatcaatgtgcaaaaatcactagcaaaaagtcactaacattcctagacaccagcaacagtcaagcggagagtcaaatcaggaatgtactcccattcacaactgccacaaaaagaataaaatacttaggaatacagctaattagggaggtgaaagatctctataatgagaactacaaactactgcccaaagaaaccagagatgaaggctgggtatgatggctcatgcctgtaatcccagtactgtggaaggctgaggtgtgaggacttcttgagcccacaagttcaagaccagcctgggcaacacagtgagcccccatctcaaaagaaaaaaaattttaataataaaaagcaatcagagatgacacagacaaacggaaaaacactccatgctcatggataggaagaatcagtattgttaaaatggccatactgcccaaagcaatttatagattcaatgctattcctattaaactaccactgagactcttcacagaactagaaaaaaatatttcaaaattcatatgaaaccaaaaaagagcctgaatagccaaggcgatcctaaacaaaaagaacaaagctggaggcatcacgctacccagcttcaaactatactacagggctacagtaaccaaaacagcatggtactgat

SEQ ID NO: 590917 - DNA, 392 bp, Homo sapiens
gaaaacagcattcccttgtgctatattctcagttactatggcattcgctaatctttcctaacaggactattttcctgaactgtaaaaattctcaaacactgcatacacagagaggataggagacatggcatttgcggataggaaatgaggaaattttgcgataggacagctgtagatcctgttgcggacacccagccgggcagttggaggcggggtcagtccagaagccttcagataacaccagggtgtagtcctggcgagaaatcttcagttgcttcaggaccttttctagccccacgcgacggctaggtcctccgtgagagaaaactggttcgagaagcatggccaacattcccaatgatccgtgagtattgagaagttctccatgttct

SEQ ID NO: 590918 - DNA, 934 bp, Homo sapiens
gcggcggagtcggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggtattcagctctttttcttgggtcaaaaaatttatctttagcaggaaatactggttgcagcttgttggttgtggtggtacaacttctaacctgagatactagctgtcgaatcacaagttttaccgtttttgttttgtgaaatttgcttatgtttcctatcttggcatcagtgcctgatccagagaagaatatactcaaatgtttgtggactgtatgaatgcatgtcggtcaaatgttatcaggattgtggggccattttaatacaaaataaaccttaaaattcaaaaaaaa

SEQ ID NO: 590919 - DNA, 876 bp, Homo sapiens
  misc_feature (35)..(35): n is a, c, g, or t
  misc_feature (38)..(38): n is a, c, g, or t
  misc_feature (47)..(47): n is a, c, g, or t
  misc_feature (49)..(49): n is a, c, g, or t
  misc_feature (51)..(51): n is a, c, g, or t
  misc_feature (54)..(55): n is a, c, g, or t
  misc_feature (58)..(59): n is a, c, g, or t
  misc_feature (61)..(61): n is a, c, g, or t
  misc_feature (64)..(64): n is a, c, g, or t
  misc_feature (66)..(66): n is a, c, g, or t
  misc_feature (68)..(69): n is a, c, g, or t
  misc_feature (74)..(75): n is a, c, g, or t
  misc_feature (82)..(83): n is a, c, g, or t
  misc_feature (90)..(91): n is a, c, g, or t
  misc_feature (95)..(95): n is a, c, g, or t
  misc_feature (100)..(100): n is a, c, g, or t
  misc_feature (120)..(120): n is a, c, g, or t
  misc_feature (137)..(137): n is a, c, g, or t
  misc_feature (226)..(226): n is a, c, g, or t
  misc_feature (366)..(366): n is a, c, g, or t
  misc_feature (431)..(431): n is a, c, g, or t
  misc_feature (486)..(486): n is a, c, g, or t
  misc_feature (508)..(508): n is a, c, g, or t
  misc_feature (538)..(539): n is a, c, g, or t
  misc_feature (556)..(556): n is a, c, g, or t
  misc_feature (562)..(562): n is a, c, g, or t
  misc_feature (587)..(587): n is a, c, g, or t
  misc_feature (591)..(591): n is a, c, g, or t
  misc_feature (632)..(632): n is a, c, g, or t
  misc_feature (685)..(685): n is a, c, g, or t
  misc_feature (707)..(707): n is a, c, g, or t
  misc_feature (713)..(713): n is a, c, g, or t
  misc_feature (715)..(715): n is a, c, g, or t
  misc_feature (732)..(732): n is a, c, g, or t
  misc_feature (748)..(748): n is a, c, g, or t
  misc_feature (776)..(776): n is a, c, g, or t
  misc_feature (804)..(804): n is a, c, g, or t
  misc_feature (812)..(812): n is a, c, g, or t
  misc_feature (815)..(815): n is a, c, g, or t
  misc_feature (862)..(862): n is a, c, g, or t
taagctgagaagggagagcgagcttaggaccgccngcncggggcaancncnaannaanngnganancnncaccnncccgcgnnaaaaccnnacgnagaangaagagcgcggcaaagcccngggagaccaagccaaangagggggcagcggcgccaaaaagcgcaaggaacccccgggccaggaggcccaggagggccaacgggccgccaagggcggcaagagggcncaggggggagcggaagcgggcagcggacaaccccgccccggcgcagcacccggccccccccgccccaaaaagcaaaaagccgcccaggcggaggaacagaagggacaggcggcccccgaccaggagccaaacgcgggcgngggcggccagccaacaagaccagaggcgacccacccagccaagggacagcgcccaccacccagcnccaacgcgccagcagcaccaaccagacccagcagccccaacccagcccccgcccngggggagagggcaccagccgcncccgagagggcagcagagggcggcccgcanngaggagcagcgcaagangcccangaaaggcgaggcggcagaaaacgcnccanctccaaacagcgcagcaaagccgcttccagccaaatcgagngcagcaccagaaacccccaagcccagcaagaaaaggaccaacaaagcgcagangcacaaaaagctagcaaacgcntcaaantnacagcaaaagaaacccnggaaaaagctcaaccnggagcaaccccagcccaagctaaaaccnaaacgggcgcccgagcgcaagaagcagnccaacgcnagnagcgccctcgggaaccccgcggcccaaaaacacccagcgcccaagangaaaccacaaaatc

SEQ ID NO: 590920 - DNA, 262 bp, Homo sapiens
ccgcgtcgacgacggacatggaagagggctggggtgatggtgaatagagagcagatatgggcatagccttaagactacagatgctaacgggagagccctgtgcttaccagacataggactattctcctcctcctccaagaagtggccttcctcggtgtttcatgaaggattttgtgtatgtgcatgtgtgttcacatgtgtgcatgttgaaggccagctttcagaaatttttagattttgaaatatatatttatgtcgacgc

SEQ ID NO: 590921 - DNA, 1393 bp, Homo sapiens
  misc_feature (1345)..(1345): n is a, c, g, or t
gcggcggagtcggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatgccaaggaagctggaggaaactacactccagcattgacagagcatgtnccccgtgaaatggcagcagagaccagcaagtggctcatgggtgagggg

SEQ ID NO: 590922 - DNA, 359 bp, Homo sapiens
cgtgaacaggactagccctaagtaagattgtgaggtagaacaggtagtatcggatgtctatgcttacacttcccgtagggtcccatgttatcaaaccctgttctggcctgaatcccttcaagtaacatcccaggaagttctggcttggaggaacccaggaacttggctactgtcttctcattctgacccaccaaaacctgtaccctgcaagttcttagaaaacatctgaaaaacaaagcatactctgatactaacctcatgaaggtacaagtgcattcttctcagggctatttgtgtttaagcactaaactaaagatgccactccttatcatatgccctactaccatccttatacaagc

SEQ ID NO: 590923 - DNA, 109 bp, Homo sapiens
catagtagcaaccgtgcactagtagccaaccagtgactagtagtcacccgtggactagtagccaaacgctggactattagcctaccgtggaatagtagcgcaacgtgga

SEQ ID NO: 590924 - DNA, 103 bp, Homo sapiens
tgcatattaaaattaccagcttcagttctggtaaaaattaccatgtccccttaatttctgcgatcagaattataaaaatatgagctcaacatacgttatggtg

SEQ ID NO: 590925 - DNA, 723 bp, Homo sapiens
tagaggacccccgaggggtcctgcagcttttctaatttaaccttgtcaggttaccaactactaaggttgtaggctcaagagggtgtgtcctgtcgtaggtaaataactgacctgtcgagcttaatattctatattgttgttctttctgcaaaaaagtggggaagtgagtaatgaaattatttctaacatttatctgcatcataccttccgagcatttattaagcatttcgctataagttctcgctggaagaggtagttttttcattgtactttaccttcatctctgttcattatcatcgcttttaaaacggttcgaccttctaatcctatctgaccattataattttttagaatggtttcataagaaagctctgaatcaacggactgcgataataagtggtggtatccagaatttgtcacttcaagtaaaaacacctcacgagttaaaacacctaagttctcaccgaatgtctcaatatccggacggataatatttattgcttctcttgaccgtaggactttccacatgcaggattttggaacctcttgcagtactactggggaatgagttgcaattattgctacaccattgcgtgcatcgagtaagtcgcttaatgttcgtaaaaaagcagagagcaaaggtggatgcagatgaacctctggttcatcgaataaaactatgaatttccgcaacaaatcactaatctgtgatataataaacat

SEQ ID NO: 590926 - DNA, 596 bp, Homo sapiens
  misc_feature (45)..(45): n is a, c, g, or t
  misc_feature (77)..(77): n is a, c, g, or t
gttggcttcattctgtacagtgatcctacatagtaacctgtgctntgtctcctatccagtcttccatgtctatcaanagttctgtgagtcgcttcctggtaagctggctctagtatcatgtccaagcctatattcatctggtagcacgcagtaattcttcacatctgtagttggttgcatcatgtccatatcacgtgtatatatagatcacatgtcctgccatagtagacactcgcgtccagacgagttgtaatcgtcggtcgcatcctacgtatgctgtattcatgtcacagtatactctatacggtgtgcatgaactgtcaggttgtatgagatacatgtcagatgtgtctcctcctgtcctgatgatctcctcacattctgtgccagacaccacaggaatactgcgagtgacagtgtattgtgcttctcaggttttccagtattgaacgaagcacacgaaggttagtttggatattactattcacagtctcatctatatataattggtgcttttccagttattaggagtactcattgtctacattttcattatctgttacatgcgtctgcctcgtctcgtgccgaattcctgc

SEQ ID NO: 590927 - DNA, 345 bp, Homo sapiens
gtgatgtcgatctagaggacccagcggggaacattcacttgacgggtggcagaggctgtagtgagccgagatcccgccactgcactccagcctgggtgacatagtgagactgtctcaaaaaaaaaaaaaaaaagccaaaaaacccccaaaacaaaccatagtgggggttttaaggattccaaacccaaaagagacgttggaggatgtgtataagacctttcttgtgtgtataacccccaaagtaaaaagcaaatttggacctcacaggggccttgagatcctggtgctaaggggtctaataatgggatggaaaggtgcattggggggggcatcctgtggggtggg

SEQ ID NO: 590928 - DNA, 160 bp, Homo sapiens
tcttccagtcttccagggtctcgatgtagttcagcccgtccacgccctccacatgcacgttgcgcacatcgctgaccgcgaagtagctgtgcagcgcctggctgatgctcacgctttcagtgtccaggttgtggctggtgaggctgatgtgcagttgctg

SEQ ID NO: 590929 - DNA, 387 bp, Homo sapiens
aggaggagtggggcggggtggcgggggaaaaacaaccgtgctgccaggtcacccagacctccagacagccggctagcccccctggccgttccttttacgcccaagttttgctccctgaaagcagattgggtgatggccctgcaaccccaggccaaggtttgcctcaaagaccgagtgacattaaccctttcccccctcctaggtttccatccagggctgtgttttccttgggggaggagatggggtcgttttgatcagggtaaggcagtcaggcgggggttcccccctgcctttttttcctttgagggtgagaaccctgaacccagcccctgcccctgggtccctgttctggaaatggtttaattaatccttttccctttttgaaaa

SEQ ID NO: 590930 - DNA, 486 bp, Homo sapiens
  misc_feature (400)..(400): n is a, c, g, or t
tgaggacccttatctttgggacggcgtaacaatttcattttgtaggcgaatcaagtagctgacgagagcggtagccagaggcccaggcccgtcgtcgtggcaagaggatctcaaactcagtgtccagatccaagtcagtgctgcagtagtctttgggtaggttgatctcaccgttcgtctcaagcgatctcctcagtttgttccatgtggacagaaagactgtgatcctgttgtgaagcagctgcctcaacccatctgagctgtgcttgttgaggaagcctctgatggagctgtattcaacttgctggacgttctggaactgcttcactagatccctttgcaaggccaaaatctcaggcaggaactttaccagcctcagctctgtttccttccgcagaanatgccagaggatgggcactctttctttgccatttttctgtcccacaatgtgctggaggtactcaactgtcgccgtcccaaagccag

SEQ ID NO: 590931 - DNA, 259 bp, Homo sapiens
  misc_feature (135)..(135): n is a, c, g, or t
  misc_feature (210)..(210): n is a, c, g, or t
gcatgccgctttttcacaaatttacagaaccgtaatactgcaaacagggggggcgcatggaagatacaagcttctccggtcagctcccggactcattgtattttgagataggctatcctggcctcagcgtagatngtgcccttacgtcgacttaaattcttcatttgcgtcctggcctcgttcgtccaagtacttccttgagacggctcngcctccttcgctctgcttgatacctcctgcgctctcatcctgctaatcc

SEQ ID NO: 590932 - DNA, 81 bp, Homo sapiens
tcagaacccagggactcagctgtgtacttctgtgccagcagctacgttacagggcaggcaaatcagccccagcattttggt

SEQ ID NO: 590933 - DNA, 371 bp, Homo sapiens
ccgaatcgccggaaaaagaatcggctggtcgaaaagtcggcgcgccgacctgcgacgccactaccaggtgctgtcacgcctgcgcatctggctgtcagaccgcgaggctgcggcgttcctgtttatcggcatgaccgcggccttactgttcgtggttgcgatcagccaattggccatgtccccagcggtgaaggccggccacatctacgccgtcatgacctatctgtggaccttcgtcaccagcctggacgaagcgccaggcatggtcgaccaactggcgcggctcaaggacattggcaagcgcgtagacccagggcttggggaggcctgagcctcaacgaaaccgatccacctcatgacgcaagcctgcg

SEQ ID NO: 590934 - DNA, 1732 bp, Homo sapiens
  misc_feature (268)..(268): n is a, c, g, or t
  misc_feature (391)..(391): n is a, c, g, or t
taatgttaggctgattaataagtgctggcttggggcagttacacagttggtttccaatgaggagtttatttgtgcacttttgacacattcacgtggtactgtggccaattatagaaagttgtgctcagtggcacaaagaaaacacccacagctgtggcctgtgccacgagccacaccacaagaacaccagaacaaagtggctagcattgaacagtgagaggacttaagaggtggtggggtgttatatctcgctttattataatataanagaacacaaaacacaaataattctctctctcgagccgagtgtcttatacaccaagagacaccatctctagagacaatcatcacacaatttcaaccagagtgtgttctgtgtgactctccgagnccgctgtgtgtccccattttttcctctccagagagagacacacagagagtgtatatggcacacacacagtgtgtaacagccacacacaacacgcacaattctctgtgtgtacaaacatttacctcatatgaaacacccttacaaacatttgtgattataacacatctctataacacttctctatatataacagattgtgagcgcttctttataaacaccaattctctacatatcatctctacagagagggccccgtgggcttttatagtgtggcaccatgtggctatattctctctatcacccgagagaaaatatatatcaccgccaaaatatatcccccctctcgtgtgtcgaggtatacagcgatgtgcctctcacagttttttgaccccaccccaacgactctcttatatgtctctctatagaacccttatttgtgtgtgcacccacggtgtgtgtgtctctttgtgtataaaaaaccgcccaaagatgcccccgcgtgggaagacactccaaagtgttgaaccggtgtcccataagatattaaccccggtgttgtttccagcccctgtggggtcataaccacctactaataatctcccccgatgttgtggtccccccagccctttatctctccacgaagagaagggggtgttgtgcggccgagtgggggcatgatataaaaccccccaacaagagggggtgctcctctgaaaaggggggccccgataaaaattcccccgagagattattcaccccacatttcttatataaggaaacaccccaagagttgttcccccgtgtaggaggcgcaccttctaaaaatcctcccaacaacaaggtggaggacatggccgtctttatagtgtcgcaaaaaagcccggaatgagtattatggtgtccctccaacacaattgtggggggggcgcccccgcatgtaaccactgggaagagagggggatttactgcccccatttatagacgacaaacagccaccgtgtatatattctccccagaaaaacccccttccatttaattggattgcttttgagggaggctctcctcacacatcttaaaaagcgatgcttcaccaacgaacacatcaatcctcgccggagtgggtggtggagcacaaccctccgcgtcagccgcacctgacgtcgaaaccccctttatgtgtacttctagcggaagaacaggagacagtcccctccgcgcatatacaaaacgtctctgttatctaacacaacgggagtagtttatctacccaccggatgatgtcccacactagaaaacgaacgactttcgttttccagcccaactatctcttccatgataaca

SEQ ID NO: 590935 - DNA, 1060 bp, Homo sapiens
acgaccacgtggtcgcgccctctcgctctcttaagcgtacgtaacagctgggctctaacgtatcataccgatgcgccctggtcggtgacctacagcatgttatacccatgacctattgtgcagccacgtgccccagtttagaatcaatggcatcacagcaggtgtgactcctccgctgtcttacataaatgatacaagatctaggccggtgtactattcgtgggactcttactgtgtacatgcgccgagagtgacttcgcggcatggccatgaacggccgggacgccatgcaactaggagacgccttggcaaggtgctgtaggggtatgagatttgccgtccgatgagtaagttgccgagtgggctctcagatacttgaagcaaggctcatggaggcgattcccatctaattgatatgtaatctcggtgccttctgccaatggtatcccgcgagatccccttttcgcgctattggccccccatagagtctagcgcctgtttggtaaaatactgacgacggttttctcacctgtttacccttcgaataagccggtgtacgaagacgcaactcccgagggcatcacgccgtgtaacacctggacgcaaactgggaccactggtctgagccacgacccaagtaaaccctttgagatacgtgccattgaagtttatggaagtactaccccttcaatggggggaccgcgcacttggtggcacccccctttgtgtcttcgtcggccttccacccgggcgttgctcccagtgtcccccaagggcttcaataattacgctgctcgcggggtgctaccccgagggagggccctacttgtggagcgcacatcggcgggcgtccccactcatcccgcctctggctggtgtggctgcagtccctgagttggcccgtgacctacctgtccggcctattgccctgtcccagccgtggcttccgcaatgggcccctgggcacgacactcgcctccggcgctcattctgagtggccctaacgcttgtttcgccttcttcttgcacccttgggcggtcccccgttttttcttcgcgc

SEQ ID NO: 590936 - DNA, 151 bp, Homo sapiens
acagtcattccagtgataacaatctgtcataaagaccctacagaagcagactcccctgtggagccttgaaagaagcaagcaccacagaattctccacagctgcaaggaaaatgaattcaggccaggcgtggtggctcacgcctgtaatccc

SEQ ID NO: 590937 - DNA, 183 bp, Homo sapiens
tactttcacagggaaggaagtttgaagtgtagatagaaaccgtacctggattactccggtctgaactccagagtcacgtagtgagtttatctcggttgatcaatggaacctttaatagcggctgcaccatcgggatgtcctgatccaacatcgaggtcgtaaaccctattgttgatatggact

SEQ ID NO: 590938 - DNA, 334 bp, Homo sapiens
  misc_feature (299)..(299): n is a, c, g, or t
  misc_feature (307)..(307): n is a, c, g, or t
ggaacaggttggtgacggtcagttatagaagtaaagctgtagatggagatgtggtgttgaagtctagagggatgaggtgtgggaaggtgagagacaagaagaagcggataaccctgaagattgatcatcgagactgggaagatcgaggtggagaagcctttgcatcggcaaggagtagggacagtgacatctttctttgagtgacggtctgtgcattgcctgtagtccggcacagggctctgagctgcactggcccgggtgctggcatcttggtggagcggacccactcccctcacatnccacaggnccatggactcacttttgtaacaaactc

SEQ ID NO: 590939 - DNA, 1164 bp, Homo sapiens
tggggatggcgtgctgtcttctgcgcgtcgcttgtcgcgggcggggggccctcggggcctttcctggtgagtggccctggcgttgtgtatatggtaccttgctgtcgctgtccggatgtgtcgaccgcggcgtggtgggccccctgtgtgacgtttgtgtgcaccgtgggcatgtctgtgcgggtctgctagggcggttctgtgcatgcgggcaacatgtgtgttcagttgcatggggcgattttatgccgcgtaggtggtttggttggtgatgtgttctaccggtggtccgccgtactggggtcttgcatgttaggactgcggggccttatttctcccggtgggcgctagtggcgtctgttgtgatgcctgtggtcgcgctgagagatgtgtgtgacttcgatgtggataggggtatagctcgcgcattgcttccctaactcgtgcagcagggtgtcagcggagttgacattgtatgtgtatgttatgattgctaggtcgggcgcgtaacgagatggggtacgtaacgcaataatgcgtcgaatgttgtagaagtagctggaaactaggtatggtaagttgcgaagagtatgttcacagattcaatgatatgtcctccctggaagagcgtggactctagattccgcctcccctgtgtagtgtagtactaggcttagtgactgcttcgatagtatcagagacagacagtgacagtattgacttcagaggctaggtcatgaataggtcactgcatcttcctttgccgggtctctttttcattcattttcggggcttggagcctggggaacgcctgcttccgtgttttcaggacactcaagcagcctatggagagatccagtgtgtccaggaactgttgtgtagcctcctgaccggcatgccacggagtgagtcacgtgtggaagtagatccttcaacctcggtcaagcctttggctgactacaacagtcatgagtagacccagtaggtaggacctacctgagcttagccactcctggatatcctgactcagaaactagtgtaagatgacaagtacttgcgtgtaagccactaagctttgcgggttatttgttacacaagctataaataactaatatatagggtaaaaggaaaaacagtaaatgaatgatacgtcctgtacgtatt

SEQ ID NO: 590940 - DNA, 369 bp, Homo sapiens
  misc_feature (112)..(112): n is a, c, g, or t
  misc_feature (141)..(141): n is a, c, g, or t
agttttttttggtggttttggctttcggaaaaattccccaaaaaactaggaggctgggggtaacggaaaaaactaaaaaaagagacattggttgattccctttaactggtgnagtaccatcccataaagggtcaccctggntgagcagaaaaagaaaaaaaccccaataatcaaatctgtataatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaaaa

SEQ ID NO: 590941 - DNA, 507 bp, Homo sapiens
gacgacagggcgactcctccctgatagccgacagtggtcagatctcgtaacttcaccgagtcagccggatgactggtcaaggtctctggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggtgatctcgaagcagaacttcgcctatcactcgcagaagatcaagatccagaacatctccggtcacccgaaggagatctcgatctcgcacatctccagtaactcgaggaaggtcccgctctcgaacctcaccagtgacacgccgccgctctaggtcccggacacctccagctattcggcgccgctctagatctcgaacgccactgttaccacgcaaacgttctc

SEQ ID NO: 590942 - DNA, 354 bp, Homo sapiens
aaataaaggggggggaagtttttaagggcttgttttgccctcccgtcacccctgtttttggcccccggaatccccaacatgcactggtgttgtgtttttaacatgtcaatttgtccgttcacatgtttggtacatggtgtttttggccttggctgacatgaaacttttgtttggggttcgcttttcaactaatggttttgtgatcaaattgtgccgtactttgtgccttttgggttttaaaagtttttttttttgccttttttcaaattttcccctgtttgggtggaaattaagactttttgtagtttttatatgttgtaatattttttcaaataaatttttccttttacccca

SEQ ID NO: 590943 - DNA, 302 bp, Homo sapiens
ggggcccggctcgtagaggtgcctcccgatcgttgccgctttctactcgcaccgtgcgctgatctagctgaggacaccaacggccgcaactcccaggggataccaatccggatcggggacggcggcggcaccactggagggagggcgctgaagctctcgccggaagcagaagcagtaacgggagctgcgcagatgccaagtgacaagaccattgggggaggagatgattacttcaaaatcttcttcagtgagaagggggatggatagcatgtgccttgtggagtgtttgtagaattggaacc

SEQ ID NO: 590944 - DNA, 400 bp, Homo sapiens
gccctgtgcccatctcgcatgctgcggtgccgcagccccttgcgtctctcccagccccacaagccaggactcaaagctctcccagtgctgcaagacacccagcattgctctaaatctgcacctggtgggctggcaagggacgttctggggacagattgaccagcctttcctcctttccccaaagcctcaccagcatctggctggcccagctgctttcaccggaaggtacccactatccccttgcacttggatttcctctggaccttgctctgaaaatccagttcacccaggccccgcttttgcgtgatcaacccctctcatctatcaagtctggccttccaggcctacaaagcaccccttccagaaagcttcccccagtaaccaaaaacctggggatcct

SEQ ID NO: 590945 - DNA, 229 bp, Homo sapiens
aggctgggtcttttcttttttctctttttctttctctttccccttttctttggtcatattctttaacagctttgtgctgttagagccactatttccattggttggattccctttaggtgtggtactagaagctttattaacaggtttcacaccaaactgagattctctcccttgatttatcagtctcctccagtactggtttcatccgatggaaggttgctaggggggg

SEQ ID NO: 590946 - DNA, 412 bp, Homo sapiens
agctcctcctcagaaacatcttccaggcaaaaaaaagaaaaagaaaaaatcatttgctcacctatcgacaatagaaaatccagggatcttttgcattgtataaaatttggctcagagaagaaaaatgatgtattgaaaagaagatgaagcttcagttgccatttgagtggtggaaaataaatttgctttcggcccttaaaatggaaataagtcgatagaaaaatgcaggcctgcccccttttgagtcagcagtttttttggttgatgaaagggtgagaagacgtgctcactggaagtcacccgctggatcacttaggaagccgcagaagtgccgaaggacatgcatgtgtatctttcaaagttctcaactgatttattaaaaaaaatcataaagcagacttttgaaaaacct

SEQ ID NO: 590947 - DNA, 208 bp, Homo sapiens
  misc_feature (90)..(90): n is a, c, g, or t
  misc_feature (174)..(174): n is a, c, g, or t
gtcttcttgcctgccctgtgtcgtaaaaggggacgtccaacaaagagaccacctgtccttcgagcaggagttaacaccgtcaccaccttngggaggaacaagaaagctcagctggtggtgattgcacacgacgtggaagctatcagggccattacattgacagatacgatgagnccgccgtcactggggtggcatgtcctgggtccaa

SEQ ID NO: 590948 - DNA, 440 bp, Homo sapiens
tctacggttcgcatgttcctatcacatgtcccggctgatccccgggacctctgtttaggccactcacttagcaagagggactcagcagatgggatggggtgaaggaccctgagctcagaggtgatcctgggtgatctggggggcccagtgtcaccacagtgtccttatgagaggaggcctggctgagtgtggtggctgatgcctgtaatcccagcactttgggaggccaaggcgggcagatcacttgaggccagtagttctagaccagcctgaccactatgatgaaaccccatctctactagaagtgcaaaaattagccaggcgtggtggtgtgcacctgtaatcccagctacctgggaggctgaggcacgagaattgcttaaacccgggaggtagaggttgcagtaagccgagatcgcaccaccgcactccagcctggg

SEQ ID NO: 590949 - DNA, 480 bp, Homo sapiens
tctcaacacgtgaaaggaacctgagtatgtgggtgaggccttgctgactttgagcttcaccctacggtgatctgggataggccatgtacggagaagcatctgattcaggatttaagttatttcttttgggatgggtcatgttccccagagcagtcttctgatctcttttttgggaagatggaagtcctgggagctgagtgaggttgagggggtgggggtgggggtgggctctcagtatttagcattcatgaaagttatagtcatttcatgcccctgttacgggtaaactatctaggtcctcacctgtgcggggccagcccccatcacatcctctagtctactctcttcagataatagacttccaagggcgggtatggtaactcacacctggaatcccagcacatggggagtgcaaggggggcagatcacctgaggtcaggagttcgagaacagactgtccaacatggtgagaacccgttt

SEQ ID NO: 590950 - DNA, 303 bp, Homo sapiens
  misc_feature (95)..(95): n is a, c, g, or t
  misc_feature (134)..(134): n is a, c, g, or t
  misc_feature (206)..(206): n is a, c, g, or t
  misc_feature (290)..(290): n is a, c, g, or t
ggaggcagcagacacgcccttttagtagggacttaatgggccggtcggggagggggaggcgggatgggacccccaccctttttccattttttcanagggaaactcagatgtcccaactaattttaaccaacgcnttaaaaggtttatttggggacatggcccccagtggcttttgccccaaaaaggggaaaggaacccgcgggtanattatttttagcaggcaggaagtcctgtgcggggtccccatgagcccctccagctgtactagggcccttggaataataaatttnataaggtgccgga

SEQ ID NO: 590951 - DNA, 219 bp, Homo sapiens
tggtaccggactgagatgtctgagatagggcaggagctgagagtgcattgggactaaattttttttttttcaaggtggagtcttgctcttgtcgcccaggctggagtgcagcagtgggatctcagctcactgcaacctccgcctccgtgagttccacgcaattctcccacgctcatcctccgtgagtagccggggattacacggcgcgtaccacacacg

SEQ ID NO: 590952 - DNA, 119 bp, Homo sapiens
gaaatactggtcgtctgtgtgtacatggtcatagtaatcccccataaatgcaaacatcctgcagcagtggactcaggcattagcccatgaggcacatgccactgtattaagtgatgtta

SEQ ID NO: 590953 - DNA, 134 bp, Homo sapiens
agacgactctagcaggatcccctcattaaggcaatcccaccatgagtattttcactttgggctctttctgggctaacgggaacagcacagaagacatcaaatacactttacctttctagggctgccagtgttaa

SEQ ID NO: 590954 - DNA, 286 bp, Homo sapiens
cttggccctctttttaatggtcccaaaggaaagggggtttcacataataaagctttttggttacccccttaaggaaacctccccccgagataagggttttttaacctaataggtacattccctaggcaagttcaatgaaatgaaccctttaagtgggaatgtaaaccagtcctttgcaatagatggcaagaataagctggggccaaggtcacaaaatggcaacatggggatggttttgctccccaaatgttttattttgctggcctagccttcataataggacctg

SEQ ID NO: 590955 - DNA, 566 bp, Homo sapiens
ctatacgcataagggtgggtgcggtggctcacacctgttactctcagcactttgggatggccgaggcagtcgatcaccttaggtcatgtagttcgacgacgagcctggccaatcatgtgagaaaccacgtatctaccaaaaatacaaaaattagccaggcattgttgttggctgggtgtaatctcagctacttgggagcctgagccagaagaattgcttgaacctaggaggcagaggttgcagtgagctgagatcacaccactgtactccaacttaggcaacaagagcgaaacgctgtctcaaaaacaaaaaagataatttccataaacatttttataacttttttttgttaattaaagagtgggttaatgctccaagaaagccttgttaatctgacgtaggccaaaattgcaccactgtactccagcctgggtaacagagcgagactctgtctcaaataaaaacaaaaagaaaacaaaacactttttataattgacaaacttgccaaaatcaaattctttcttcagtcctcattaattttggtgtgtgtgtgtctgatggagtct

SEQ ID NO: 590956 - DNA, 636 bp, Homo sapiens
gatccgtagctggtcgcagtcccgaaggatgatatgaagatattcaaatgatgggaccagcatccaaaaggaggcgaatgggctcaggagatagttctaagaattgtgaaattcaagtcaagatcttggttttagttactaatcaagagaaaaattggttaaattacaatgggccacttgatgaaaaagggaaaataatatattgtttaagaaaaaggtcaaggaaattttgggggtgaacctccctttaaaaggaaaatttccaaattaagaaggggagaaaatttggttttaaaagggaaaaactctaaccttgaagaagaaggcttaaaattgttaatttattgggaaaaatcaaggttggaatcctaagggttttaaaaggaattggggccagtgattgaaagtgaatttgattttaatggataaaaaggaaattatccaaggcccaaacaattgcctgaagtaattctggttattccttacaaggaaaaaacgaaacgtcaacggaacttcacaggacccaattataacagaggtattcccccaaatggcaacaaacaggaataactcaggaaaagttgaaagccaggtaaaggtgcctgaggtatattacagaaaggctgcccaaaaaag

SEQ ID NO: 590957 - DNA, 176 bp, Homo sapiens
cttgcttgtacgggttatggggtatggcccgtccgctctcatagtccgcgatcaccgtggggcttctcattgattttgcgtggccaggtccttctgcgtaagcccctggctctgccgaccttgctggatcaccttgcccgcctccagggtcaccctgtcatggtgcagctcctcgg

SEQ ID NO: 590958 - DNA, 366 bp, Homo sapiens
ttcgagaggtctagaaaaaaaaaaggttgtggcgtaggggcagatatactctgacctaaaccttagcaagagcatagctagtattctagatatagattcatgacgtgcatctatctaaagtagcttgtctcatctgttttctcataagacttaaatttacttacataaatcggtgaatatatattggtaatatgaatctctacacccttcttgtagatactataaacttaatataaactatccacataaattgctcagtaccattgctatcattagttaattaccattgccctttaatctgttcagccaaaattgattagaaggggaaatggcttcttggtattgcttagattattttttcttatt

SEQ ID NO: 590959 - DNA, 210 bp, Homo sapiens
agcatgcaggcacgggcggggcattaagaatggcgtagtagaatacggaaaaattgagagcaagatctaagcgaataggatgcgtgggtggaagttctgtcatggcaatatcactagcagctttataagccacataggcggtactccgcagcctccttcctgtcgttatcctgtgggaaattctgacagatacctgtgttacgtctaggt

SEQ ID NO: 590960 - DNA, 243 bp, Homo sapiens
gcagcgcaaaggatggctcccaagaggatgcaaaggcgtcccgggggcttgggctgcaggctgaaggggcagggccggtctggttatgcctggcgggctgcccagagcaggtttcccctttcccacagacgtccccggggtgtaccgggagggtggcaagactacctccttcctccctgccctgcatggcagccctgtgaattcacccactcaccaaagctcatggagttccaaaaaaaaaaa

SEQ ID NO: 590961 - DNA, 309 bp, Homo sapiens
gacacacctttgcgcgctgtcaccacactgcatacacagagcacatgggtgcccagagaaccgtcgcccgagcccactccattcagatcatgaaggtgcgaggagatcgcggacaccatgtgccgccggccggctgtcaagcagttccacgacatccgcagatcaagttcccgcgtgccccaccgggtcctgcgccgtcagcacaagccatgcttcaccaccaagaggcccaacacccttcttcctaggctgcacggccctcgtccgggtgtgccccaaataaactcaggaatgcccctggtcatgcta

SEQ ID NO: 590962 - DNA, 266 bp, Homo sapiens
tattgaagaaatttctttaacaatggtgaaaacgaaatataccacaacctgtagatacagtgaacagcagtaccaagagagaagtttatagcgcctgcatcaaaaaagaagaaaaacttccaataacctaatggtgcatcctaaagaaccagaaaagcaagagtaaacaaacccaaaattagtagaagaaaagaaataataaaataataaataaaataaaaatcagagcagaaatcagtaaatcaaactgatctataggagtggtg

SEQ ID NO: 590963 - DNA, 390 bp, Homo sapiens
tgaaggtctgactctagatgattccccatacgtgaaaagcgactctgccagatgcatgagtctaaatctacggtgagagcaatgtctccgtgaatttacatggatcttgtgaagattaaaagggattttgtaacggtttcctgattaaagaaggtttgactaggagtatatgtttttcctggctctcatgttacctccactatagcttagtccctatgtgggagcatcacaggctggacggtgaagtcgtgaccttttactgcctttgtggctgttctttatctctggccctgctcccagttcctagaggcagtggtgtccttgacaacattagttacgagcctcagacttcataactgggctcagtggcactgctggtatcatgagtct

SEQ ID NO: 590964 - DNA, 170 bp, Homo sapiens
gaggtaattcgtgcccttttcgtcacaggcactaaggacgtgggcgaagttctccttcatcatcgtacagcaggcttggtttgtcattcttgtcatcacgtctggtgtatttgtgaaacatgtcgatcatgcctattatggacctctcagcttgagtgttgctcatcttt

SEQ ID NO: 590965 - DNA, 471 bp, Homo sapiens
ccttgggaggcaggacactggggcaagtgctttggggctccagccctatggcagcatctaggggtgggtgtctgtaactttcaaagcccaagtgtgcatgtgtacagtgcactcttttagccttgccatccatagatggcttaagggtaaaccagctcagtgaaccctctgcctttttgcaaaaggagggggctagtgtgacaactttctgtatcccaagccctcatccagcatcccagaagaatcaggtcacacatggacttgaaggatgaatgcaggggtttaatggagtggtggaagtggctctcagtgggatggttggggagctagacaggggatggagtagaaatatgatcttgccctggagtttgcctgtccagtggctgattctccgaacatcctaagccaaactcctcctgacgttccttctcttctctcctctgctgcaccattctgccatcggttggtctc

SEQ ID NO: 590966 - DNA, 1264 bp, Homo sapiens
  misc_feature (1213)..(1213): n is a, c, g, or t
atgcaacgttccacgggaataatgatcggagctgtactggcgtgtgtcggacacgattgtgtatggtgtgtgcatttcagcgtactaagactttcataatgtgctgaaaaatcgtgctacttgttggatgatatggataacgaatacctgctataaagtgatgaaataagtggtatccagccagtccatgcggacgcgctattcatctatcagaacagcctagtactcttggtgagctgacgtcacagagtgcctatcttggtgcaccgccgaaattgctttagcgatagttagctggtttgacttagctatggagatccgcccacggagggacaaggaggagcatgacgatcgctgccctcgacaaagcctcgggtgcttccagtgatgagtgcttgactctgttcccttccacgatttctagtacatacctgtcaagactcggtgtctcgatatacatgatccgtggacatacgctgagtccccatacagtgtcgcatggtgttatcgcgacatttccaatgtctggtaacaagtttgacttagtaaacgggctcattgtcgtggaaccttcttgggtccaacacgacttatgagcttagagaaatcctgacgacaccactacttcaggccccggcgccgctaagtaagtttagccgacacaaggttcgtgggaaatagccttgatgactaacctcggagttaattgccgcctcagaacttttcccaggaattactgccccgtaggttacaacccctcttagaattgggtggcattggccaaggcataaaaaacaagtccggagtgggacacttatccaagatatcccctcgaattttccgcacggtctataggccacgaagttggccgtacattaggaagcaccatttatactcgattgacgagcgggtaaaatttgggtttgggtgcgcttcaaaacgatcacacacacgagtattggtctttgcgagcacctaaagcaatgatttgggctaattgattcggacggtagggtttggatacaggtgggttgcgcagcacgcaggggggttatggataaagctggtggcgctccctttgagtcagtgtcatcaccatattatggagtgctcttcgccaattgaaaaaatcgcgtttcggggttgtaaaaaacagattgtgtagaccccgaaataccgatagggagcgtataagagatagcgaccacaaatnttttgatgggacagaagagatgtaatcacagcctacggccgagctaaaacg

SEQ ID NO: 590967 - DNA, 120 bp, Homo sapiens
gcactccagactatatagtacaggtagaaaagtctaattattcagctgaggaacattgtaggtatggggtctggggagaagcagtaagtttttggggcaaatcaggagtgcccttgtcgt

SEQ ID NO: 590968 - DNA, 456 bp, Homo sapiens
  misc_feature (16)..(16): n is a, c, g, or t
  misc_feature (62)..(62): n is a, c, g, or t
  misc_feature (98)..(98): n is a, c, g, or t
  misc_feature (107)..(107): n is a, c, g, or t
  misc_feature (114)..(114): n is a, c, g, or t
ttttttgaggtgtatngagggaggaggtatatggaatttttttaattttttgggttatattntttttttttgagttgttttttatggttgggtttatnttggttttnttttttntggttttagattttgggggaaaggaaggaagtgtatgtttgggaattggtattattggaattaatggttttaatttttttaattattagtattttttttttttttaaggtgaagtggagggtgttgtggtgagttggttattttagagttgtagtgttattggaggagttagattattatgatattgtagggaaggaggggagatttttttgtagtttttaattggggtgtgggaggggtggggaggttttttataaattgtattattttttgttgagggtggagtgttttatttttttaattaaggtgattgtgattttgattaataaaaaagaatttgta

SEQ ID NO: 590969 - DNA, 476 bp, Homo sapiens
tgcagtttgatctcagactgctgtgctagcaatcagcgagactccgtgggcgtaggaccctccgagccagagatgggatcttactacattgcccaggctgaagtgcagtggctattaacagctgtaatcataatgcattgcagctttgaattcctgggcttgagcgacctccccaccttagcctcctgagtagctgagactacaggcattctaatatatgcattcttcataacaactgtgtgaaacatattaatatcctcattgttaacgatgaagaaactaaatctcaggaagaaaaactaagtgaagacaaaagaaggatttgaactgaggtttgtcagactctcgggaccatgctgttgaaaccactaaaccacgctgcctctgggtcacttggtaaacagcatttaaccattaagaaagtcattaataaagttccttgtgctctccttgagattacaagccattgatttgct

SEQ ID NO: 590970 - DNA, 818 bp, Homo sapiens
  misc_feature (53)..(53): n is a, c, g, or t
  misc_feature (292)..(292): n is a, c, g, or t
  misc_feature (354)..(354): n is a, c, g, or t
atagccgtgcgaggccatggtgccaatatgctccactgttgctcgtttattgngcctgaaactgtctgggtctgagctggggagcggaagccacttgtccctctccctccccaggacttctgtgactcctgtggccacagagtgtccaaccagtgctaagggcctggtgtgataccccctgcctggcccccttgcccaaactggcagggtgggccagggctggtgcatgcagcccctctttcacctcaactatggatctcctgccccccaagcccaagtacaatccactacnggaatgagtctctgtcatcgctggaggaaggggcttctgggtccacccccccggaggagctngccttcccaaatcagctatcatccctgggagcccatcactgcctcctcatgacatgggagacagatatgtacacacacataccactgtagcatccatatctatcccacacgagatagaagcacacctagaaggcatggacaaaacctggctaggggtggcagcccagggatctaagggggagcacaggaagggcagctgatgatggggaggggatcgtaggggcagacatgccagaatcaggccccctacccctcctccaggacatgaacaagcagagtggaggcggcgggcgcaggactcgggtggagggggccagctgggggcgaggagtggaccgacaagggagctagtacagtaaaccacgcggggaaggtgatccaacgacaagtcatggacccgggatacacagggcagactgcgagtacagccggagagcaacagcacagggcccaccggcagagca

SEQ ID NO: 590971 - DNA, 192 bp, Homo sapiens
aagtgatcctcttccctaagcttcctgagtagcgggacccaccacccgtgcaccaccatgccctgctaattttttgtagatacgagattttgctgtgttacccaggctggtctcgaactcctgagctcaagcaatcctccctcctcagcctcccaaagtgctgggattacaggtgtgagccaccgcccttgg

SEQ ID NO: 590972 - DNA, 446 bp, Homo sapiens
tgcagtttgatctcagactgctgtgctagcaatcagcgagactccgtgggcgtaggaccctccgagccagagatgggatcttactacattgcccaggctgaagtgcagtggctattaacagctgtaatcataatgcattgcagctttgaattcctgggcttgagcgacctccccaccttagcctcctgagtagctgagactacaggcattctaatatatgcattcttcataacaactgtgtgaaacatattaatatcctcattgttaacgatgaagaaactaaatctcaggaagaaaaactaagtgaagacaaaagaaggatttgaactgaggtttgtcagactctcgggaccatgctgttgaaaccactaaaccacgctgcctctgggtcacttggtaaacagcatttaaccattaagaaagtcattaataaagttccttgtgct

SEQ ID NO: 590973 - DNA, 588 bp, Homo sapiens
tgcagtttgatctcagactgctgtgctagcaatcagcgagactccgtgggcgtaggaccctccgagccagagatgggatcttactacattgcccaggctgaagtgcagtggctattaacagctgtaatcataatgcattgcagctttgaattcctgggcttgagcgacctccccaccttagcctcctgagtagctgagactacaggcattgtcctaggtactgtggggaccaaaacattcagacctgcttctaaggagtgcagtccatggaagagtcagaataacaaatcaacatttgtactacaccagaccagctctcttctaaggttgctatgacttcccagcaggcattctaatatatgcattcttcataacaactgtgtgaaacatattaatatcctcattgttaacgatgaagaaactaaatctcaggaagaaaaactaagtgaagacaaaagaaggatttgaactgaggtttgtcagactctcgggaccatgctgttgaaaccactaaaccacgctgcctctgggtcacttggtaaacagcatttaaccattaagaaagtcattaataaagttccttgtgct

SEQ ID NO: 590974 - DNA, 314 bp, Homo sapiens
cagccagataactcctataacacaacatacagtgcagtgtaaatgaacctaaacagatttaccagtacctgtacattactaaacagatgtaaatgaaaagatacactatgcattgaacttaatgctacttattagtatatatatgttttaagtttctctagtagatgtgagtttaactatcgcaggaataggatcctcatctactcttgttgaccgtcttcgtggcaagtggctttaagttctagcatattcagtaagagaaattagagctggaatgaaggacatcacagcctgcatacttggtacaatgtctc

SEQ ID NO: 590975 - DNA, 659 bp, Homo sapiens
tgcagtttgatctcagactgctgtgctagcaatcagcgagactccgtgggcgtaggaccctccgagccagagatgggatcttactacattgcccaggctgaagtgcagtggctattaacagctgtaatcataatgcattgcagctttgaattcctgggcttgagcgacctccccaccttagcctcctgagtagctgagactacaggcattgccttgcttctccttcattttctgccatgactgtaagttccctgaggccttcccatccatgtggaactgcattctaatatatgcattcttcataacaactgtgtgaaacatattaatatcctcattgttaacgatgaagaaactaaatctcaggaagaaaaactaagtgaagacaaaagaaggatttgaactgaggtttgtcagactctcgggaccatgctgttgaaaccactaaaccacgctgcctctgggtcacttgattattctgggagattctgggagtcttttctcccacactccagtggcatctgactatgtgagctgataagatctatagatctttgctgaacctgattctggaaggtaccaccatttcggccatcttcctaatccatactgtgagatgggacccaattgattgtgtggtacatgaagcaccacccggaaaa

SEQ ID NO: 590976 - DNA, 174 bp, Homo sapiens
agagtatccccctgggtcctgtgcagggggggccgtcctgagggtacagaagtagagggatgttgtccagtaaggggccgccagctcagtcattgtcagctctgggatcttattggactccagctgcttctggtgatacagctctgctacgtgcttctggagagagtcgcatag

SEQ ID NO: 590977 - DNA, 281 bp, Homo sapiens
tgtatatacaatcgagctcggtaccgactgcaatctgtgcctcttgggttcaatgtgatctcgcgtcagcctcccgaagtagctcgacgattcaggtggatgccaacaagcccggataaattttttggaacttttagtagatatggggtttcagccatgttagctaggctggtctcgaactcctgagctcaggggatctgcctgccttgagctcccaaagtgctgggattacaggtgtcagccaacatcgcccggccattatctagtgttttaacccttgg

SEQ ID NO: 590978 - DNA, 618 bp, Homo sapiens
tgcagtttgatctcagactgctgtgctagcaatcagcgagactccgtgggcgtaggaccctccgagccagagatgggatcttactacattgcccaggctgaagtgcagtggctattaacagctgtaatcataatgcattgcagctttgaattcctgggcttgagcgacctccccaccttagcctcctgagtagctgagactacaggcattgtcctaggtactgtggggaccaaaacattcagacctgcttctaaggagtgcagtccatggaagagtcagaataacaaatcaacatttgtactacaccagaccagctctcttctaaggttgctatgacttcccagcaggcattctaatatatgcattcttcataacaactgtgtgaaacatattaatatcctcattgttaacgatgaagaaactaaatctcaggaagaaaaactaagtgaagacaaaagaaggatttgaactgaggtttgtcagactctcgggaccatgctgttgaaaccactaaaccacgctgcctctgggtcacttggtaaacagcatttaaccattaagaaagtcattaataaagttccttgtgctctccttgagattacaagccattgatttgct

SEQ ID NO: 590979 - DNA, 549 bp, Homo sapiens
tgcagtttgatctcagactgctgtgctagcaatcagcgagactccgtgggcgtaggaccctccgagccagagatgggatcttactacattgcccaggctgaagtgcagtggctattaacagctgtaatcataatgcattgcagctttgaattcctgggcttgagcgacctccccaccttagcctcctgagtagctgagactacaggcattgccttgcttctccttcattttctgccatgactgtaagttccctgaggccttcccatccatgtggaactgcattctaatatatgcattcttcataacaactgtgtgaaacatattaatatcctcattgttaacgatgaagaaactaaatctcaggaagaaaaactaagtgaagacaaaagaaggatttgaactgaggtttgtcagactctcgggaccatgctgttgaaaccactaaaccacgctgcctctgggtcacttggtaaacagcatttaaccattaagaaagtcattaataaagttccttgtgctctccttgagattacaagccattgatttgct

SEQ ID NO: 590980 - DNA, 879 bp, Homo sapiens
attcagcatgctgtatttaaagaacttgtgaagcttgtagaccctgtgagttaaggcatggagcacccagtaagaggaaaacaaacatgtgattatgttggtgggattgccagggagtggtaaaacaacaacatgttgcaaagctagcatattattacgcagaggaaaggttggcagacctgttctcagtatgtgcagacacattcagagcaggggctttggaccaactaaaacagaatgctaccaaagcaagaattccatgtttatggaagctatacagaaatggactcctgtcatcatgcttctgaaggagtagagaaatttaagaaatgaaaatttgtgaaattattagtgtcgatacacagtggccgccacaaacaagaagactcttgttctgaagaacatgcttcaagttgctaatgctatacaactctgataacattgtttatgtgatggatgcctccattgggcaggcttgtgaagcccaggctacggcttttaacagataacagtagatgtagcctcagtaaatagtgacaaaaacttgattggccaatgccagaacagtgagggtggtgcactcaagtgcagacgaaggccacaaaaaagtgccgattattctccactgcctacaggcgggacccgtactatgaatgaagtcgaagcctttcaaaacaacaggcctttaattaagcaaacgtctggacgggcgcgcactgagaggccggcgagaaaacgccacgaggcgaacctgggcgcgcaaggacccccataaccaagtggaacaggccgcagcacgcgcccaacgggtggccgcccaccacacacgaaaggggcccacccaacaaagggagacccggtggggagaccaatcgcaca

SEQ ID NO: 590981 - DNA, 163 bp, Homo sapiens
atgcgcacaagcctggaatttttgtatttgaatagagacggggtttctccacattggtcaggctggtctcgaactcccggcctcacggtgatccgcctgccttgacctcccaaaatgctgggattacaggcatgagcaagccaggagacctgagcaagccagg

SEQ ID NO: 590982 - DNA, 323 bp, Homo sapiens
gcagagtggacatcgaggatctcacgtggggtggtgactgccacgctgattctgagtggaagccaagccctttcagtcatagctgttctgaggctcagacccaaatgctaccaccaccaagccctgtgtcacgacggcagcggctgcagtcaccagaaacaatccttcctgcctcgacacccgtgccaaccccagccaccctgacggtgggctgtccacggaaatgccacggccaagagcccaggtccttcacgctggcctcttccctgccgggctgggctccccagtgccttcagagttcgttgtgccgagctctggagatc

SEQ ID NO: 590983 - DNA, 179 bp, Homo sapiens
  misc_feature (102)..(102): n is a, c, g, or t
  misc_feature (114)..(114): n is a, c, g, or t
agaaagtgccacagtgttgacaggccacaggacatgctgtgagtgaataaagagtacacactgcttccctgctttccccagtgactgaatgctcgaggccanctcctcctcagnctcctcctcgaactcgccctcctcctcggctgtggcatcctggtactgctggtactcggacacca

SEQ ID NO: 590984 - DNA, 447 bp, Homo sapiens
gaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcctctccggaagaaatcagtatctatgcaaatcctgaaagacgaaatcaaagcccataatgattcagaacagtgctgactcctgtatctgatgtgactctgagcaggttggtctgctctttttagactggaagtgtagtgcttcataatactgctgtaagtcttctaagacaatattatctagcatgtttcagtatctctctatcatagtccctcatccgctatcatgggatcctctagatcacc

SEQ ID NO: 590985 - DNA, 191 bp, Homo sapiens
accaatgctcatctcacccatcgttcctgttccggggccgcatttattccctccgtttctttccacttggattgtctggtgagttttgctcttcccccttctgtcgctacgtttaataatataagcgtaaacatatttaataatataacaaatcataatatacacaaggcccaatcacttacagataagat

SEQ ID NO: 590986 - DNA, 207 bp, Homo sapiens
gaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagatctgtgcaataatactctgttcctgaatgctatttagaaatactatcctcaaaacaccagtggtt

SEQ ID NO: 590987 - DNA, 189 bp, Homo sapiens
taaagagacagggttttgccatgtgggctaggctggtcttgaactcctgacctaacgtaatccacctgcctggacccctaaagacttcccaaagttctgcgattccaggcctttggggttggacagccctctggggttggccaggcctctggggttggccagccctttggggttggtctgggtcaaatg

SEQ ID NO: 590988 - DNA, 415 bp, Homo sapiens
  misc_feature (28)..(28): n is a, c, g, or t
  misc_feature (50)..(50): n is a, c, g, or t
  misc_feature (58)..(58): n is a, c, g, or t
  misc_feature (87)..(87): n is a, c, g, or t
  misc_feature (144)..(144): n is a, c, g, or t
  misc_feature (168)..(168): n is a, c, g, or t
  misc_feature (340)..(340): n is a, c, g, or t
ccaccataatccccccagcactttgggnaggccaaaagggtggggtgggnatcgcttnaacccccgggcaacaacaaaaaaatcccntaaaaataaaaaaaaataggcagccgtgtggtggcctcatgccctgtaatcctcaanactctgggaggctaaggtgggaanatggcttgagcaggagggttgcttgaggtcaggagttcaagaccagcctgggcaacatagtgagacctcatctctgccgaaaaacaaaaaacaaaaacaattagctggatgtggtggctcagcacctgtagtcccagctactcaggaggctgaagttggaaactggttgagnccaggaggttgagacgtgattgtgccactgcagtccagcctaggtgacagagcaagaccctgtctcattttaaaa

SEQ ID NO: 590989 - DNA, 203 bp, Homo sapiens
ggtcagatcaactctgcccatagctttctagcccaaaaatccttagtgtgatgattagagacatgacacaaggacgaggagggctcaaagggacaagtcggtaaacctgtttattgtcccaaacttgggtcattcatttaggcaccttattattacatttgggtgggcaattgcctgttttaaaggccaaattttttgtttta

SEQ ID NO: 590990 - DNA, 259 bp, Homo sapiens
  misc_feature (24)..(24): n is a, c, g, or t
tttaactggtttttcccaaaattnccagggggatgcaatggagaaagcccagtcttttcagccaattgggcagggacagctggatatccctatgccaaagaagtggactttggctcttccccccaactataacttcaaataggccatggggggaaacatagaagcttaaactataaaattttagaaggacggataaaataaaatttatggggctttgggaaattaatggttttttccggccaggccccaaaaaatggta

SEQ ID NO: 590991 - DNA, 337 bp, Homo sapiens
aaatgtctgggggtaaaagccctgtgcttttcagtggtggctgcgtgaaaaggaacgaccctcaactgtgtgttcctgggcttgtgtgggacttagaacctcagttttattacgttatagtcagacctttttttgacagtatgagacagactgcaggatgaaaatatttgtcaaaattttaactgaatgtttactggaaggacttgagattcccttttaaagttggattgttaataatttcatggcagtgaactgaaatttgatgtttatgatatggggtttttttttttaaaccagcttcccagggctaaaaataaaaaaacccaaaaatgctgga

SEQ ID NO: 590992 - DNA, 1591 bp, Homo sapiens
ggggggagcgcggcggccaagctcgctcggcacgcgccccgcccccttcagaggcctggcctccctgcacgcaccgtgcagactgctgtgccctgtgggtcccgagtgctcctgtcgccttgcccgacccggggcccagccgccttccactggccctgctgctcgtacttggatgcgaaggacgctggcctcctgacagtgagcgcggaatggtgaccgtcgccggagcgtgccatcgggcacggattaagccctccgatttcagtgctacatcagtggcgcagagacttacaacgtcgtcgtccttgcatatctagacctgggtttcaggcagtgtaacgagcttcgcccttttagagaacacgcattcatctgtagcgcattgcatcgcatcggacacgtacggcatcatgcgtctgcgtccttatgcactgccggtgacccaccgggaaaggtaatcaagaagttgataccatcagtccaattcatttcgctttgccacaccgtggtcacagcgtcgagacaaacgtagccaagccagtggatcaatatatataaccccagcgcacaagcacttatattagggagcatcatttgcacgatagcgcatcgcgggcgatatacccctgggcgatatagatcgggcttttgtcgcccacgggtaattccaccagagattatataaaataatggcagaggaacccccatatactctacacgacagcttttccataggatagcaactacggcgcacgtttacaacgcagacaacaagccgtttcatctaacgcaaccgcaagtttataacccacactattcgcagaccttaaaacatcggtatcgacttccctatattttatgggagcacggccttctcccttattatggggagcaccgcggccttatacctatggcggcgccacagacgaacaacatttatatagcgcatgggagtagattaacgcaacagttacaaacgacaacaattatccttctcgttaagggacaggttccaatattaccccccattaaaactatccacttacttggccaaaatatacccttatatccagagttgtaaaacgacgcccgcttcctataagtttcattttatccagagcgcccaataatacgccctttgtgggcacaccaagtggtcgtcaacaacaccaagcggccgctatttataggggtccacttggcacatttgtgccccatgtggccactatcatatcaatatggcttctctcacacacacacccaacacgtttaagcgatatccctatttgggtgccacacacatttattcatctacacacttatattttgtggatcccccacggtcgtagtgtgtcaccccccttaattgtcactaagcgccgcatagtagctaggccccaccgactgtaaatcattcaacggtgggggcatagacaacaacgcaggttctattacaagacacataatatagtaggcctgctaccagagacgaggggaaccggcgtcgagctatctcacggaagcattatccactctaaacaggtatgcgtgacacaggctacttctcatcagtgacgacgcacaccatcta

SEQ ID NO: 590993 - DNA, 368 bp, Homo sapiens
cgttcgccgctgtaggccgaagcacctgcggagtgtgagggacacgtatacactggccatgggacaaggcggacaagaacctgactccatcagtttaacgatctcagccacgacttgggaacgtgtggattcagacatgtatattgagtgaatcattaggacacaaaataggctgaagaagatgttccagaaatccaggcagactattggccactaccattacacacagtggtgctgcccttctccactccaaactgagcacgaaaaaggcaaggggactgggccacagtgcattagggaggacagggtctctcggcttctctaccccaatatcaccagagggaaaggttaggttagaaaaacgatgc

SEQ ID NO: 590994 - DNA, 502 bp, Homo sapiens
tacttttccacagggtacttttccacagggtggtaggcacctgtaatcccagccactcaggaggcggaggttgtagtgagccgagattgcaccactgcactccagcctgggagacggagcaagactccatctcaaaaaaaaaaagaaaaagaaatacagatacttttggaaacaaattggggagaggggtgtgatccttgggcaggtagctaaagtcagcattagtccaccagaacgggagccttaaagtcctcttacttctcacttcaatcacttctggccttagacctcattattaccgggaacagttccttttctagggtctgggaaagaggatcttctttgaattccaggattttttatttcctagtgtctgtaaaataaacttttggtctaattaattcaaagtttcaattagggaaactgagaaacttttgcagaagtaaacagacggttgtacccaatggcttggtatccagactcagattcggtaataatcagg

SEQ ID NO: 590995 - DNA, 128 bp, Homo sapiens
ttgattctctgctcagcaggagatttccggccccaccaccacgccggtaattttgtattttcattagagacgggtttcgccatgtgcctgggttggttttgaactcctggcctcatgtgatctgctcg

SEQ ID NO: 590996 - DNA, 720 bp, Homo sapiens
gacatggtttttgcccaccaagatgtaccggatggcgatgacaccctcccattgcgtgctactcaaaacctgtcattcttggagagttgcgcagctcccttagctcaagtgctgctcagggcccttgaccagggcttaacctgggtatgagggagagttgctacaggcagcctcacccacagacgatcctctctgatgccctctttcatgctgtctaacctgggaactaatcccccagactttagattgccctgcatggttgtcaggcctgatgatgacctccgcgactgacttacctgagtccccagcttccagtgaagggcctgacctgcacacaggcgctcaaatatgagaatgagcgcagtgcctatagatgtgatcataatcacagctgagcgcgatgctcacgcctggacgtccagcactttaccaggccacggagaccagatgtcctgaggttagaagtgcaagaccagtctgtccaatatgaggagactatgactctactacaatgacagaagatagccaggtagaacgcctgtagtcccagctactggtagagcctgacacagctgtaggctgctacaggagatcctgccagcatacccacgattgcgccaatgcccttcaactgttgcctcacaaccctcacaccacctaggccgaccgcttggcccccgcctcgctcaattcgactctggtttagcacgttcttcggcc

SEQ ID NO: 590997 - DNA, 782 bp, Homo sapiens
  misc_feature (94)..(94): n is a, c, g, or t
gggccggggtgagaggcaggagaatcacttgaacctgggaggtggaggtgcggtgagctgagatcacaccactgtattccagcctgggtgactngagactctaactaaaaaaaaaaaaaaaaaaaaaattggtttggcgggggcctcaattaacaattggcttttggatgttggagtggcggtggttggaaattaatttttctttcggggtcttcaaaatttcaagaaaagtggatgatggctttgaagtaattccaaaattagggttttcgggcaggggggtccttataaataagtagggtatatggatggtcaaacagtaatacttccataatacgaatgtgacatggctctggggatagttgggacaaggggtaacttatacagggggaaatcctcgtggtgcattatttttccattctaaacctcagagatctggtttcctctagaaaaaaaggtccatctgtggggttaataaacaaagttttgcgtctgtccacaaaaaacgcagcaggagcagccaccaagaaaccacaacattttgggcgggcagcggcttgcgcactaagaagaaacgtttcctaaacaccatttggtgggggcgcgcgggggaccccagtcatggacatacacagtgggccatcacccgtgtgtccacgaggaaacctcggcccagcgcacggggtggggtctccccccatataaaaaacgccgggagacacggcggtcagagcccaccagagggggtcgggcgccacgggtcatacgggcgcgggggcaga

SEQ ID NO: 590998 - DNA, 589 bp, Homo sapiens
  misc_feature (532)..(532): n is a, c, g, or t
atcagaagttaattttggtatacagaacgcaagatgaataagaccatattgtggagttttctactattttttttctggaagtcaaacttcaagagcgactgaccaaaaaattgctgactttgcaatggatctttataaagctatttctttatcccacaagaacaacattatattttcccctcttggaaccactatgcttcttggaatggtccaactaggtgcaaaaggaaaagcacaacagcagatcctgaagactttaaggatgcggggaaccccagcaggagaggaattttctgtgttgaagtcacttttttcagccatctcaaagaagaagcaggaatttacatttaatcttgccagtgccctctaccttcaagaaggattcattgtgaaggaaacatatctccatagcaacaaggagttttttcagagtgctacaaaactggtggattttctggatgcaaagacttctgcacaggcaataagcacctgggtagaaagcaaaacagatggaaaaattaaaaatatgttntcagaggaagaatttggccccttgactcgtctggtcctggtgaatgccatttatttt

SEQ ID NO: 590999 - DNA, 147 bp, Homo sapiens
  misc_feature (25)..(25): n is a, c, g, or t
tgataagagaccatcctccatggantggttctggccagttttagaggctgtgcctttacagaggctgagcctttccagaggctgagtacctttatgtccctgcttcactttttgatgtgtagggcctaattataatacatttaaatg

SEQ ID NO: 591000 - DNA, 153 bp, Homo sapiens
agagacggaacagatgctttcattatggcctccagaggaaaccaaccctgtctccaccttgatattgcacttccaggctccagaactgtgaggcaataaatttctcttggttaaaaaaaaaaaagcaaaatttactcaatttccagaagaggg

SEQ ID NO: 591001 - DNA, 342 bp, Homo sapiens
ttggggctcagtcaggcgaagtcggtcattacatcccatttattggtggtaagggtcaaaagcttcaacggaagctgaaagaccatcttcagtgacacctccggcaatcacaatttggcctttagggacggctactccaaacagggaaggaggaatttgcatgggagccagatctttccaatctccttgggggggggtggaagataaccacccggtgggtacatggtgggtcatcggtctttcctcctagagaatatatcatccttttatgtgaaatcacatgagggccatagacttggagagggagttaaattacttcgttccatttggcagccacaggat

SEQ ID NO: 591002 - DNA, 1692 bp, Homo sapiens
ctctgctgtccgttgtgctgtttgatgggctgatgtgtgtctttggggtgcgatgttttgggttgcgtctcagtcagtcgatgcacagtacgcgacatatcaataacgcagaatagacattatcgaatgcgatcggattgagtccttcgcggctgatcaagtatcgctgagtcgagatgtcggcgtcgggctcaggtctgatgcagctgtgtggcgtcgatgcgcgagggagggtcgcgccgtgaacggtcagctacgcaatctgtggtgtgcttctgtcgtactctggatgctctgggttgaggcgagcacctgctctgctgctgtcgcctgcgtggcgtgctgggcatcgagtggtggtgggttgtacttttatagtgtttgaatttgttttgtgtgtttgtgtgtgtgtttgatgtatttgttagttgtgttggtttggtctatgttggttgtgttgttttttagtttttctattttattatgtatttagactgatgtgtgtgtggatcctttggattatgggtgacgtggtgtgtatggatttggtgtgttgtcgtatgttatgtatatattagtattttacagatatgtgtatttgttggtacatattgttttgtgttattcttctaatgaggtacttttgattgtggttgtgtatgagagttacgtcttgggtgtggttctcacgtgtttgttgtgtgtgttgtgtgtttttatggtttgtggttggtgttgggcttctttttgggtttgtgttcgttcattgtgttcttgcgttatgtcgtagtgtgtgatgtagtagtgattgtgtggattgattcaataatgtgtgcgttgtgttcgtagttacgttaagatttgtggcggaagtggcagttagatgtagcgatgtgtatcgtatggatgtgaaggtagtgtaaatgcattgtggtaagtgacagaaagaaggagttcaggttagaaggagcaagtatgtgagtagtcagtagttagaatgtagtaggtagtacgcacggtggaccctcctgctcgagccctgcctatgtagtcattgcttggtatggctctttaaatgcaaagcacaccagcgaattttgtccccagtgttcactgagaactctcgttatccttaagcggaagagtgtagtccaatagtcttggcgcaagtacacggactgctctcagcactcgcctgagatgcaacaccaggacgcctggtcaggaccaaagaaatgctgcacgcgaagccaatgtcgacaggttcactgagacggcccactgtcgagtgcttcctcgacgtgctccgacggccatatcgctgacacggaatcatgatttgtcactgagagacatttcgtaacatggtacccttaaccaattgaagcggtataccagtagtctacacagtgattaccgttcatcatagccccacggagagttgtgcctgccaccttacgcagtagccagtcgcagagagctggcaggcgctcggccataaaggtggtggagggtgatcgatcctgcgagactcacaagaggggaaactgacagagatacctacagacggagtgctgtgctacctggtgccgacaagaaagccgaggactggggctgggtcagcaaccgaattccagatttagaagccggaatttggtcagtgtaaccgtggtcaggccacctcgagtgaac

SEQ ID NO: 591003 - DNA, 176 bp, Homo sapiens
  misc_feature (30)..(30): n is a, c, g, or t
  misc_feature (80)..(80): n is a, c, g, or t
aggggaataattagaaataaataacagaanaatatcagaaaatccttgaataagccaggcacagttcgcacaccccctgngtcttagctacttggagggctaaggcaggagaattgcttgaggccaggagtttgaggccagcctgggcaaaataacaagactctgtctcctaaatt

SEQ ID NO: 591004 - DNA, 315 bp, Homo sapiens
  misc_feature (5)..(5): n is a, c, g, or t
aaggnaattcatgatttcatcaccacacatggagagatttgggaacctcagtgtaagagaaacattacaagtccttttcttacctctacaagtcacagtgttattaaaccagcagcaatcattcatcatcccacaatatgtctttcgttcggctcatcagttggcatcatgtccttttgttttcgctcacacttcatccttgtgcaagtccatacaacttcactcaatccttcagtccttccactcagcacagcaggcaattcaagcacaggtcaccaagcaacttgcaatcatttcacaagcaagtgtccatca

SEQ ID NO: 591005 - DNA, 564 bp, Homo sapiens
tgaggatgaacgtaatatgtacatagctgggtgtagaaggaatttgttctgcactttatgtagccaggaaatttcttctgtttccagggtcatccagctatgctctaaaagcatcatccagaaattgcaatgctctgaattgtggagaggcctgattttgaggttgtggattccattccactggctagctaagagacaggatagctgacctgagagggaatgaggctaaaaatcctatctaatggcttctcatcaaatagagtttaagaatgaggtcacctgacccaacagagagctctaatcacaagggcttgagtattttatcatggttttactctggtcctcattttgtcagaagaggatgatgaaacccaaagacatgaattgtagtaaatagagctaggaatagaacctggggatcaaagctgtgtctggcatcccagactggtcattcatattagtaaggatccttgtcctcagatcacgagtcccgtgataacctggttggatgccaaagcattaccatgctagtaatgcaactgaacaatttgggttctttttaag

SEQ ID NO: 591006 - DNA, 145 bp, Homo sapiens
gtaattctacccgccgtcagcctccctaagtgctgggatcacagatgtgattcactgcgcccttactaacacctactccattaaacctggcctctaataatacccgccagggatttctctatcagtacagacatgtagacatgca

SEQ ID NO: 591007 - DNA, 428 bp, Homo sapiens
  misc_feature (53)..(53): n is a, c, g, or t
  misc_feature (76)..(76): n is a, c, g, or t
  misc_feature (79)..(79): n is a, c, g, or t
  misc_feature (103)..(103): n is a, c, g, or t
ccagccctaggttttgtttgtcttttgttttgagacagagtttcactcttgtngcccaggctggagtgcaatggcngantctcggctcactgcaacctctgcntcctgggttcaagcaattctcctgcctcagcatcccgattagctgagattataggcacccaccaccacgctaggctgattttgtattttaagtaatgtgtcagtgtccaatgtctgtccacctctccgcctccaccagtctgatgtggaccttcagtatttcatgttaggctttataggcagtatcttataacattactgatttcttgccattgtaataaattgttaccatattttattatctttatttatttatttatttatttatttttgagatggaattgcgctctgtctcccagctgggagtacagtggtattttggagta

SEQ ID NO: 591008 - DNA, 225 bp, Homo sapiens
tttgcgtactccatgctagaggccgtggtgtgctgcaatctgtagtttgatactcccctgctggcaaggtgctatccagcgccgaccacagtatagcagatgttatccgacagtgcagatgagcaggggccatgtgtagtcttgattgctctcactgacatttctattgatgcagtgtagactttgaatcatactttgacctttcttgagccttatgcgagcgat

SEQ ID NO: 591009 - DNA, 423 bp, Homo sapiens
tgtattgtcagtgggtcagtggacctgcaaaaccatggggaggctagcaaacgaagtataccagttctgggatacgcagccgtccccaagctaggcgaagtggaaacacccatgccccgtggagcctgacaaggacaatatccgccaggagccctacaccctgacccagggcttcacctggaatgctttggacctgggcgatcgtggtgtgctaaaagaactgtacaccctcctgaagtgagaactatgtggaagatgatgacaacatgtcccgatttgattatcccccggagattactaatgtgggctctcacggccacccgattgtatcccccagtggcactgtggggtacaaagtggcctcaagtcgggaaatgggttgggtccataagcgccatccaagcaaacatccattatctatga

SEQ ID NO: 591010 - DNA, 220 bp, Homo sapiens
tgggcgccactccctacgccggtgaaacgagctcatggactgacccggggctgggctcgcagcaggagagaggagggcgaggagggtggcaggcagctcgcttaggcgcattcagactccaagcatcaggaaatcattttgtacaaccacccgaagcagagatattttttaagaagcgtaaattattttcagttgttttctgatcctgcctttttctttt

SEQ ID NO: 591011 - DNA, 321 bp, Homo sapiens
ttttggcccccgggttttgggggggaaaaaaaaaaaaaagggttaggggaaaagggggttttgataaaaaaacccccgccattttgtttttttttggggaaaccccacccagaaaaaaaaggggtttttcccccctaaatccccccccctttttaattttaaaattggggtccctttttttttgggggggccgggtttcccggaaaaattgggggggaaaaaaattaaccccccggttttgtttttagggccggtttttgggaaattccggggggccatttttttttttacccccccccaaaaaaacccgatattttttta

SEQ ID NO: 591012 - DNA, 192 bp, Homo sapiens
ttcccgaacaccttctgcggctgtcttctgcagccctggtgaccgagcctccacagcttttacaggctctgagctgcaaccgatcgcggtggcctccttgctgtcctgcttcttgccttcagaaacttctgacttccgagtcctcttcatgatctcctccagacgctttctgcgctcttgccgctcttgctc

SEQ ID NO: 591013 - DNA, 204 bp, Homo sapiens
cacacctgcactgcatccgaacctgcagacgtggctcggagcacactctgatagtcctcagactgtgtgtgtgtgtgtgtgtgtgtgtagtgtagtgtgtgtgtagtttgtgtgtgtttactcgagaacatttgtctagaagtgggggagcagatatctgcacagataaaacaggatatgtagaaggcacgcgctcacaccgtg

SEQ ID NO: 591014 - DNA, 656 bp, Homo sapiens
gccatgtctatgtgccctcactacagtctccagcaagagccgtaaggtgcttaatacgcagagtaattaagacagggatcagcatatggctatggagaatgaaaggtatgttgactctggctggagccgacctttccagatatatgcttgcagtacattaacgggtcatatagctcttggtgtcagcgggtgggtaagtaaatggcttgagccatttacaactaaagatcggctacctgtctacctgcgagccgactcattcatttaataggcccgagcgtctagcccatgtatcattttgtgagaaaaaagatgggacgcttgcgttgcagaaccttggcttccgtgtgcatgctgcgcataactgatgcagatgtgagaacacatcgcatgggctcgattgaatgtgtgctacccttctcaaccgcagggatttttgtcgaccataaggcagtatacgctttcttgctcccccagatctctaggtatgctgtgccctgcggcacagaagacattgaaaggctacatttgatatctttgagagcaccagggggcctaccctcattttcttccccttgagactcttgtctggttcacatgagccttccagttatctaggagtccgagtttattctgatttgaggttaggagtgctt

SEQ ID NO: 591015 - DNA, 499 bp, Homo sapiens
tgtgagatttgagcttgagagaaggtgagtacacagagcaattgtgcagattgttgtagatgacgaagattgacatgcgacagaggtgtgcaagttcgcataagcagttaatagcatttctaaattttaaaagcaatttggtaaattatcggcgtgagattattatttcgtagttgccaatagcaaacttgcattttcgcattgaatggagaattcgagtgccttgtcaagcgattttaaagtatgacaattatttataaagtgtatggtatggaggaatcgtttagagattctctttcctaattttctttcttattgaagatagattctgtatcaagcaagttaatgggtagtaatgactgtgttgacttcaattttggagcgcagtagcgtatgttaaagatgaactatttggtctcattgaagccaagacagaactagctgctgtgtgtgttcttcagggataaataaaatacttacagaaaagacaacaacaaag

SEQ ID NO: 591016 - DNA, 155 bp, Homo sapiens
ccaagtttcctttgtaaagaattcccttttttcaaattttaaaatttcgacttcagcctttgccctcaggagggtttgctccagcatgagtttttggccttacatagttttaatttatccagtgggtcaagaggtagaataaatgctccccctta

SEQ ID NO: 591017 - DNA, 105 bp, Homo sapiens
tgggctgcagtgggacgtgtggggtttctctcgagtaatgaagggtaactcagggagcctgtcgtgatgccccagggaagctgagtctccattcgagttgcgagg

SEQ ID NO: 591018 - DNA, 250 bp, Homo sapiens
  misc_feature (64)..(64): n is a, c, g, or t
  misc_feature (111)..(111): n is a, c, g, or t
  misc_feature (122)..(122): n is a, c, g, or t
  misc_feature (130)..(130): n is a, c, g, or t
  misc_feature (137)..(137): n is a, c, g, or t
  misc_feature (174)..(174): n is a, c, g, or t
  misc_feature (213)..(213): n is a, c, g, or t
ttctggctgacagtaaatttggcatatttttagtcattatttcttcaagtagtttttgtttttncatcctctctctgtccactcattctgaaccccagttacatgcatgtnagactccgcgntattcccntcatggntctatgactgtattcatgttcaaaataattttttccngtgtctttttgaatcattatctcttgacccgcatttagnttcaccatcatctgtaatctgttaatcccatctaaag

SEQ ID NO: 591019 - DNA, 340 bp, Homo sapiens
  misc_feature (84)..(84): n is a, c, g, or t
  misc_feature (220)..(220): n is a, c, g, or t
gtgtgttgaaggtcagtgcttcactgggagggctcacaggactcagaatatagtgtacttacagctatgatttattacagtgangggaaataaagcaaaatcagcaaagggaaaaagcatattgggggaaatcaggtacaaacttctgagttctctcccagtggagttacgtaggatatgcttaattcctccagcaaccagctatgacaacatgtttgangtgttgtctaccaaggaagctcaactagacactcagtgatcagaatttttattgggaggatggccacatagggcaccctctgtataggtactcttcggactgggcatgtacccagaattt

SEQ ID NO: 591020 - DNA, 363 bp, Homo sapiens
gggccttggcgttggcgccaacacgcgcccactggctcacagccgaaccgtcggtgtcgcttgggaagaagctgctgttgtcagggtgcttgccacggccaccgtccaggtggataccccacagggcctgggcatcgacaccaaaaccaacggtgccttcggtgaagccggagatgtagtcgagcttgaagccctgacccgattcgcggttgtctgcaccgccgtcacggttgtcgttgttgaagtacatggtgcgcgagctgagcgacagtttgctgtcttcaacgaaaccggcagcgcctgcttgttgcgcgagaacccccagtgccacggccagagccagggctgacttgtacatgtatt

SEQ ID NO: 591021 - DNA, 343 bp, Homo sapiens
cccccctcctatatgcacttcagcactggcccagactcacgtttccacctttccaaatcattctcagaaatgttttatccatgtacccacccactcagccgactaaacatctacccacttgccaagcattccctgaacacctaccacatgccaggccccatgccaggcactagggacaagagagacaccttgtccctgtccccaaggaaccggtggtatggaggagggaagaaaacacgctggtgctgccatagtgtgaggatggccccacacaatgctctggtgacagtgtgagccagcagagccaggagcaggaggaaataccctcaacacagggtgttgg

SEQ ID NO: 591022 - DNA, 1088 bp, Homo sapiens
cgctcgtggacagctgacctctgtctttcaacctctgctgtggtcaatcccatgacgcacctgcctgtgcatgccccagtagcaagcaccagtgcagcacatggcaagtcccaaataagtatcactctaaagtatccatcctacactcatatgtgattgatcaatcctgcacacaatgttatcatctgtagggcagccagcacacatgtgtggcatcccaagctcacattgcctccagcatcccgccaatgtacaccatatcacctggtgcacaggcttgatggcatgcaagcactggcgccacacgcaaccaccacatgcattgacagaccaagtgaccaatcaccgcagtggcaaccctgacacacacacaacctccagcctcatgtgctgaaacaacttgcgtgcgatcaatcatcctgtgggtgcacatgtgtggcattcttgttgtacaacccacatgcagtgacactacacattgacaattcaatgggaaccactgttatgccttgtacccaacataccatgatgcccagccttgctttccccgatgactgtctagccactttgcccccattgatgacgcacaaattgtaacatgcccatgaccaccattgcgtctcttggccccgacgaaagcactcccataacaccaatcgcataacgtgtatcaagcacataaccatctaccagatgtacaccaactacaatccatgagatgaatgtgcaacatgatcacgcactgaagaacaccatgttgagcctacgcaagccacacctgtatacccatactcacactctaccccttccaccatatggcatggtcatccacaaggtatccacatggacgcacacaaccctcactcttctatcaacagaaactgattcacatactacggagaccacgcgcaccgatgctcacagcaaccatgactacccccccctaacggccacatctatgaagcacgacacaccgagagcgatcgctacctgtaactatgacaactacaccaacgcgcgtgttacctaaatagcgcagcagccaccacacacacacacacgaccaccctcgaaggacacatcacacc

SEQ ID NO: 591023 - DNA, 285 bp, Homo sapiens
  misc_feature (18)..(18): n is a, c, g, or t
  misc_feature (129)..(129): n is a, c, g, or t
  misc_feature (203)..(203): n is a, c, g, or t
ccaccctgctgattctgntgagtggtggggactccaattggtactctggcacagagaaaccggaatgactaacagcacgggtgcgaaggcctgtaacctatccaggggaggcggggttgtcactgagangggtgggctgagggccctttggaaaccgtctgacgtgagagagttaccgccgttgccaacaccttccctaacgnccttctgatttgtccctaatgaaactcccgtctgtggggtccacatctttgttgatactctagaaaccaatgaaaaaaaaaa

SEQ ID NO: 591024 - DNA, 326 bp, Homo sapiens
  misc_feature (5)..(5): n is a, c, g, or t
  misc_feature (24)..(24): n is a, c, g, or t
  misc_feature (48)..(48): n is a, c, g, or t
  misc_feature (80)..(80): n is a, c, g, or t
  misc_feature (89)..(89): n is a, c, g, or t
  misc_feature (106)..(106): n is a, c, g, or t
  misc_feature (141)..(141): n is a, c, g, or t
  misc_feature (151)..(151): n is a, c, g, or t
  misc_feature (161)..(161): n is a, c, g, or t
  misc_feature (167)..(167): n is a, c, g, or t
taccncaattagcccaggcgtgantggcaggtgcctgtagtcccagcnacttgggaggctgaggcaggagaatcgcctgnaccctgggnggtggaggttgcagtgnaccgaggtcacaccattgcactccagtctgggcgncacagcaagnctccatctcnaaaaanaaaaaaaaaaaaaaaggagggcattggaattaattaaaaatagatcataatgaagtaactctccagagtaaacctacattacaacaaatcaagagaggggagttgtgtaacaatcctagcaagaggcactgacatgatattaaatcaacttggttttaa

SEQ ID NO: 591025 - DNA, 551 bp, Homo sapiens
gcacgctgctgtgtgcctgaggtggctcccgtgacagtacgcggacgggtggatggcggcgcgcgtgtggcagctgtatatctggagacacccgcagcctgcacctgccgagtacaaggcattggcttgcttgggcttgctgcgccagcactggttgccagctgggtgctcgactgtagccttgtggcactgtggtgagcccagtgccggggcctgggggctgttgcatgagatcgggggtcttggctcatgcctggtacttgcgctggcctgcagaaaccacatgtggcctgtgtgcactgtcatgggctggccttttgccaagtccttggaacgggagtgggacaccaagtggccatggatgcagtgtacctggccctggcatgaacatggcacttgcgatgtgcccctgtgagtgctagggggtccatggtagctggttcgcatgggaagaggcccctggatgaagtggagactggggttgtgcagtgatggtgtgtgggcatgaaaaatgtgagctgtcccttgatggcttttggagccaggagcca

SEQ ID NO: 591026 - DNA, 186 bp, Homo sapiens
aaaaaagactggggaggaaaaaaatcaacttagaagatcatatgaaagggcactcacatggaacccagttagtgtcctagtttattacttgtcttcagatccagaaaaaagagtaagaaactagggtaacagaacacctaggcacatctgtaaggcattagtttcctatcacacagcccattctag

SEQ ID NO: 591027 - DNA, 160 bp, Homo sapiens
cggtgtggtggcgcccgggttggacacgtacgttgctgggcgatgtcctcagaacgaacgtatttttgtgtgtgtgtcaggttgcagtggcctttgtgcagcgttgtggtttttgcagagtcttctgtgacagttttgctattatgtatacaagcatgag

SEQ ID NO: 591028 - DNA, 781 bp, Homo sapiens
tgttgcaccgggttcttgtgtgctggcctgtgtatcttctccctcgtgtctgccactggcccatgatgtccccatgtgctgactgttgcatgtggtgccatgtgcccatgtggtgctgtggcatgtcctgagtgggggcttgctgtgctgctccctgtgtggtgcatcctgctgtgctggctgtggctggtgttcgcctgcctgtggcctgcatgtgttcaccttcaccctgcccccttcggtacctggggggagactcctgtgggaacttgatcacatgccgcacatgagctttgtgagtttgcccatcctcctggctatcctttgttcactctggtgtgctaaacttggcaattacacttgtttccttttggttcaatttgcctacctgcgtcaatcttctctgtggcttatttgtgagcatgtagctgcatcattactttttttcacctgttttcatgtgctttcttggctcatctgctggacggaatccttgctgcgggggtgttttcattttctcagtctaacattgtgcagtgtgtccattgcagcagaggtaatagcttaaacaatctctttgtggggctgcttatgtgctcttactgtacattttgaggaagcaagcaaatgctaaggagagatcaaaggtagctaaaattggtgtatcatctgatggcataaatatgtaaccagacaaaaaataatcaggagtgataaaccttgatcctttaatttaaaagaggaattcccgggccatggataactgaaaagagatagcatc

SEQ ID NO: 591029 - DNA, 154 bp, Homo sapiens
ttgcattaagacttgaaagacttccagacgtgtgatcttcaggcccaggatgctcaaacccatctcactattcttagtttgtaaatcctccttttcataccatcatcttgttttctttttgtaggtataactacaaacactcttgacaataaaa

SEQ ID NO: 591030 - DNA, 360 bp, Homo sapiens
tacatgccctgcctgcttctgtctgggtttattacccccaagtcaacccccagcaagtcctccgctcgagccttcagtcccctgctgccctgcctgcaagagctgaggggcccttcttggtgtcaggatttcttagtccatgccagctggcccctcctgcgcagccaggatggcgtccaggtccctgatggtccacagtgtgtcccctggggctcggtggagcaatccgggcgggcgtcggcgtggaggaagcagtgccttcaatcatcgtgggaacaggccaggtggcaactgatccgggacttgcccacgctgccagtgctggagcttccatcgcctaggtccgcggggccttgtacg

SEQ ID NO: 591031 - DNA, 786 bp, Homo sapiens
  misc_feature (786)..(786): n is a, c, g, or t
tgggttacggcagcactttaatttttccttacacaaggacgtgtggctggggcctaaggttctcacataacagtaaaaacaccaaaattggtggtcatctcttcaaagaattcgagaatggcgtacaaaaaaaaccttacataatattaagaagtggaatacttttacgggcgtaaagtgcaaaccgcttctccaacttcaagcaagtaacagcccaacgggtgttcgggccaaagacatcagctacgaaaggaaacggggctcctacggctgggacttctccaacccgtgacagacccgcaagacaaaacaactgggttctggccagcctctagagaaatcccagaacactcagccctgacacgtaaataccctgcgacagatcagaggctggctgggccacacagactcaccaagccacagatcttgtcttccacaagcacgttcttacctttagccacgaaagtgaccaagccacacgtactaagggtggacctcaaagatttgtccggggctattaaacaaatcccaggggggaccagcttacacttcaatacaggggtcaaacatcagcaaccaagttctacaacccagctgctgatatcagatacaagtcttcaaggacaaatttcttcttcgaaggcttatcccagtttccgtgaggctagcatgagggtttgtgccattggccagcgggaaattctattctcaataaccatgcgaaatgctaacgcatctgagaatcggtaaaaacatcgcgggcagagagggggcaaactggaaccn

SEQ ID NO: 591032 - DNA, 294 bp, Homo sapiens
cctcatcaaatcagttttgccctgtgaaaagatccagccttccctgtcgtcaaggtggggttttactcgggatttttgctgttgttgtggccttgggtaaaggcctccccttagaacacaggacaggcctgctgacaagggtgagttttccttggcaaagaccaaaatatttttttccgggcccctggggaattttaggggtgatgggaaaaaaggaacctggagtggaaggagcagagttgcaaattaaccacttgcaaattaggtgcaaataaaatgcagatgattgcgcga

SEQ ID NO: 591033 - DNA, 225 bp, Homo sapiens
tgctcaggatgcgctcttatgaggccctatttcctgagaaggagattgaggctaacccagaagttgacagcttagcgtgggaagcccaatgatgatgatatacgggagcccgatggaatctcatagctcgagcagcacgtttcggcaccaacctgcaccccaagagcatctataaaagttgtcacatacttggcgccgggcatctcgtttcactccactaccatg

SEQ ID NO: 591034 - DNA, 223 bp, Homo sapiens
tcagctggtaccgtcagacgctgaactatgtgggaagagagctaggtagaacggtcagtcaacagactggaacgcatataaaggctgctgttttccattttccttcttttttttttgttttttggtttttttttttttttggaaatggtgtcctcactcgtgtcacccaggcgtggagtgcaggggcacattagttccagcgtttgaggggaactcctctaga

SEQ ID NO: 591035 - DNA, 245 bp, Homo sapiens
aaggaaaccatagaatttgaaaaggaaataaaccagtgctctcaggggatctgagaaaacagcaccatatatattagtttaaaaaattaaatattatttacaaaagtatattttacaagcaactgtttcttgtgatatatatccacttgaagaatctctttatggggggtcatctctgtcgcacagacggatccaccagtaaaaatgcactctagcctatcctcgtgacggctagaagaacacgt

SEQ ID NO: 591036 - DNA, 1013 bp, Homo sapiens
cgaggaggggttatcacaactgccacttcccctgcctgtggccctctcagcagaacggtcctgcacaacaagtctgaaggaatggctcccgtgtcttcatctacggtcagttctgtaacgaaaacttctgggcagcagcaagtgtgtgtgagccaggccaccgtgggaacctgcaaggttggcacaccccaccgtcgattcagggcgactcacgtcacctcgtgcctacaccaaaccccatctctgggagagccacagtatcctggactgttcaaatgattcacgtccagatctagtccatgtcctgcagacgaggccgtccatgacgagttccccaggcagctcaaagcactcagcgtagagacatctggaggggtgcgagacagatccgtgatgccctgtgaataaagtggtgcagtcattatatctaccagcagagccacctgccattctgccgtgtaggctggcccaactccagttgtccccagctctgtctccagcagactgttgcaaaagtgaagactgaaccagaaactcctggaccgagtgtgcctctctcaggagggtcagacagcagtgactacagaagaaagttctgagctgggaaactatgtcagtttaagatagaccatttagaaactatccatggcaattcctaactgcagtattaacagaagattgccattaatcactgcgaaaagtgaagataggcagatgttgactgcagaagtctgggagcagtactatggctggaacattggagacatcgagagcggtgagtggcaccgagcatgataaggcgaaagtcttcaacgaatcctggacaacgatccgaaattcacacctgatccctcaagcaaggaatcgccatgctgccgtgtaaggtaaccccaacggagctgagactgagagagacgggccacgagagcattccgcaatcaacagaccagttcccattgccctgggaactcgcgactggcggcgaacaagacgaagggggcgacacccgggaa

SEQ ID NO: 591037 - DNA, 83 bp, Homo sapiens
gcacgaggaaaagacaacaacagtgaaagtaagtgtccccagatgcttgtggcaaatgaaaagatggatactttaaagattaa

SEQ ID NO: 591038 - DNA, 628 bp, Homo sapiens
  misc_feature (197)..(197): n is a, c, g, or t
  misc_feature (401)..(401): n is a, c, g, or t
  misc_feature (487)..(487): n is a, c, g, or t
tcacatcatcagactaggtgagtagtgtcctccaggctctggtagcacgtgacagaaacccactcaaattaagtaaaaaagagaaatcgattattataaggaatggggagaatgtcacatcgttccaattacaaactgttggcagactcaccattgagtcatcttgggtcaaacatccaaccacagaccacctgagncaaggggattgggtcacgcagaacagacatgattggggaacccacttatgtgggtgggggcggtttcctggagaggaagagggctgaaaacacatgccaaaaaggagtctactccacttgagccctggagttggagaccagcctgggcaacatggtgaaaccctgtctctacaaaaagtacaaaaataggctgggcgcagtggntcatacctgtaatcccagctactcgggaggctgagacatgagaatcacttgaacccaggaggtagaggttgcagtgagcagagctngctccactgcactccagcctgggcaacagagcaagactctgcctcaaaaatcaaaccaacaaaaaatagctgtgtgtggtggtgtgctcctgtaggtccagctactcgggaggctgaggtggaaggatagctcaagcccag

SEQ ID NO: 591039 - DNA, 202 bp, Homo sapiens
atgaagtcgggtgatagctgccatagtagatatggttcctggcaacgcccatgtgtgttggagagcttctcagactatccaccttatggcgtcgctatagctggttcgtgatatagaaacagacagtgtgcggtggagtagtcatcaacagcagtggacaagcaaggctagctgaagctaggcaagggtcaccaaagtctgc

SEQ ID NO: 591040 - DNA, 492 bp, Homo sapiens
  misc_feature (26)..(26): n is a, c, g, or t
caagaacccccttcccgtcaccccanccaatgttgttttccggctcgaaggctctgggttacaaaggcccaagatcctcaacgttggggacattggaggcaataaaacagtgaccctgccccagttgtttgtgcctgtgcgaccaggccccccccagctcattgccagcttggacagcccccagctttcccaggtgcacggtgtcatccaggtggatgtggccccagcccctggggatgggggctttttttcaaacgctggaggtgacagtcccttaggaaagaccatccctatggcatctcgaggtggagcttaaccctgtgccaggaacaatggggctggagtcaaatgagcaaggacattgccccaaaataggggccccctacaaaacagctccccaggagctcaggtggggagtccagggctcccggaaaaggagtcagttttcccttgccctgggggaacaaatgctaataaactgttttttaatga

SEQ ID NO: 591041 - DNA, 851 bp, Homo sapiens
  misc_feature (125)..(125): n is a, c, g, or t
  misc_feature (162)..(162): n is a, c, g, or t
  misc_feature (219)..(219): n is a, c, g, or t
  misc_feature (263)..(263): n is a, c, g, or t
  misc_feature (851)..(851): n is a, c, g, or t
gcggaggctctgctcggatcgaggtctgcagcgcagcttcgggagcatgagtgctgcagtgactgcagggaagctggcacgggcaccggccgaccctgggaaagccggggtccccggagttgcangctccctggagctccggcggctggctccaccggcganaagagatcccggaggtcctagtggacccacgcagcctggctggcgcatatgtgcgtnggccgcttttatgggcaatgggctggctttgccaatgtgcttcngagatctcggacgcggacaccaaaggaggtgttcgcgggcaagattgtgcctaagtctctgctgctcaagccgcaccagagggagaagatgtccatggaaaatatccattcaccgcagcctcgcccaccagcacgtcgtagtgatccaaggcttttgcgaggacaacgacttcgtgtccggggtgtgggaagctctgccgccggaagggtctctcctggagctgcacaagaggaggaagccctgactgagcctgaggccgatactacctacggcaaattggtgctgtggcttgccagtacctgcgccgaaaccgagttataccctcgagacctcaagctgggcaagcttttccctgaatggaagatctgcaggtggaaaatacggggattgtggaatggcaaccaaagtcggatatgacggggagaggaagagacctgtgtgggactcgtagttaaatagctccgaggtgtgacaagaaaggcacacgttcgaggtgatgggtgccaatggtggatcatgtttccttgttagtgtggcaaacacttttgagattttgccaaaagagactacctcggttagaaatgacn

SEQ ID NO: 591042 - DNA, 138 bp, Homo sapiens
cctctagaggatacacacccgtccccagccccttcacacatggaccactcctcaaatgggggttgaggggcaatgacactgggtatgagtgaagcagaagagatttagaggcagtcatggaatttgtggcgaaaataa

SEQ ID NO: 591043 - DNA, 442 bp, Homo sapiens
tcatttgacaccagaccaacttagactgtgcccccaaaaaacttgtcatccctactatcttttgtctagtcatactcctattcaccattctcaactactcatacatgccctgctcttgtttatactgctggtttacactgtttctccaagccatcacagatatctcctgctgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccatttagtttttcaattcatacaaaaccgtatccaggccatcaccaatcattctgtacgacaaatgtttcttctaacaaacccaaaatagcaccccctctaccccctctagagccaa

SEQ ID NO: 591044 - DNA, 687 bp, Homo sapiens
  misc_feature (111)..(111): n is a, c, g, or t
  misc_feature (121)..(121): n is a, c, g, or t
  misc_feature (127)..(127): n is a, c, g, or t
  misc_feature (553)..(553): n is a, c, g, or t
  misc_feature (574)..(574): n is a, c, g, or t
  misc_feature (604)..(604): n is a, c, g, or t
  misc_feature (613)..(613): n is a, c, g, or t
  misc_feature (622)..(622): n is a, c, g, or t
  misc_feature (629)..(629): n is a, c, g, or t
  misc_feature (631)..(631): n is a, c, g, or t
gcccaacgggggcgatgagcgatccttgggcgggtttgcccgccggagtaatccggaagaggcctcttattagggctctggtggcggcggtcgcggacactttgggtctgnacgcaacgcngcgggncatgaacgccctccagccttcgagtcgttcttgctcttcgagggcgagaagatcaccattaacaaggacaccaaggtacccatgcctgcttatcaccatcaacaaagaagaccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttcttgtgatattgagtgagcgcttgtgggatctggttgtttaaaagcgtgcagccctcccacttcactctctctgtctctcctgctccaacatggccagacgtgcctcttncccttcgcctctgcgtgattntcagtttcctgaggcctcccagccacgttnctgtcagcntgcagactntggatananccttttctctactcccatatatacgtttggaagcttttgggcatctaaaagaggga

SEQ ID NO: 591045 - DNA, 1032 bp, Homo sapiens
ggggactctgctgccggcttctcggagcggcgctgggcgaccagagcagggtcgagatgtcctacatcccgggccagccggtcaccgccgtggtgcaaagagttgaaattcacaccggctacgaagcttggcccagatgaagccaggtgggctccgcgttcactcccactctcccgagggggtgctggcctcccccagggtttggccttcttacggatttagaccgaggtacgaggctcaccttatcagcgcagctctcaggatcgtcatttgcctcttttgcctgtgggttcacacttgcgtattcttttaatcacaagtttgatacaaaagtgtccatcgtactcttgggagatgcccattctactttggaattcagcttttactaattcgcatctgggaagctcagcaagtgcacaagccttaacttggggttaccggtggaaaacccatggccggccctttccccgattgttggtgcgctcaataaacaattgctggaaaccaaaaaataaaaacacacacacataaacatcacaacacactttcgggagcgacacgatgacactctaaaaagccttttacacccccatcgcatgagagcgcgcggagccaccaatagtacagcgcaccccggccacaagcgtgtccaccaaagagaactccagggacacagaacacagggggcggagtctcaccaaataaaaaaggcgcgggggagccacgagacgggtgttgtgaacacaccacaaaaggggccacgaggccacaacgggcggctcacacaacgaggcccaaagcaaacgcaagaataaccgcgccgccacgctggtggagaacgacagcaaccacaaagctgaaaggggagcaaaggagagacgtaaaagtagaaaagtaccacagatacattctagagaggagtggtagtggctagaataagaaagaataacaacgcaaggtagtatgtacagaacacaataacgaggtaaagggacagacgaatagtagcagtaagatagaaagaggaaaaaa

SEQ ID NO: 591046 - DNA, 405 bp, Homo sapiens
  misc_feature (111)..(111): n is a, c, g, or t
  misc_feature (121)..(121): n is a, c, g, or t
  misc_feature (127)..(127): n is a, c, g, or t
  misc_feature (271)..(271): n is a, c, g, or t
  misc_feature (292)..(292): n is a, c, g, or t
  misc_feature (322)..(322): n is a, c, g, or t
  misc_feature (331)..(331): n is a, c, g, or t
  misc_feature (340)..(340): n is a, c, g, or t
  misc_feature (347)..(347): n is a, c, g, or t
  misc_feature (349)..(349): n is a, c, g, or t
gcccaacgggggcgatgagcgatccttgggcgggtttgcccgccggagtaatccggaagaggcctcttattagggctctggtggcggcggtcgcggacactttgggtctgnacgcaacgcngcgggncatgaacgccctccagccttcgagtcgttcttgctcttcgagggcgagaagatcaccattaacaaggacaccaaggtacccatgcctgcttatcaccatcacaagagacacacactgggaacatcattaaatacgtgcctcttncccttcgcctctgcgtgattntcagtttcctgaggcctcccagccacgttnctgtcagcntgcagactntggatananccttttctctactcccatatatacgtttggaagcttttgggcatctaaaagaggga

SEQ ID NO: 591047 - DNA, 457 bp, Homo sapiens
  misc_feature (164)..(164): n is a, c, g, or t
ggggactctgctgccggcttctcggagcggcgctgggcgaccagagcagggtcgagatgtcctacatcccgggccagccggtcaccgccgtggtgcaaagagttgaaattcacaagctgcgtcaaggtgagaattaatcctgggtttcagcattggaggtggantcgaccaggacccttcccagaatcccttctctgaagacaagacggacaagggtatctatgtcacacgggtgtctgaaggaggccctgctgaaatcgctggcctgcagatttggagaccaagatcatgccaggtgaaccggcttgggaccatgaaccattggtcacacaggaaccagggccccggaaagcggttcaccaagcgctcggaggaggtggtgcgtctgctggtgacgcggcaagtcgctgcagaaggccgtgcagcaggtccatgctggtcctaagcagtcagcaga

SEQ ID NO: 591048 - DNA, 592 bp, Homo sapiens
  misc_feature (126)..(126): n is a, c, g, or t
agccccacctgtgccctgtgtcggattttctgtgccccaagttactctgccagactgactggaggggaggatttggagcctgccagctcacactactcctgtggctctggagtgggcatcttcctnagagtacgggaatgtcaggtgctatttttagctggcaaaaccaaaggctgtttttattctcctccttaccttgatgactatggggagaccgaccagggactcagacggggaaatcctttacatttatgcaaagagcgattcaaaaagattcaaaagctttggccccaacccagtgtcccaaaggaaattggacatgcccaggaagccaatcaaaccctggttggcattggctggcaacatttataatttttgcccccccaaaaaaccccaacttggggtttttttaccccagttggctttttaaaaaaaaaaaaagttttgctgaatttggaaaaaaattttttatttaaactttccttccccgttttaaagtttttggttttgagggctgatgaaaatcattttccatcagcaaatttttttgccctgtttgctgggccccccaaaaaaaatgttttgggtttta

SEQ ID NO: 591049 - DNA, 1120 bp, Homo sapiens
gttgagaaccgtttgggctgttggggctgtgggattgcgagagtgtgggggagagggaggcgggaagtaggtggggcggttagcaggtggaggcaaagcgggtacgcaagttacagttgtggtaggtgtggggctaggtacggtaggagtggggtagaggggtgtgggaatttgcgtgcggggttccagtttatggagcatgggcccctggttgcgcggcacttgtcgtgacatcgcgtgggtgacgcgcgggcgcgggctagttgagtggcgtagcgtcggggcatagtggcgtctgtgcgaatgtcttgtcgatggccacctttctgtctctgccccgtggcctcctattgtgcaggagagggcgctttcgtcctggggcgcaggcccagctcttcgttagggccgccaagctttgggaacattaggtgctatcatgggatctatggtttgggcagtgctgcagagtgagcccgtcctgttataggtgcttcgcgtgtggcctaggcgtgagcagccaggcgcgcgtgatgacgttggggtatgggcacgcggatggcatggctgtactataagagtgataggggtgacctacgtgctaggcaatcgttcgctcagtggatcccctacggtcctgcgcctgctgctggtgactgtgtcgcaggtgtagtcatcggggatgtcgccatttcaagggggtcatggtcactctgtgactagtctacgctagtcgcgctgcttcacgctgctccactcctgtacctacaatggtacgttcgcctacgatcgcagacctgctgtgtgaacttgtagacagtctgtacaatttcggcttatgtcttgtgcctgacgttggccatatattggtgacactcgaggcacgaacagataatcggagaaccctgggtaacggacctggttcttttgcttacttcggggaactgtaagccctcgcgttctgggaatcgctcatctgctgctctgtgtcctaggaagctaagcctgtctccaccgcccgaggcctgacgccggtggctcccagccgcagttgcgttagcattggaccttgcgtccgagggtaggaggtgctcggtccgagcccgctcctttcattacacca

SEQ ID NO: 591050 - DNA, 93 bp, Homo sapiens
tggttcatgttctttattgaacaccttacatgggtttggacagggcctatgggtggcatagtcaaaggcgaactttgcaatccgctgaaactt

SEQ ID NO: 591051 - DNA, 934 bp, Homo sapiens
  misc_feature (130)..(130): n is a, c, g, or t
tcattaactgcttctcacatttgttgatttatgggcctcctatcatatcgtgtatgtaccccggtgaaatcggtcacgttgtttgtatgtgcttattgtatcccacaactgtgtacaccaaaggcccggnggacaacccgtaactatgttcaaaaaatcctccacattgacaaaccaaatttggcttgtataacagcttacccccttcagtgtgccgactgggatggcccccgaaggatagtccaaagtcgtcaaaccaaatctggtatgagaatcatccccgatacccaggtgattacaccaaccggctcatctccaggaagttttatataagggcctagtctttccgtcatgatcattgcccacgacaagccggcaacaagatgggataaaaaagcagtcaagctcgtgccccaccacagcagatgcactcgtgactctttcaagccaacccccaacgagggctcaataagtgtcagggggcccgcccatgggcacaatacaaatcgatgagcatccacatgacaagaacagttctgaaacaaaagcgtcattcattttatgaggcgcacccccaccactgtgcgtgtatcacacaaccgggaatcgccccacacatcagggatgcgcctgcaggcataagtcttttggtgtccaccaaacatggtagtgtgttaaaattttgagcgccccacaatagaggcagggactatgacaagggttcagcaaaaaatacggtggtcgtagtgccaaacaataccagccccattgttatgcacgcagagaatcaggcatggcgaccaaacgaagcgaagtcaaaatcctagttggtggtcatacccgaggtacgagggagaacaagctgtcgggagaggcccttgcggaggcctctgaaaccccaatctaccaaaaaggcaaaaaagacccacaaaac

SEQ ID NO: 591052 - DNA, 245 bp, Homo sapiens
cgtggtatgcccaccttagaaggtgactcaaccatggtcacctcgcctctggcaatttcaagtcagcccagactccctcacagatggtgcccttgcattctgccaacccgccaggaacctctcaagtcgccccaggtcctcggctcctccctcagtgtccgttcacccactgactcgcccagcagtctcaagtctccttccatggcggtgccttctccagagctggagtagcctcacctaaagac

SEQ ID NO: 591053 - DNA, 368 bp, Homo sapiens
  misc_feature (256)..(256): n is a, c, g, or t
  misc_feature (294)..(294): n is a, c, g, or t
  misc_feature (359)..(359): n is a, c, g, or t
catttgtataaaagaatttgtgataaatatatccaggtgctcaccaaagaaacatgtattaacaacttaaattagatttttctaactgatagttttcactcatttataatcagtagaaaagccggttaaaatgttggggcagctcaatgatttaagtttgtaacatgtaataactgaatttaggaccctaggtttggttaagctttaagattttttaaaaaaacttactccccctgcctccccagccttatgtttnttttaatgacttttggatcctgagctccctttgcagtntgaaaaaggtattgcagtcagaactgtgtactgatgataaaagcctctggtagcaataaaaagtngtccttaaa

SEQ ID NO: 591054 - DNA, 359 bp, Homo sapiens
tctggtgccgtaaaaatgtgtggatgctgggggagggggggcacttggggggtaaaatgtgtattgttgtgggtttggggggtagggggcttgttacgttatattaaatcgatggaggggatattcctggtgttattatttgggggggatttgttgagtcatagttaaattgtttatgtgtgtgattgtgtgttaaattgttttgtaattcttttagtaggggttatttttttcttataataaggtgctttattgttttgtttttcttatccctatggtattttcttatttactttgtggcttttgtttttatattttgtaattttttcgctgtgttttttagttattatactgtgacc

SEQ ID NO: 591055 - DNA, 139 bp, Homo sapiens
  misc_feature (130)..(130): n is a, c, g, or t
tctctctctctctctctctctctctctctctctctctctctctctctctctctctctctctctctctctcaaggtattgcagtcagaactgtgtactgatgataaaagcctctggtagcaataaaaagtngtccttaaa

SEQ ID NO: 591056 - DNA, 913 bp, Homo sapiens
ggcttcgcggtagacggacagaggagtcgtagcggtcgaggctttggcggctccgggtgccgaaaagtatgtatgcataagagtggatcaattaacatgataaatgagaatggccacatatctttcaagaggagaagtactagaagtttataaaaatctggtgtatcttggatgagatattccaaaaggagcagactatttgtacacacaggcgtttgaagaacattttccttataaacaaagatgtgaagaatccagagaagatcaaagaatttattgcacggggcgaatctgtaatgaaagagctagaagcttgtacttccttaggaaatacagagctatgaaacaaggctattattcagataccatcaaaactaattgatcattactactttattgtacgctatcagtgccagctgtaatgtataccgtgatgttgtcaaataattctaacttacaacatgggaagatcctacattgtctgtgtaaaaaatccctgagtgccctactgaatctaaatgaggttccaaattcgtgttcatacggagaactgtatcagcactttatgctcaagcttgatacaagcatagcaattagctatactaccgatcatagggttatgagccccccctctgaatgacaatattatacattgaatctctaagtaataggacttacgccattatttgagttatacccattgactgacaagagaatgcatttaccgaacattataagcaatatttctacccctctgctctcgaactctggaggaccttttttccccgtgttattacaggctctccgtccaacacaggcggtgtagcttgtcacacaacttggcgcgcgcaacggggggggagacaaaactaatatggcggcacacggctgaataaaaccactcgggggcaca

SEQ ID NO: 591057 - DNA, 375 bp, Homo sapiens
ctgctccgcccctctctgtgggacttgacaaggggccccgaggccaagggagaccactcctccctccaggcctatgacttttactttgtgggtctctaaaaaccatgtacacactttcactctattgtaaccacacagggcacgcgcatacagcatgtcagagagctgccccgggcagctctccctcccgggcacgctacctctggcctggtgtagcaccgagaggacggatgtcatcatgctattagcggaagagccttgagcttaaaagctcttcattttctttgccggaaagcatatggtttgtgtttttgcagttttatttttttaaggatggacactaaatctctggtgccatgttccctagcccgtggc

SEQ ID NO: 591058 - DNA, 224 bp, Homo sapiens
ttgatagatcgttcgtgcaagaataggaggtggagtgctgctagggctgccataattaagggccaagatgaatgtgaaaggtcaagaatcgtgtgagggtgggactgtctactgagtatcctcctcagattcattgaactacgtctgtcccaatgctttgggatggcggttagtaagtttgtaattactatggcccctcacaatgatatttgtccttactcgag

SEQ ID NO: 591059 - DNA, 283 bp, Homo sapiens
gacagtgtctctcacccagtctggaatgcaacagcgtggtctcggctcactgcaacttccacctcccgggttcaaaggattcttgtgcctcagcctcctgagtagctgggactacaggcatgtgacactatgcctagctaatttttttgttatttttaagtagagacggggttttgccatgttggcccaggcaggcggatcacttgaggccagaatttgagaccagcctggccaacatggcgaaaccctgtatcactcttttagacccttctgtcgtcttctc

SEQ ID NO: 591060 - DNA, 461 bp, Homo sapiens
  misc_feature (449)..(449): n is a, c, g, or t
gcatttccatgctgcctctgggccttcagcttctctgtcttcctccctcagcaccaaagccccgtctcttccattaggagcttgtcttcctgctgggggtgttacctgactctttggcccaccctcgggcctctgtggaggcctccttgaggcctgactggggggggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgcctgtggtcgtccgcacctgccaccggcctactttgtcctagacctcccttttgcaaaagtgctcagaaatataaatatttaatttaaaantgaaaaaaaaaa

SEQ ID NO: 591061 - DNA, 114 bp, Homo sapiens
cgtatccctttggaaactcggcggggtacactttgccgacgttccttttacttatttttaacccttctccttactgacgcactgcctgtgctagggttgaccacgtgacgggta

SEQ ID NO: 591062 - DNA, 104 bp, Homo sapiens
gagctgcagttcaggaaacagtgacagtatttatgccaatgataaaactcagactttcaagcaaaagttaggatttgtgaagcttttatccacataactgatct

SEQ ID NO: 591063 - DNA, 283 bp, Homo sapiens
ggggggcctttttaccccctgggttttcccctggggcccccttatgccccctgcctaagattgaggggaaaatttaaacagccccgccccccggaaaatagggttttggtggggtggtggttaaaaggaaacccccttttttggggaaggggtttttttaaaacttttcccatttgggttccctaattcgggttttttttcccccaaatggggaagggggttttgggccgggtaatgaaattgaattgccccaaaccccatagaaattttttggggtggccca

SEQ ID NO: 591064 - DNA, 508 bp, Homo sapiens
  misc_feature (124)..(124): n is a, c, g, or t
taaaaaagacccattttggccgtgatctaaaagggcattagctgatggttagtatacacaaatggggttgtagaatattttgtcttggtgcctggaatttgcttttacgaactcacttgagagncagcggccagggaagagctctctctcacctgaatgcttagcagagcaagccatcaaaaccttccaggaagtgcaagccaaagggtctgaattggaggcacctccccaaagatcaaaagttatgctccaccaacacagagacactgagaaatggttgaatgtgttctaaattaaactgccctggtggtgagcagagatctgccaaaatctttcaattaatcacttttaccttcagggcagagttaggcctgagagtatttcaatagatttttattggaacagagttatttcagatattaaactatgttgcacaaagtaaaaataatgttatttttaagttgctactcttgttaaataaaagttggcaagcgttaaaaaaaaaaaa

SEQ ID NO: 591065 - DNA, 517 bp, Homo sapiens
  misc_feature (40)..(40): n is a, c, g, or t
  misc_feature (122)..(122): n is a, c, g, or t
  misc_feature (136)..(136): n is a, c, g, or t
  misc_feature (143)..(143): n is a, c, g, or t
  misc_feature (145)..(146): n is a, c, g, or t
  misc_feature (186)..(186): n is a, c, g, or t
  misc_feature (220)..(220): n is a, c, g, or t
  misc_feature (227)..(227): n is a, c, g, or t
  misc_feature (275)..(275): n is a, c, g, or t
  misc_feature (296)..(296): n is a, c, g, or t
  misc_feature (430)..(430): n is a, c, g, or t
  misc_feature (493)..(493): n is a, c, g, or t
  misc_feature (502)..(502): n is a, c, g, or t
agtacattacacagctggatgagatgcagcggcactggcnggctgtcgaggacgagaagaagacgctgaactcgctgctgcgcatggccatccagcagaagctggcgctgacccagcggctngagctgctcgagcntggaccntnntgcagacccggcgtggccgtgccaaagccgcccccgaagnccaagccagccacaccgagcctgtatagtagctnccaggangactttggccacccggccctggtcacactgcagccccttccccttccntctcgtgggcccacaatgganggaaggaaggggaaacctaaaaaggcccactttagaaactttttggaatatgccacttgcaaattcttttcaaaataagcattcccccagggtttttaaatggggaagggaaaaaaaaggcttttaaatggttngaagcatggcttgcgaagcttgcttggcgttgggaaaagggcctcttggtaatggggcccggnagaaccccnttctttcccctgggc

SEQ ID NO: 591066 - DNA, 408 bp, Homo sapiens
  misc_feature (47)..(47): n is a, c, g, or t
actctagaggatctcggactgaagctggctcagaatccccatgtttngcgtttttcctcttactacttattatcactgagttggggagcctattctagaccccgaatgacctgtgagactctgaagtactccaaattagtgtggtgagagactggtgccttttatgggaaaaggcctgttttttccccgggaaagaatgcctattcagaggctaaagagaccgtggggactggcgtgtttggggtccccattaatcttggactccagcagtgggaagtaattaaggaacccgggtgatttggcttcccagggctctgatattccccctttccttgcccacacccttctttaccaggcttccagtgcttaccagggttcagttgcctgaacagggcttcagtggcgggt

SEQ ID NO: 591067 - DNA, 518 bp, Homo sapiens
ctctccagacaccccttgcccgggagcagctggacccagcctgccttctccagccccggggcggctgcttagccccaggtgccgttaacaatggccggcctgtgtcagggtccccattcaccatgtgcacaggaagcccagctcgggccatgcatctgattttgcaccagctcctgcccagcccacctgagaatgcagatgtttggatccagtggggaatgtgttcctgctccatgctcccaatttcagaacaaactttgagctgagctacagctttctcattgatccccttctagtcttctgaacaaattagtctgtgattttttatttttttccatttattgctgacccttttggatttatgaggccgtgtgagaggaattatgtatctcacacacacgcatctggcatgacgataaatctccaccactgaagccccgcagatttgcagcgaatctgatggctcccaggctcgctgccacgtggttggtgctgacgtgcggcgcaatgcggtggcg

SEQ ID NO: 591068 - DNA, 266 bp, Homo sapiens
tcccaaaacgcttgcaggaggcctataacaaacattaccagcccagctgggcaccatttagcagatgcaaccagatattcacagaaggggagcttatggatctccatgcctccacctcctgacatgccgtctgctagcaatatacgacgaccgagcaaacgctgcagatgccaaacattccacgctctctatccgattaaacatattccaaaaggctgattcgactgcacaggacggtctccgattctgcagcctactacagtagc

SEQ ID NO: 591069 - DNA, 468 bp, Homo sapiens
  misc_feature (35)..(35): n is a, c, g, or t
  misc_feature (73)..(73): n is a, c, g, or t
tgataaagacatttgaaaatctgtctttctggctntccgaattcggcacgagaaaaggctttttaaaaaaaangttcctttgaagttggggcatggatgcttacaagcctgtaatctcagaaagttgggaagctaaggcaagagaaccagaagatcaaggccagactggattattataatatgaccccatcttagagacatcgagaaaaagacagacagacagacagacagacagacacaacctcaatttctcagacccagtgggacatgggttgtgcccctatgaccactcacaagtaagttagctgggcgcttagctcagtggctgtagtagccctgactacagtagtcttggccttactcagggagccaccctgtcagtctgtaagcctctccgttggcctgttcttgcctagcccatcttcactgggcttctgtgtgggcactattacttggagcagtacattt

SEQ ID NO: 591070 - DNA, 107 bp, Homo sapiens
aactcgtagtaacgttagactaggagcaaaggtgaccaccatgagcgggtaagagaacaccagtactacacactcggacaacaggaacagtaaccaataccaccaat

SEQ ID NO: 591071 - DNA, 248 bp, Homo sapiens
agtgcgttgaaccccaggccagtcagccagcgggaagagctagaaggaccagaggccagtgagggaggaaagacccacagtcctgcaggtctggaggagccagcccttaggggttctctgcgccctgcaggagaacaggaaggagagaggcaggagacgtgagcctgcaacagagctgactcaggcaggggcaggatcctcccggtcaaggggaggagaggaagggctcctcagaagggggaagtagc

SEQ ID NO: 591072 - DNA, 385 bp, Homo sapiens
catatatctggataaaccatacaaatatgactgtaccttcaaaatctgacactaccactgataatcaatatcagtgcaattgcacgatgtaacagtatacgatctcaaactgctatgtatacatgtgtcttaattttatatgtctaacgtcatataggaatacctgaccccctatacataagaggggccgtaggcacatggcatatcataaactatggcctaggcgcagtcataaaatgcatactctgaaacaaacagggagactcgttgtactagtaataacaaaagtataatttatatccagtaggtataggtatcggctgaactgtgtgtcctcaaaattcatacgtttaagacctaaccctcaccaccatagaatgtgact

SEQ ID NO: 591073 - DNA, 137 bp, Homo sapiens
agcagtggaagaaatagcaccgtgtgagaaaggatcccttggcgtccttgaatggctaccaagcttgacaggtaatgaaaaaagtacatggtagagacaataaacgaacagaatagagagactgacaatgccagaag

SEQ ID NO: 591074 - DNA, 211 bp, Homo sapiens
gtgctggaacctgaccaggattgtcagtcaactcattgtaggactctggccttccttcaaattagctacaagttcaacaaagtggtcatatgcagtagctaaattctccaaaacttcttctcttaagttagcttcattattagatagtttcattttcgaaaatacctgatgtgagacctgaatatatttaagaagtcctgcgaacctatga

SEQ ID NO: 591075 - DNA, 122 bp, Homo sapiens
catttagactagggcagaacgctctctctcaattagatttctaatgaaatttcttaatcggtgcattgaggtttccacatctttttccaagcagtgccccacttcatggatttatagctata

SEQ ID NO: 591076 - DNA, 214 bp, Homo sapiens
  misc_feature (80)..(81): n is a, c, g, or t
  misc_feature (85)..(85): n is a, c, g, or t
  misc_feature (91)..(91): n is a, c, g, or t
  misc_feature (98)..(98): n is a, c, g, or t
  misc_feature (206)..(206): n is a, c, g, or t
  misc_feature (209)..(209): n is a, c, g, or t
aaagaaagagaaagaaggaaggacagattaaatctccaaagtaggagaatctattatatagcaaacaaacttgtgtaatnnatcnctcggnccgaatnaagagaaagaaggaaggacagattaaatctccaaagtaagagaatctattatatagcaaacaaacttgtataattaatctctaggagcacgggttctaataagcccangtncacta

SEQ ID NO: 591077 - DNA, 112 bp, Homo sapiens
cgttgggctcctccaccaccttcatcttcgctgcacctgccggcgcgggcccgccggccgagagcccgaggagcaacaggagccgcgccagccccgccgccatcgcgccgca

SEQ ID NO: 591078 - DNA, 909 bp, Homo sapiens
ggagaacccatgtctcggcatccgcggtcggatcgattaacccagggtcaatatgaagccgggtattgagtgtatatagatcaccccctcccgcgggtaaagctaggggctcacctgagtgtaaaaaactccatgtcgacatcaacgatagagcgtacgaaaagtggactttatcatatctgatatcacacaaatagctacacgcaccctagactggtgatgaagatacccgcgaccgtagtgtctggaggcgcctgagtggcctcaacaggtgtaaactcaacaaaacggctcgccagaacagtacgagccacagtttagatactcagaggaccctggggtgcttcatatccctctagaggagcctgttggctgtaaatcgcataagagcgcccgatcaacctcagcaggctcttgctcagcctatatagccgcatcttcagcaaagcctgatgaaggctacaaagtaagcgcaagtacccacgtaaagacgttaggtcaaggtgtagcccatgaggtggcacagaaatgggctacattgtctaccccagaaaactacgatagcccttatgagaacttaagggtcgaaggtggattcgcagtaaactaagagtagagcgcttaggtgacatcgggccctgccagcgggtgccctgcgcacggtgcatccgtcgtcaagtattccttcatgggagcttttaggtaacaggcctacgcattgataatgaggagacacacgcggtacaggggagagtcctgggagggaccgtcgacgaatgccaccagggaaaactccggtgaatatgtgccgctcgcgaaaacacaagatgcgggacacgcctgaggggcccaccccccggggaacatgttccccaccaagcggaacaagccaaatgcacacccggtggt

SEQ ID NO: 591079 - DNA, 811 bp, Homo sapiens
agcggggtttaggctaggagtgctggggaggcttgtcttgagttcggctttggtttgttgtttggtggggtgtggggagtggaaggtgtttgtctagctaagcccagcccacaggcagcagtcatgtctcacatgcctctctcgtcacagcatacctggctgtttaccctgagcccagcccctgcgggcccttgggtggggatgggtatagtttgcagaaacaagctggaagccggtctctcttaccagcctccgtgcaacagcggctgggagctgggagcagccggaagctgcaggagactggagcagcagcggctgtgtggacaggcacatgcaggctctgcggcgggaggacggcagcgagcggaaggcgggagcgcgagcaggacatatatgcgtccacaggctacgaggcaggagcagaggacagctcagagatccattcaggaagcagcgtgctccaaggaaacaggccctgctgcctggagatacaagacggaagcagactggacaggatgcagccggcacgccaggaagcggctctccagaagcgccagcgtggcagagcaggacgcaatgacctaaccgtcaaagatccactggcagcaggaaggcaaacgagacaggcaaggcagaatcccaacagaaccagggaagcgaagagcaaccaggctccctgacccggggacgacccagggaaagccgccctgcgaaaccagaaccgggctccgagggcccctgccaagaccgactggagcaagaccagaccatggcacccgaaacagggaagaacgcaaaaacacaagagacg

SEQ ID NO: 591080 - DNA, 257 bp, Homo sapiens
accgccatttacaactatgttgtgttcctctatgcttttcagccgagtcctatctgtaatggccctgtgtattgccttgttaaaatagtgaacatgcgcccgtgcggtttctcagtgttccttggagagaaggtattgggggagagtcaagcatttgaaccaaattctcacgactacccagaccccattcttgggaacctgctattactacctgctaacgataatactctcagtaatggtgatagttgtaaatggcg

SEQ ID NO: 591081 - DNA, 747 bp, Homo sapiens
  misc_feature (519)..(519): n is a, c, g, or t
  misc_feature (661)..(661): n is a, c, g, or t
cgccaccagggcggcgcggcccttctccgttagcgttgctgcttttgttcctgctcggccgcagattggtgcttgccatcttcttccatctgcccattaactctcgcaagtgcctcctgcgaggagattcacaaggacctgctctagactggcgcgtacgagatctccgaccagtctgggggcgctgtcggtctgcgcagccacctcaagatcacagattctgctggccatattctctactccaaagaggatgcagccaaggggaaatttgcctttaccactgaagattatgacatgtgtgaagtgtgttttgagagcaagggaacacggcggatacctgaccaactcgtgatcctagacatgaagcatgtagtggaggcgtaaaatttcgaaaagattgcgttgagaagctctaaccattataggtagagctgcgacgcctataagaccttctcaaatctatagctgacgatcttgcctacatgaagaagagagaagaggagatgcgtgctaccaacnagttaacaaacactcggggactatacttcagcatctttttaatgttctggttcattggactagatacctggcaggtgttctacctgcgacgcttcttcaagggcacgaattagttgagaaatgaatgaggcatattcttctnccaccttgtacctcatacaccgttggtgttttttgccagtcttttttgtgttggaggggggggccgcctcccccacaggatgaggg

SEQ ID NO: 591082 - DNA, 482 bp, Homo sapiens
taaacaccataaccaaaagagattaacccaggagtaaaagttaatgtaatattgaaaattcaatcaatgtcatatattaacaaaataaaggataaaaaccacagtattgtctcaattagatgtaggaaaagcaactgacaaaggccaacaactattccacagtaaaaactcaacaaactagatatagaaggttatttcctcaacctgataaaaatgtatatacaaagaacccacagctaacatcatacagaatagttaaatactggatgctttatccctaaaagaaggaaaaagaaaggatgtcaactcttcccacttacattcaatatttgactggaggttctagccatggcaaggagaagaaataaaagatgtctaaattggaagtagtaaattcatctctactgacagacagcatggtatttagtatactttctttttatttaaatttaaaaaaaacaggacggcccaggggaaagggc

SEQ ID NO: 591083 - DNA, 310 bp, Homo sapiens
ctcagtatgttgaagtgagagggatggcaagtaatgctttacgccagctggattcactcagagtgattcagcagcatgccgatagagggcatctcgtgtcgcttactgcttattctgttcgcctctgccttctctctcaaggacaacggccttcctgcagaacagtaaaacaaacatagacgttacgtggaacactctgacacccaggagtgtacaaaacacgtgtcaatgaaccacatggcttctccaaaattagcaccgggctcctgaaaacattaaactgcccagacagcaaacccataggcgacac

SEQ ID NO: 591084 - DNA, 457 bp, Homo sapiens
aaaaggggccggggggccccccccaattaaggggggttggccccccctttgggccccccgggttttcccttttttttttccggttttttttttggggggaattgtggggggaaaccattttcccccgggaaccagttttgcccttttttcccccaagtttgaatttaccccccctaaaagggaaaaaaagggggggccccccccggggggggccccttttaaaaaaaggggtccccccgggccccggaatttgggcccaaaaaagatttccctttcctttaaaaaaggaggcccccttaaaaatggcattttgaaaaaattttttttggaaaaaacaacttttttttttcccccccattttgggccttttggcaaaattttggaaaggtttttttccaaaattttggggggttcccaaattggtaaaaattttaaaaaaaaaaaaagtttcccccca

SEQ ID NO: 591085 - DNA, 945 bp, Homo sapiens
taaaaaaacccgggggccccggggggggggtaccccccccgggggggggcaggcctctctctctctcctttttttgtgcgtcataatattgtttttatccggggtcgctcctcaggaaggggggggaggggggggggggtcctctcattattgctcccccgcagatggtgggaggggtgtcctctctctaacaataatgaggttttgttgctcttcagagagagagagaggggtgttcttacacaaaatcatccagagaagaatttctttatataattttcgcgcggcgcgggagaagaaaagaagagagagtgagagagtcccccccaagagagagagaagagaggagtgtgtgtccaacgagtggggggtgatgtactgaccactcacgcgagggggatgcacacgagcgaatacaagcagggcgaggagctatccttccgagcgagatagtgccccccacaaaaaatgtgttttgtggcgggagacaacatagaattttctatattatctgccccgcgccagtctaaatatatatcttcgtgtacgagagaaagacagagtctatatctgtgggcgcgcaaagtgtgttagtgcgtgccaccagaggtgtgtggagagggcgcaccatttaattgtgcggcgggtggctgggagaaacaaaaggacgggtttataatcaacacgagtggagacctgcgagtgtgatcaaacatgaaggcggtgatctccgcagggacggcacaccgcggaactttttctttgtcgttgtatcacaacaaacgaagtgggtgtgaaagaaataacatttgcgtggcggcgtgtctcccccccaccaattaatgaagagtagaggaggctcgtgaatatataataaatattattcgcgcgaaaacaacaaaccgcggagtgtattataacacgcggcccattattataataatc

SEQ ID NO: 591086 - DNA, 329 bp, Homo sapiens
  misc_feature (14)..(14): n is a, c, g, or t
  misc_feature (125)..(125): n is a, c, g, or t
  misc_feature (305)..(305): n is a, c, g, or t
gtttttgacagagncttgctgtgtcaccaaggctggaatgcagtggcatgatctcggctcactgtagcctctgtctcccggttcaagcaattctgccccagcctcccaagtagctgggactaacngcatgcgccaccacacccagctaagttttgtatttttttagtagagtcagggttttactttggccaggctggtcttaaactcctggcctcaactgatctgcctgtctcggcctcccaaagaactgggattacaggcatgaggcaccgtgcctgtcccatgttgtacttaatagatatttnccatatacaattattttttaattt

SEQ ID NO: 591087 - DNA, 372 bp, Homo sapiens
cctggatctcggcgcaacattcacattgggaacctggacccatgagattgatgagaagttgctttatgatactttcagacgccttatcgggtcatcttacaaaaccccagaattatgcgggaaactgacacaggcaactccaaaggttatgcctttattaattttgcttcctttgatgctacggatgcagcaattgcagacatgaatgggcagtacctctgtaaccgtcctatcaccgtatcttatgccttcacgcaggactccaagggtgagcgccatggctcagcagccgaacgacttctggcagctcagaaaccgctctcccaggctgatcgccctcatcagctgtttgccgattcacctcctccaccc

SEQ ID NO: 591088 - DNA, 645 bp, Homo sapiens
gaactcttgaccttgtgatctgcccaactcagcctcccagagtgctgggattacaagcatgagccaccgcgctcggtccctttctttttatttatttatttattttgagatggagtctcgctgtgtcacccaggctggagtgtggtggcacgatcttggctcactgcaacccctgcctcccaggttcaggcaattctcctgcctcagcctcctgagtggctgagactgcgggtatgtgccactacactcagctaattttgtatttttttttagtagagacagggtttcaccatgttggccaggctggtcttgaactcctgacctcaggtgattcacaccccttggcctcctgaagtgctgggattacaggcatgagccactgtgcccggcattttttgtgttttttagtggagacaggttttcaccatgtggccagtagctgtatttagttatttaaggagggctcaatcaacaggtttaaatggtgtgctattcataatttattgcaaaaataggccgggctggtagttccagcacttagggaggccagcaggtgaatcacttgaggcccgggagtctgagatcagcctggcaacgtggtgaaatccgtctcttgtgaacaataaccaagtacggggcgtggtg

SEQ ID NO: 591089 - DNA, 135 bp, Homo sapiens
tctgtctcattcagtcgggcgtatatatgtcgaagaacagatatgcctcccacaatacagtgagagcattctcctatctatataagagctaatctgcattacagaaaaatgtgtagtagaatatgctgtacttcc

SEQ ID NO: 591090 - DNA, 330 bp, Homo sapiens
gcaggatgctgtgggtattctctgggtggccacttagaatttactgtattgtctgggtgtggtggctcatgcttgtaatcctagaacttgggaggccgaggcagggagatcgattgagcctcggaggtcgagatcagcctgggaaacacagggaggcccccatcgctacaaaatattttaaaaattagccaggtgtggtggcttgtgcttgtgtcccggctacttgggaggctgaagtgggagggtggcttgagtccaggagttcactgcactgagctgtgatcacaccactgcactccagcctggacgacagagtgagacgtccatctc

SEQ ID NO: 591091 - DNA, 123 bp, Homo sapiens
ccccaggctgagaacctggggaaaaaagtttttagaatttgggggagggtggggggagggagggccttgtggggaaggaaagggaaaaagggaggagcggggcttgcctccatgactttttca

SEQ ID NO: 591092 - DNA, 794 bp, Homo sapiens
  misc_feature (288)..(288): n is a, c, g, or t
ctcggttatcggaaagtgcaggaactggcaaatcttgcttacttcatcagtttattgaaaaaaaattcgaagatgactcaaatcatacaataggagtggaattaggttcaggagataataactgttggtggtaaatatgtaagagttacaaagtatgggatacagcatggacaatgaacgattcaggtccgtgaccgagaacgttattaccagaggcgctggcccggaggctctccgtcgtctatcgatatcactcagccagagaaacctacaagtgagcttactaanttggcttaacaagatgcccgaactgcatagcgcagccatgaacatgtgtgactcatcacttgggtggaaaccaagagaggacctgcgatgcagatcggtgaatgttacctttctatagatagcctccagtatattgctcaacgaaaatgatgctgatgttatgtaggtaaatcaagtgcgctcacaggggcagaatgtagaagaggcttttgtaacagtggtgcaagaaagaattagttaacaaaaatcgaatcaggtgagctggaccctagaacgaatgggctcaggtaatgcagtacggagatgctgccttgagaacaggtgaggtcaccgcggcgcgcacaggccccgaacgctcaggagtgtggtcgtgaggagagcacacaggtgtacatacaggggcatttgggacacaatcgtgggaacctgaagaatctgaagtttaatttaccagcatctttatctactctgtatggaagtcagatctggatggggacccagagaag

SEQ ID NO: 591093 - DNA, 199 bp, Homo sapiens
tgtcgctgatggcatcttcaggctgactgatgagttcttactcgggagctggctgaagatgctactctggagttgaggtgcgagtaacaccaaccagggacagaaatcattatctttagccaccagaaaacagaatgttcttggtgagaaggggcggccggaattcgggaaccgactgcttggattacaaaggagggta

SEQ ID NO: 591094 - DNA, 240 bp, Homo sapiens
  misc_feature (165)..(165): n is a, c, g, or t
  misc_feature (200)..(200): n is a, c, g, or t
tttcgagcaaaatgtttacatttacatggaaatacacactaaaacagaatattttcctaatcatgaaacttcgccaaagcaaaatacaaacttccaacgggaggtccactcaactaacaacaatgatccccaagcagggcaccaagaaacctgggggaccctttncaaaaaacctcctttcaagagaccctaatactctntccacacacccacacgatttaggaacttggacatgttcct

SEQ ID NO: 591095 - DNA, 407 bp, Homo sapiens
  misc_feature (396)..(396): n is a, c, g, or t
gacgagagctagcaccatgagcttcaataccctgttaaggaataatatgaacagaggagaataatctaattttagattagaaaagaaccccagagatcctgaaacactttcctctctccgcttccctccatgagataaaaatcactccagccagatagccaaattttgataaatgcctattatgtgctgggtacctttcaaggaactagagatcaagtgatgaacaggactgaacaggacacacaaggtccctgcctttgtggacttaaatgctaaaaggaagacagacaatgatcaagtaaacaagtgacacacccaaataaatcacttaatattcctaaaatcacacagagagttggatgtagagcctcgcttgggccctcgttttgcttcccnctgattcccct

SEQ ID NO: 591096 - DNA, 171 bp, Homo sapiens
gatttactggaatttatgcatgttgatctgggcctaccttggtggggggccatttctgcattgtacagtgtttttcccgcttgccttgattttttcccttattgttgacggggccaatccaagaggggaggcagggttccacaaattacttttccaaaagaatccatgaag

SEQ ID NO: 591097 - DNA, 225 bp, Homo sapiens
aatgcataggaaactctgcataagaatttactctatttaataaagttgtaccccatgaggacacaggttaagaattctgatactgacatccatgtatactggaattgaacaattaagtaaatagatgacacatagtgaaattcaggtttctcattattggaatgggagtttatagaacatcaagaagaagccagaaagtcccatgtggtaatgggtagtcataga
